United States Patent 10,233,495 (METHODS AND COMPOSITIONS FOR SCREENING AND TREATING DEVELOPMENTAL DISORDERS) - sequence listing, part 203

SEQ ID NO: 1601 - DNA, 959096 bp, Homo sapiens
gttcgacgccaggattggctgcaagtagggagctttcgccgccgccccgggcccctcggactgtgccggcgccgcacccgaggctctcgccagcccggcgccccggtgctgaggtaagtgaggcggcagctgtgcgggtccggctcctgcgtgggcgcgcgatgccccggggacgcggtcgcgggtgtgggggggaaagggcagggtccgcgcgggttgcccgaaggacaggggcgcttcccggggctctgactcccgcggggccgggcagcgtctgcggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaacttctggggggtttccagtttctttcgagaggcaagacaaccgccccgtcccctccccgggcccagacggcggcgaactgtgcgccgggcgccccacagaccccaatccactcactctccttctggaacgcggggctcaaaatcttcgtgcattttctctcttgtgcttcgtgtatatgttttactatttatgaagggtgtggaggtgagggtaggaggacgtgggctcctgaatccctctgaaccagccagagagtcggctgcatggaaacatttcgcagcgaagctcctgcgaggaggcggcttcgcgcgtcgggaagatcaggcggttgcttgctggccagggtctgcagattcggtgcgaagaagctggcggaggttgtgtagggcgagtcagtgtgactgagcaccctgggtgtgtggtctgcgtggaggagagtgggccggatcttgaggtgtgttggaggtttatttgtaagaggagttcctgaaaggaatgtcgtggaactttttctagttttcctgctggaatcaacataggggcgggcacatgtttgtcagaataacagtggcatttaactgcatgggaagctctttcaattttctgtagtgggagctggatagttcaaggagtaactccacataactgagtcgtttggatacccacacaagataatttggaacgcgcttgtatttttttgttttttgagatttctggtttatgtcctttagagagtggggtaggagcgtaaagactgtataggttgcctatgagcaggtccatacaatagcgttcccaagtctgcctaatagcaagtttgttctctctttctctctctctacccaagtgggtgaaaaagaacagtgtgtcatgaagacaggcacctggaggtgatttgggtggcattcatgagaaaattcacgttacccgtaagtttattcttgctatttttatcttgatttctttaaagattttgtgggaatatctgcagtgggtcgcaggagtaggtaagattgctaaggatcaaaaacaagtttcatgagaatattatttttgctaccttataaaatagctattgatttgtttgttgaagctggtttcaactgctctgtcttgttgaggagagatgatgctgataaacgtcattatttttccatctgaaccctgggaggtagctggcaaggatggaaaaactgaccttttcaattaaagactaagagtctaagagaagtgacttggataagggtgcatgtcagagccacatgtaagtttcaacagaggtagattttcctatttgcagttttttaaacaacacttttcagtttctttgagttgtaaaacttttcaagtcaattgggagtcaatgcagtacctttttccatggtcatttcatattggcaggtaattaagagtgattagagaacaaacctttcaaatgatgttggattttttatcattcacttattttacctacttctctctcctttttgttcaaaagtaggtcttctgatttcttttccgatctaagcactaaatcttttggctgcagtttttcttctgaaatgtatacagggcatccgttccttcaatttaggtcttaaaaaaataaagctgctcagcagaaaattcccatgcatggtactgacttttctacaagtttgtctgatcatgattttaacttgttgtttcttctttgttatatttgaggacagacataatatgcattagcttcaatctctcttatcttaaaaattaatattttgtaaaaacttgcttttatattattttagttgaataagtctatttcatatgataggcagggggaagtctctacacactgattttttttgttcctttttgttcatttttccctgtaatgctatgttttaagcctagtgaaggaggcaaggaggcaggatttactgcctagatttattgatcttcattattattattatttactatcagaagaaatctgacaacatatcaataaaatttatttataaactgaagacatgctgttatatgatacactacttataaaacacacaaagaaacaaaaaagatgaataaagcaaaaattatgaaatagaaggtctcatgttgctgttatgtatcccggtggatcattttgtacagcccctggggtgtgtagcacactttaaagatcactgctggtttgatatttttaaaatctttctctccttatctctgctctgctgttcatcatctctgatactctagccagttgtaaaactgctacacttctatatcttctgtaacaaatagattaagcacacttgttttcctctcatggactcatatgtggatagaatgaggtgtaaaggatgaatgtgttttggagatgtcatcttagatctcccaaagtagacatacaggtgaattttaaaaaatggagttttagtttaaagactaagtaccaatggtcaggaagtgaagaatccaaggagtaaatgagggaggattggaaggacactttccacattgcagtgttgtgtggaggctggaaagttcataaaccttgaagcagattaacctgaatctaagtctggcaccatcatttattacatttacagtcctgggcaatgtagttccttaatttctgtgagccttagtttctttaggtataaaattgggataacatctatttcacggcatcacgatagggattaaacatgagagcatgagtcaacatgggtcaagagcttggctcttttagattggctctttagcagatataacagatccaaaagggatactgcctcagatgtgaaatatatttatttctcggttgtgtgaagtcccagaatgggtgatcatggcagtactccttcaaagtgtgattcagagacccagccttcatctgttctgtgcccttgccgtcttcagcagggtcactgtgcttacttgcatcaagccattggaaagaggaagacttgggaggatgttaattgcccagaactggaatgagtgcatattacttttccttgcattgtgctggccagaacccagttctttgtggatgtacgttactattaaggaggctgggaaatatagtctagaaatgttatccaggaagtagaagaaattgttgggggaacaactagcattctctgatgttttattactatatgtgatatttcttccatgttcaataactgttacttccttttcttctcctaacccttgcttttttttttttctggtagaaaaactggaatggatacaataaataataatagaagcagttaatacatacataatgcttactattattgagatactttttaaagcacattgccctactttgcccttctaatattatctctattgtacagatgaggaaaactaggcatagagaaattaagttatttgttcatcatagctagtaagtagcagagctgggatctgaaccaggttctctcactccagaattgattttttaacagctttttttttttttgcttttgcctcaatacttttcttatttaagccactggaccgctttttacttttgcctatatataaaaaagttgccaagagaattttttaaaatactaaagtagaaaaaaaggatataatccaaaacatactggaatggaattagatatgatacagctttatcttgaatacctaccaggatcaggagcagatatttaaagtaactccccccacttacacacccttcaccactacaactgctctttcatttgtgataaacacattttcagggtctgtgccttgaattataaccttcctctgaagattctattgtgggagtcttgcgctaccactttcatgcttcagtatgtgaggataaattcctcttcacttctcagcagaaacaaatatcttccctggcaggtttttcagctaaaatagcctctcctaacttttgatcaaaggtattgctctttatcaatatccccatcctccaagaaaggaaaccctcttcttttcctatgagctttgcaaaattattttttatttatctatttatttatctttattttctatatgactaaggggactgtatatatatcccaggtaccgtctaaaagaaaatggtccctcttgttctcatcctgttgtcccatttccattagagaatctgcctcatcttatgtttcctatgtatttgtctttcataaaaatgcctgttagagttttggttcccagtggctgcagtggaaatgtgtagtggtcaatagtaagcgtatactttttgctaagatagttattgtttcaacattaaagagtgatttttttcctcttgttcagtatgtatttgttgcatcttcacaattaggtaatgatatgtatcttcttaccatgtaggtaggcataaatactgtatacctaccagtcatttctttcccagaagcccctgttcatttcctctttactttccctgagcctcacatcctgagaattttgcttttttttctgaactcctctttcttccaattttttccacttctgtgccatttatgtctacgtgtgtgtgtgtgtgtgtgtgtgtgtgcgtttcaagtcccttcttatgatttaatggggttggagggctggagaggttttcatgtgcttactgtcatgttttcagccaaattccacagggccttgtaacaggctaacatgagcagataagctcttaattttcagtgacttattttaactttttacttcttgctcatgtgtggtagttcagtactcatagaatagatcctgactgagtggctgtccatggggtcattcagggaatcaggttccttagagttttatggctttgttcatctttaagtacctagagtcctcatcattcagtcaagatacagagtgtgaggagataaataatccagagaagtcttattggaggttgttgtaggcacagcctggaagtggttgtcatgacttctgcccacattcctctggggtggacctcagtcacttcgacatcctttgctgcaagggaagctgagaagtggtgtctagctgagtgcctgggggagaagggtgaaaggaaaacaggtttggtaaataactagccagtctttgtcacaggtttccaatgaaagcatgtgagaaaatcagctaattctctaggtatggggaaaagagagcatggattttggttatttgccaaataaatgcccattgccttgcttccttttaattttgacctctattactatcccattcttagtgcatatggtctgggtgggattccgtttcccatttaaggattggagcatgggaaccaggtcttgtcgggaagagcattgacttttcctgtccacagtaattgcttctagaacagaacaggcatggacccagtgagaaccactgcagtgagatgctttgctttttctcagtggctctagttgggctccatgtatgcctttgaactaattcctgtagataaggagattagaaccagggagcatgtgggcctgccactgctgcagctgtcttaacaccaaaaagagaacctagacctgctgaggtcaccacatactacttgagaatgaagccaacagaacagtagcaaggggcatgatggagcaaaaccagctcctcttgcatcatgtgagcccgttaatctggctatgcctaaagtgagttaacctggtatattagtctattctcacactgctagaaagaactgcctgagactgggtaatttgtaaaggaaagaggttcaattcactcagttccgcatggcctcaggaaatttacaaccatggcagaaggcacgagagaagcaaaggcaggtcttacatggcggcaggcaagagacagtgaaggaggaagagccccttataaaaccatcagatctcatgagaactcacaatcatgagaccagcatgggggaaactgcttccacaatgcaatcacctcctaccaggtcccacccttgacacatgcaaattatggggattacctttcaattgatgagatttgcgtggagacacagagccaaaccatatcattctgcccctggcccctcccaaatatcatgtcttttcacatttcaacatgccttcccaacagtcgcccagaatcttaacccattttggcattagctcaaaagtccacagtccaaagtctcatctgagacaaggcaagtcccttctacctatgagcctgtaaaataaaaagcaagttagttaattccaagttgcagtgggagtacaggcactgggtcaatgttcctattccaaatgggagaaattggccaaaacaaaggggctacaggccccatgccagtctgaaaccaggcggggcagttattaaatcttaaagctccgaaatcatcttctttaactctatgtctcaagttcaggtcatgctgatgcaggaggtgggctcccactgtctggggcagttctgcccctctggctttgcaggctacagctcccctcccaactgctttcatggctggagttgagtgtctgctttcatggcacacagtgcaagctgtcagtggatctaccattctgaagtctagaggaccatagccctcttctcacagctccattaggcagtgtcccagtggtgactctgtgttgggagctccaacccccatttcccttccgcactgccctaacagaggttcttcatgagggctctgccccttcatcacacctcttgcctggacatccaggcatttccgtacatctactgaaatctaggcagaggttcccaaaccttcatttttgtcttctgcacacccacaggacgaacaccatgtggaagctgccaaggcttggggcttacaccttccgaagcaacagcttgagctataccttggccccttttagctacagctggagtggctgggacgcagggcaccaagtccctaggctgtacacagcagggagcccagtgccttgtccaagaaaccgtttttccctcctagacctctgggcctgtgatgggaggggctgccgccaagatctctgtcatgccctgaagacgttttccccattgtcctggctcctccttacttctgcaaatttctgcagctggcttgaatttctccccagaaaatgggtttttcttttctacagcatcatcaggctgcaaatttttcaaacctttttgctctgcttcccttttaaacataatttctaatttcagatcatcacactcaagtttaaagttccacagatctctagggcaggggcaaaattctgctagtctctttgctaaagcatagcaagagtgacctttgcttcagttctcgataagttcctcatctccatctgacctggacttcattgtccaaatcattattagcattttggccaaaaccattcaacaagtctctaggaagttccagagtttcccacatctttcttctgagtcctccaagtctctagtaagttccaaactttctgacatcttcctgttttcttctgagccctccaaactgttccagctctatctgttacccaattacaaagttgcttccacattttcgggtatctttatagcagtaccccactctctgcagtaccaatttactgcattagtctgttctcacattgttataaagaactacccaagactgggtgatttataaaggagagaggtttaatggactcacagttctgtatggcttgggaggcaacaggaaacttaaaatcatggtggaaggggagagagaagcaaaggtatatcttacatggcagcaagcaagagagagtgaatgagcaaaggaggaaaatccccttataaaacgatcagatctcgtgagaatcattcactatcacgaaaacagcatgagggaactgctcccatgatccagtcacctcccaatcaccacccttaacacttgggaattatggggattacaatttgagataagatttgggtggggacacagaaccaaaccatatcagctggtgattttgcagctcttcagattcataaattaccctttgacgtaagctgatttgggttggatttgtatgacttaaagtgaatactgatttattagaccaagcaaaaaagaggaaagaatactggataaggaagggagtgggggttttatttgtttgtttgttttcctgagctcatcttatgtcactttggttgtgtgcctaacagtttcactcccttgtaatacatcagacttccagtcaagaaccatttggcatacccctacccaggcacatagagctctcactaaattataaacccgaagctgttaattcttctcaaagctgatctctccttacagagttatggaagggaaatggaggtgaaatcacatcctcaggcttaattccctctttcaagattgcctgtggtccctcctggatgatgctttcttttccagcatcacttccctgttcctatcctcccccaggcttgcagaccaactgtaacaatctaatcacccatcctggaacttttcatgtgccttttcttttttttttttttttttcatgactgtttacattgcctctctctttggcctcctcttactgtccttgtctactgtgtttattacagtttgcacaatgctcaactcaagtatcactaagttaagcctctttcaatactattgaggcataaagaatggctccgtcacctgtacatactctcattgtacttgtttccatgccactgatataatatctgtcatgagaatgaccatctctcttgcttttcccaggacaggggggttcccaggatgctggatattcatttttaaaaccaggaaagtcttgatcaagccaggagaaatttgttgccttgccttctacattgtaatagctctcatttaacatgccactcggtgcaatggaatttcattgagacagtggataacagcttgaaatttggaggcaaaattcttaccaatcctagatccattttgtactagttgtgtgattgtgagcaagtgacctaacttttctaggttacagtttcatcatctgtgtagtggaatagtatgtgttttgtagggttgttagctaattaaaagacatcataaattaaatcacttcgtttagtgatggacacatctataacattgtctaaagcacacgagttttgtgaagattatgtagagtactacatgcaaagtacaagcaggacagtgcccaaatcctagtaagcatccagtacacagcttttgttatggattgttgttattcacttttaagtatctcttgcctaaaacatagtagatgccaaaaatacaattacactcagagaatacatgttcatggagcataaacaatgttactcagagtttgtgataagtggggcaagcaagtcagtgagagtgattaggaaatattttcgataattacttggtctttgaaacttgaaaaagctggaattgactgcaggattagttcctttttagaaacagtttgttttttcttgcatatttaaaccagacttcacaaattttcatagttcggaaagagaaaatattttccatgtttaggcaaggtcagtattggtgcataacccctaagtacatattttcattatttttattaatgaaataaaagtggcgcatttgggggaccaaaatgcaaatattttgtctttcttttggttcataagaaagtgaaggttagggcagtagaatcactactccattattaatcattattccataatgatcttgagttaaaaaaatcatatgatttgttgttgttgttgttaaccacagtgacatatcctctctacctttgggctgaacttttgtatataaaaatactttgtaacttgcacacttgtattaatataaatcttgagtgtccatgttgcctatgcctttcagttttgtcatggaaatttccagtgaggacaggtgttgcatgtgtgcttatgctgagatgggtccagtctggacaagaagacaatcaaacaaaacaatgatatgactcaaatcaccaagtatgttttgtaagatttgattctaggcacattgtcatcattttaagttgtgcaaatttgtattgttatccatattatgatgggtcttcaactattaattataaatacgaatttttttgtctttagtcactcatttgattagctattagctagatattgattctagactccttacagattagtgaattaattgggagtccaagcattatttttagtgtatttaattgggtgaatgacagctttatagagaaagtgattacttaagttgcatatctaattcttagtaaaaaattatagtacaaacaaggtcatctagaattcttggatctaagtaatggtaaattaagagttgcttttaatataatagtatcttttaaaaatggatatccctgtaaaatgtcttcattttctgcttaagcaggtgactaaagataatttacttcttgatgacacgggatcaccatgataaacatagtttggtggtttagaatagagtatgggccttggaatcagacagacctggtttgaatccttgttttgtctcttactagctgtgtgatctcaaacacattcttacttttcccaaggcagtttttaaaatctgtaaagtgaagttgatcctgcctgtcttacagataggctgtgaacattaatggtatgcattgaagactttaggacagtgtgcatggcacattgtaagcattaggtaaatgaaccgtatactacaatctttacaacttatacagaacgtagtatacttaaatgttttatatatttgttgttcattgtttcaacattctttgccacattcctgtgacactgggggatgcaacaggatcccatccagtgcagctgaagtgttgagaccgacactggtgacctccatctgctttctgctgcctttcagattgtcatattataatctttcgctttggtgaactagccttttccacttgctgttttccaccatttgtgaactggaaaaataaaatacacaagctgttcaaacattcttagtaagagtaaacagattcggagtgagactgtgaaggggcctgtttctcccctccccgccttttttttggttgttgttgtgagagagtaatggtatgggtgtttcacatccattttcactgttctcagctttacctctctacttcctggctgaggtactgagagtaagatatcactataccatagtggaaatagaaaataacctgctttgataatattgtgacatgtatttgtgatatgcttggcagtagcatcatgttagtgaaaattcctgtgttacagtgtggaatgttggctatcttacctgtagtacaataaacttcattcaaaatcctgtgcttagaatacagcatgatctttatggtataaagaggttttcttttctatttttttccagcacatttcaaggtcttactagttactagagtctaactcaaaagccttagtatttaccctttattttcttttttaaatccagtggtcagaattcccgataccaaaacaattatggatactattaaggtggctgtaatgcttatatacgcactgtgagttcattgagaattcatagttctgttaattctactcaattcttataataattgaaattcaccagcatattgttgtttatagtatgtggtgtaagtgaaattaatacttttcttttaaacattagtattttcagagaagaaccttttcctgttcttctgaattaatgaattgttacaaatttttgtaggtttcttataatgtggctacttaaatcaacatattaaggtaaactcttaagaaaagaaacataatataatgtactccccaaaataatgaatcccatgttttaggttggtatttagtctccacagctggaaaacactattttatgtgatgtataggaaaggctggaggcagacttggtgatttagaatgactcagtgattcatatcctgtctctactacttatgtatttagtatatatacaaatatatattaaagttagtatgtaacatcagaccaagtcatttaaccttttttagcttcatttttctcttgtatataatggaggaattcctgtagggttgtgaagactaaagttacttaattgtatatacacatagccttgtgccaggaatataattagaccatccctaaaaatgctgtttatcatgattttaccctttcaatgcatttattcaatatgatgcttgtgttgtagatgaaatatgtggatgttatgatttacaaacttgaaatttcattattttaaaatactctgtaaagtgatttatgtttgctcatatgcttttatctatgggatagacaatgcaatcctctctgtgtggagacagaggaaggcaacatttccatagtgtgttgttttatggttgactattactgcgagccactgtatcagaactgagatgagattagcactatttgagattttattttggagaaatggttttggctatggtcaagaatcttatttattagaaagaatgaattactgaataggctctcatctgtattctttctacttcagctatagcccatcttgccatcctgtaaaagaaatgctgacagtgacagaggagaaatataaaaatgtttccagttgctttcagtcaaatgtgattgaaattttataaaagatttacacattttttatttgtaatactgacagtactgggaaatgaatttctgtttactccagagaatagcagtcactttataggtgctttgaattttaaaacttagcaagcataacaataatgactggtgtattattaacatgcatgtaaaaggagtttaacatatctgaagagaaactggttaatgttattttacttcctatgtgtttttacagcctttcaagaatgaaacattggtagtaagtttgttttgaatgtttctctatttcatctttgtatgttggtttactacctattgtatgggattcaaagaatgtttatatcaaaaactgttttgtttagagcttatcattaaacctcattacttagatgttttaattacttttatatgtttctttctgtatttctaacacatacaatgagaatttactgttttccattgtgttttacatttttttcttctggtaagttactaagctaactcacatcagtatcttaattcctggagagagacccccatccatttatgtatatcctatagatctgattatggccttgttatggaaattggcctgactacaggcttctagtcattcatgccctagtattctcccctgttaggtaatttccaagatgcaccctctactatagtttctaagtaattcttctgagcaccagaccaagtattcatggaaggcctaaaatatatactttcaatggaaaggatggtagaaattcagccaattctgctttcttgggcttttagatattaaaaagagctatagaaatataattacactgatggatttcactgctctcaattgcctgaattatcagggttgagcaactgaagcgggtggaagggctgtttcccttatatctgaatataacataataaattgtccatcaatagggactatttgagtttgatattgatctttgatgttatgtatgctgcatttcattgattaaaagcatgcattctagttgggtctagatatacagtctaagtacatgatctatagttcagaatagagtatcatttatatagaaatttgcccatggccgtgttgtaattgtagcccattgattggcatctccaaggagcttgtgagaaatgcagaaattttttcctcacgcagatgcactgtatcagaattttcattttatcagttgatttttattaaagattgatagacattgatttgcattgtattcttaactaactgaaacaactggttccctgctacgaagcctaaatgtcaagcatatacacaacctgcttaattgtatagtaaggacccaatactataggatgaaggataggtacagttgagtttggccaaatgatgatcagagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggtcctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagtagaaagatgagcagaattttcagattgggtttggaaagagcacttaagaaagagggtggccaggtggtggctcacacctgtaatcccaggactttgtgaggccgaagtgggcagatcacttgagctcaggagtttgagaccagcctggtcaacatggcaaaaccccatctcaaaaaaaaacaaaaaaatacaaaaactagctggcgtgttggtgcccacctgcagtcctagctactcgggaggctgagttggtaggatcacttgagctagggaagttgaggctacagtgtgctgtgatcctgtcactgcactccagtctggatgacagagcaagaccttgtctcaaaaaataaataaataaaattaagaaagagggtatagtatgtacaatggccatgggcttatgaggaaaaatggcaagtttggagaatgccaaaggtatgagtggacgctaggggtatgggaaggtggcaatagggccttcatttacacagtttcatagactagaatgtgaatgttatccccagagttggaccaccaacaagcagtgactgtgattgttgcatcatggctttgtgcaaagtagcatctctagcgaatgggacaaattggggaatatgagggaattgggagatattctttatgctgtagaaagccactgcaagatttatatgacaaggtatacagtgctgatctgctgaccaatatattttctggcatcattccgtgtttctctcttgtgagtgaggtgcattcctttgctaataacatttgctgtcctcagacattattaaaggaaatttaatgctgtttgacaacatttcaagtagtagccattgatattgtcatggacatttattgttaatcacaggaacaagtttccttttctaacagcaaaatctcttccactgtttgcagtcttgtgtgatgatgaaacctcagcccaccctcctaataggcagtggaccatgaggcctctctgatgagccttcagccaggctcttctccttgctccagtacatcatgcaggcatgtgacctaagttgcaatgatcagaccctctcctcatacgtagaatcttgggcttagtaacataaggatgaagaaatggttagtagatgtatgctttttactgtgtcagtgtcctggccccactgaacatggtgtgtggtccaatattaatggtatctctactgggggttttggagctgctttgtcctctagttcttccttctattccatgcgctctccatatccttttgatagtctccttttcccaaagttggttattctttcttggaaccaaggaactataaagagaaatggaggttcttccaggtaaccctgtttatcctcttagctttctgttagggacatccacagcacgagacacacaagttagcttttcagggtgcctcttgaggcctgtccaggaatttggaaaattcatcctcttaaacagcccatggcattttccacagtttatggtaagtactcttatctcagtattctgcagaatgcagaaaggtaccttgtaaacttggggtataaatctctctattggttttcaagttgtggtgtatagctttattcaaagggaattctaacatttcatacaaccgcagctgccatgttatttcttttaaaagcttgtgccttctctgaataattcatattgtccagtgccttcagattgtttcataagatcaacacctaaaaagtcctttcttgttctagctaatacttaaagactcttttgcaaatgtgtttctagaaattgttatcacagttagggtgggcatttagctttttgtgcctagcctgtaaacttggtcttattaactttgggaaccatgagtcttggtatttatgcagtgagacttaaatctttctcgaaggtgctttatagtaacctgcatgtaaagcctctaacttgggcctggcactcatcattgggttggaccccaatcctgatgatcttcaaatcctctttcatacatagccatcaccactaaagtcttattcagctaatgttagaaacaaagcattgcaggaggcctcatatctagtaaatgcactttcatacccagtttactgttatcctccataattaacgtgaggcataacagaaaataatcatagaccaggcatacatctcaaagcttagacatgttatgaatgtcactccacataccagctccaatccatcattcctgtcctcagcttggaagtggaggaggggagacgtgtttatgggactaaatataaactctgtggggtaattgctacaaaatgtcatcctcagaaacacctgggagctttggaagaaaataaaatttcacagccccacgctaggtaataccgaatcagagtctctgggaatgagttttaggaaactgtagttgaataggctccccatgtgattctgatgttcagccaggtttgagcgctaaagcatgttctgtggaacactaattcttctaggtagatataaataggattccctttaaaagtgttcttaacaaaaacagaggaaattcaggattttaaacaggttttctaacacgagaatttttcagaatctttatgtgcattgtgaaatgcatgtttctgactatggaacaatcttgcttctctatcccccctgccaactccctacccaacacaaagactctttactaaacatctaatgttgcagatttcagccctggctcctccttagaataatccggttaatcgatcgatctggggttgggggtgggttctgtgtgggagaaacaaactcaaagtgtgttttctattctctcactcaaaaacaatcaatagagaagatttttgtgaccaaatttgtgggggaatcacccacacatcaagcaagcaatcagttttccagcagacactaactcagcgtcctctaattcagttcagtactgacactctctacttagagatagtctcagatcacagaggttgagggctcagtcccacaagactgtcccctactcccaatgccacaggcaagcctctggttgcctgttttaatggcatttctaaaacagaccagctataaattggtgttcccgcaacctcctccttgggttcagttaatttgctagagcttctcacagagctcagggaaacacgtttactggtttattataaaggatgttacaaaggatacagatgaagagattcagagggtgaggtattggggaaaggccccacactgggcctttcatgccctttctgggcacactaccctccaggaaccttttgtgttaagctgtctggaagtgcatctgaacgctgtccttctgcatttttctgggagcttcattaggtaggcatgattgatcaaagtattggccattggtgatcaacctcaccctcagtccctctttccttccaggaggttgggggagggggctgaaagtcccaaccctctaattatatcttggtctttatggtgaccagcccccatcctgaagctacccagtagctgccagccattcatccgctaattagcatacaaaagattttcctttggaggtcccaaggattttaggagttttatgtcaggaaatggggtgtaggacaaatacatatattttaccacttcatgggctaatggaatattttaaaatttcccgggtgattttattagacacgcagggtttaggaccacagatgcgatgtaatgttctttggaagacattctggatgatttatttatttaacaatgtgtcccacatcacccagattttttagtttcacatctgtcaggtggttttactcaacttacatatgtatcatcctatgtttagagcttgtttttaaatatctttttttctgattataataaaaactttttcttagaaaaaacaccccagctattacagacactcttagataaaaatgcattggttgtctaagtgaattttaatcataatgagtaatattaattgaacatttataatgtaccaaggaagtcactaaatgtttttattatattatctcatttaaacctataatagtcctgtgagctagatgctgtgatgacccctgggtcctaaatgagaaaactgagaatcagaaagagtaagtaatttgtctcaggtcatgcagctaataaatggcaatactgatatcatatcagatcccaggtatacctgattgtgagctaaagctcttaaccaatttggaatcctggttaagacagaggcttttatgtttagtgatcagtgtatgcttaaaaccccttagtatgtacatgttactttgtgaagcacattttattgcaaggaaggtgaatcttcataaatgacaggggtttaggaaagtattccaaatgttaagaaccattttaaaatgggaagattttcaaccaaatatttgcatatgaatgtaaacagaatttttgtagttatagtagattggtaatttgtgcatgtaagttatatattattcattaatctgaatgtatttgaatattccaaattcactgtttacatatatttttcctaccgataggcttccaaatgttgctaagcttccagaaatattgagtttgatagatttttttggttcctctggccagaaatttaaacaaaaagaaaagaatgatttggactactggcaataaaactcagtgaaggggatttatgtacgggtccgaatgcatgcttattagtcactcagaacatgatgtttcattttaaaagtacatgcctttgcatcttgttatgacatttagaaaaagttttcagttgcatgtctttcattttgccagagaagataaattgactaatatgtaaatgacattacagggtccaagtgtaatggttaattttatatgtcaaccaggctaggtctggatatttggtcaaacatgtctggatgatgctgtgaagatattttaaagatgagattaacatttaaatcagtggactttgaataaagcagatccataatgtggtgggccacattcagtcagcagagggccttcagaaaaaaactgatctcccaggagaaagaattctgctagcagacagcttttggtctctggctgtgacattaactcttcattgcttgtccagtctgttaacctgccctgcagattttgcacttgccaacctccataatcacgtaagccaattccttggtgtgtctctttctttctgtctctctctccgtgtatacatctagtccatcctattggttttgtttctgtggagaaccctgactactacaccaatattccttattctccctgtatgagaaagtttctctagctgtttttagaataattttatttggatgtccttacccgcaaaatcaactgttagacttttgcagaatgattagtgatggatcataccaaatactgccatctccaacactattgatgtttccccaggcattgggcaatttcatagatgccatatagagtaaatgggaacacagaaagttcaaagatggaatttgttactccctggaaatttgtagtggtaaaggtttccaggtgtggcttttgtcttccagtccaagtaggataatttagagaaatgggaaaataatctctttctagaatccacttcatttttccatttaacctacaggtatcaagtgctactaagccgtaggaccaagctagatcctatgggtagaaaagaaaagaagtggatatggaacttgccatcatagagcttagggtgtggtaggggttacccaaaaagagttaaacaattaatactttaaaaaattataaactgtataggggctctgaaggagaaaaggaaagtgctgagatagtgcataatgtgggcaggatctagtgtaggtggcagagtcaagaaaggcttcttggtaaatgtgaattttgagacccccaaacttgagatggagctagccatgcaataaccagggaagaaagttccaggcaacgaagacagcatgtaaggggcagtaggtaagtaagagcttgactcataacctgatttaagttttaatgtacaaacaatcaagttgtcatgggtcaagaaagccttagactaagctgagtgaagggggctctaaatagaatcatataggagaaataacactgggaaaatgaggatagtttagctggattctactttgagagtatgataaaggagaaacattagtttcacactttactagtttttaaatatgtgtaacttccatattatttaaactataacatgaggcatttaggttatatatatatatatatatataaatatatatatatatatatatatatatatatatttttttttttttttttatgcagagtctcactctgtcgccgaggctggaatgcagtggcatggtctccacggactgcgagctcgcttcctgggatcaagcaattctcctgtctcagcctcccgagtagctgggattacaggtgcacaccactatgcccagctaatttttgtatttttagtagagaggagggttctccatgttgatgaggctggtcttgaactcctgaccttaggtgatctgcctgtgtcggcctcccaaagtgctgggattacaggcatgagctactgcgcctggctgataaataattttttaagtatgcatgtgactctcacgagtgtggactgctagctaaggctggctcatcaatatttgtctagagatcttaaaactgagtgaaatactgtctaagtgaattttaatcataatgagtaatattaattgaacatttacagtgtaccaaggaagtcactaaatgtttctattatctcaattaaacctataataatcctatgaactagatactatgatggcctctgggtcctagatgagaaaactgagaatcagagagagttagtatgaggctcctcacactttgggaggctttctctgcatctgaagccacttgaaagtctagactcattgactttgtgaattttaatgacttccttcctccctcccttccttccctcccttcttccttccttctctccctccctctcttctttccttcttttttccccttcctctctttgttccttcctccctcttaccaaatgctagtacagcactggatatggtgaatatatcatttcaggcataagaaattatatgccgtgtaatcccagcactctgggaggccgaggcgggcagatcacgaggtcagaagtttgagaccagcctgaccaacatagtgaaaccccgtctctactaaaaatagaaaaattagcccgatgtggtggcacgtgcctgtaaacccagctactcaggaggccgaggcaggagaatcgcttgaacctgggaggtggaggttgcagtgagccgagatcacaccactgcacccagcctgggtgacagagtgagactccgtctcaaaaaaaaaaaaaaaaaatgaagttgtgtgcacggggacccatatcctccagtcctatagaattgtaagttggttactatagaacttgtgctgtatttggaacctttcactgaagaatataagcaaatgtcaaacctgtaatttgtcagagtttccatttcacaatctgaagaactgaagtgtacaaccttcactctgcattgttgaaatgaagagaaagagttaaaggtaattatccatataatttgaaagaaaaaatgtctccttctgctcaagaagtagggtctgataccttgattaatttgtactggttactaatatttaatttccctggatagtgtctgaactttccatttcagtttgccattgtaccccctttgtattttaaaattatttttctttatcacacctgtaatcccagcactttgggaggccgaggtgggcggatcacgaggtcaggagatcgagaccacggtgaaaccccgtctctactaaaaaaatacaaaaaaattagccgggcgtggtggcggcgcctgtagtcccagctactcgggaggctgaggcaggagaatggcgggaacccgggaggcggagcttgcagtgagctgagattgcgccactgcactccagcctgggcgacagagcgacactccatctcaaaaaaaaaaaaaaattatttttctttaaaggttatttgtctatgattgtgcattttaatagtatgaaagggtacctggtcaaaactgtttgccttttgtcactttctgctaactcttttccctagagacaatgttactattatttgtttatcatttcagagatctttattgttatatgggcacatataactgattttgtcagttaaaaaaatctgaatgcttactataaaaaatgatggcatggaatatttttcttcacttaaagatgaatcttagatgtcagtctacattaatctatatgtagctaactcttccctgcgaagagtatttattcctttgtacaaaggccataatactagaacttgctcataagaatttatgttctttacagactcttgctatgataaacaatatctttgtaaacatgtgtgattatatctgtaggataaattcctgaaagaagaattggaatttttttggtcaaaaatactgtattgtacatttaaaaacttttataattatttccagattgccctgcaaagaaattatcataatttacattctcaaaacaaggttgtcataatgtttgagttgatgcagtagctccttagcaattaatagacgttcattttacaatctgtcaacatttgcaactttcacgaagcctcacaagtgatcgtgtacccaggtaaaacagcttatgttagacattcttgtgcaaggtttatggttggctgttgttcttaatcctttccagttataagagctcattgaatgtctcagttcaaggttgccatgttatattatgagacattgggtactgtcggtgagacttggcatgactggacgagccattctgatctttgaattacacagcaagtagaagccaggacagtatgttcttgacttaaggcatcctcagcaaagtgataacctagctgatcttctgagaaccctcagccagacacagtggagtttatggtaaattatagctcttgttgagcattgactatatgcctagcacccttgcatatgatttctaatctttacaacaaccctccaaaatgggaataactatcctcactttacaattttggaaatttaagttcaaaacggctgagtgcatttctcaaggtcaaggtcacataactaataattggcagagctatctccctctgcctgcttccagaggagtttttccttttattgcatcattgcaattgaccatcagaatcacttggctttactaattttttatgcattaaacaggtttttctggtcagtatccaggcaaatttaggcagttcttgtttggaagggtcctttcctttggttggtccagcttttgcacccctgtacttagagggatgctcagatgctcagatgtctttgctactgctgtgtccagctgtggtgtatcttcccatgctgaccctactctcatgtttctgaactgacatctcgcaagattaattgagatgctgtagttttctagcgctacactggctgtaattagtcgctgacatatgatgatttattataggggattcctttagaaatttactttgtgttttgggactaagaaatgatcgttagagtttcagacttacagctcttgtcctgcaccacttaactgatcaaaactatgtttgggatgaccaggcagcttgacatcatagcactggtcatcctgactctctaagtaaaactgaaatgtgtggcaaattaaaagcagtgaagatggtgcatggctaaattaattcatcttgattaggccctggtgaatttttaaatatataatcagatgtgagaatttaagatgtgggatagtcaaagccaagaatccaggaagacttctagcaattccacaaagacaaaaagcaaagatgccagaagactgtggccaggcttgcttgtggaatgaaaataaggggaaaaaaatcacttacaatagattaacagtataccctgtcaaagagtgtgccagaagtcacgtaaaattcccaacccactgacagagattttggagaggtgatgagagtgaggggaagggattatctgaaaaatatgaacaaggcagtagtgaggaataagatgccagcatcaacttccgctgtcacttgttttctcaacggttagccatgccactaaggtcaactcagtatgttattaaaatgggcggttttaggtaatgattactttcttggcagatagaggattcttttatctttggggtcatgcatttttaaaagcctttgtctgcatagatttatttaaaacacacacacacacacacacacacacacacacacacacacccccttaagcaaggtatgctggctcacacctataatcccacactttgggaggctgaggcgggaggaccacttgagcccaggagttcaagaccagctggagcaacaaagtgagctccttgtctcaacaacaacaatgacaacaacaacaacaacatctgggcatggtggtgcatgactgtgatcccagctacatgggaggctgaggcaggaggttcccttgtgccaggaggttgaggctgcagtaagctatgttcatgctactctactccagcctggaagagagagtgaaaaacaaccaaccaaccaacaaaaaagcagcttgattgaagtgtagttgatgtacaaaaatctacacagatttaatgtatacaatttgcggattttaatatatgcaaagatgcatgagacaatcagtacaattaaggtaataaatatatctattatctccagaagtttcttcctgcccccgctccatgtttttactggtaagatcacttgacatctacttgcttgacagatttttaagtgcataaaacagtgttgttaactataggcactatgtcgtgtagcagatctctagcacttattcatcttgcagaattgaaattttataccctttgtacccttgaacaataactctccatttttccttcctctacaggctctggaagccaccattctactctttgtttctatgagtttgactattttagataccttatataagtagaatcacccagtatttaaccttctgtaactgccttatttcacttagcatactgtcttccaggtacatgtatgttgtcacatatggcaggatttccttctttttcaaggctgagtaacattctattctctgtgtgtgtgtgtgtgtgtgtgtgtgtgtgtgtgtataacatgccacgttttctttattcatttattgatagatatttaggttgtttccatatcttgactaccgtgaattaagtaaactccaatgatcatgggagtgcagatatcacttctagatctaaatctttgacatcttgacttcaattcctttgggcacagatttctatgaagatttcttttttctttttctttttctttttttttttttttgagacgagtctcacactggcacccaggctggagttcagtggcaccatcttggatcactgcaagctctgcctcctgggttcaccctttctactgcctcagcctcctgagtagctgggactacaggcgcctgccaccatgcccggcaaattttctgtatttttagtagagacgggttttaccgtgttaagcaggatggtctcgatctcctgacctcgtgatccgcccgcctcagcctcccaaagtgctgggattacaggcgtgagccacagcaccaggccttctatgaagatttataagttgctcagtttttatttctggtgtgtgtgtgtgtgtgtgtgtgtgtgtgtgtgtatgtgtgtatgtgtgtgtgttttaattttaaaaaccctgtcatatttaggatatacctcgtgatgagtgtgatcagcactaattgtcactctgttatactaaaagctctttccgtagtgtgtcttcattgcaagcatccattgtgtatggaatcctgaatacagttatttgaatgtctgagtattaaacaattaactgtctttacagaatgtcctccggggaacatagtttttccttagggacccttgggatctctaaccgcttaaaatctagaagctcttatgtgataggatgggaaattaaaaaataaatctctactatatgttaggatgtccatactgcatatagctccttaagataatggactatgattctatcttgtctctgcgcccagtacatggcacatttcagggtgtcacagatttcctaggattaaaatgcttagtaaatatatgaatgaattctaattttagtttctttatctggcaccttttcttgtactttctgagcaataagaagtaggtatctgggtttctagtagatttatgccatataattaagaaatattgatttaataatttttgtgtcctgtgaactttatttaatcattagctaataagatttattgagcatcttgcagttctgtagccctgtgcttgatggtgttagctccttagcacgtaattgttttgactagaatggtaatttaaggtaatttgatatacaaaatggagtgctatgtatggcaaagttgagagggggtgaggagaatataacttcaaacctgtttgaaaactcatcaagtaatatttttcttactttaaatgtgctttggcctcctttgtgtgcaagcaatagagacctatttaggctcctttaactactgggggtttatcaaaaggtgaaatatagaaataaagagacgagaaatactgtccacatgggagattctgatgtgaattctgggaaagctgcacaagtgtggcacacctggacctcacctagatggagggtggttcgaaactagaaggtcctttgtgacttttgtctgatgaggagtcctagcagtttgaggatccagttttcatagttacatagttaatttagtttaatgacttattctgtctttttcatctttgtggtttgcgtttttctcctttctcaatgaattgctagctctcttctcaagagaagcctggattgcttaagttaccatcttcccacctttgtgggcagtgcccttgctggagtccacctgataccctgtggatcagctgccctttgtcgggttcccatcacagccccaatgtgctgtgggtgaaggggtggccagggtgttgagagagagccaagtccatcagagaactttcagaagtaccttgctgtgaatcatccttcacagcctagtgggtgccgctcctcccttttattcaattttttaataaactcaatatttgatcaaattaagtggagggagggaggatggaataacatgctcctgatataatggaaaattcaggctcattgaacttgtgtgatgtgccacaatccttttagaacaagaccgtgattgaaactagtctcttttctctattacttttttgattgttttaaaaaaaatcaagaatatttctaaaatataaaaaaaattacaggagagataatttgagtatcttcactttttacactcctgccaagaatgccccacaaccccacccattacagaaggatcagattccatattggaaatatatgccaatttcaatttagctgctcagtaccaagaattcttgcacctatgagatgctaaaggtttgaactaaatggagccacattcatcattgttgtagaaatctgccagtgtttaaaaggtgctacagggaacctttaagtcatgcaccaaattaaaagattgcaagctccactggtgtagtcaaaagcaagctcaaagctgagtggcatcaaaccaagagtagaagataacttgttactgaattttgttcttcctctgaatgccactctttcaagcagagcgaggaaaatatgaattttgtgttgttaaaagatgtttatttccacaccctaatttatgtttcaaactgcaggcttttgcagagagtgtttctctgaaacttttaaagaaagtgacatgttactacatgggaagaaaagatagagcctggttggtaatgattatacagtcagggctttatctgcttgcagataatttgtggcttatttttaaccgtctgccagtttcttttctcattgttacatttacctgctgattgcaaccctgagccaatcagtcactggtgagcatttggtgaattctacttttttaaactggccaaaagaaaacacatatttccagaatggacacagtgatactagctaatatttattgaatacttattatgcagtagattcaatattttaaatttaacatttacagaaacctcaccatagcaagaattatcattactgttttactgatgaatagggtgaggcttagaaaggtaagtaacttgtcaaggtcttaaaggtagtcaatgtcagaggcagggcttggatccaggggaaacctggtcaattttaatcctgcactgagaggtgatcacaatctgaagactgtgatcgacactaagacagattttgtcaaacaagctggtatcatgaggaagtcagtttggatgatgatggtatcccataacatgtctcaagaagaacttaggatgtttagcttatggtggtgtaaattcagtgcaaggggatgtaataggtgtcttcatttacatgaaacaatttcaagcgaaagatgacttagatctgctttgcatttgcacaggggtgagatgtaagacatattaaagaaaaccataaagagccaactgaatgaaatgattcatcaataaatgtgtttcctcaacgtatagtgagtgtcctatcaatggaaactttaacaaaggagctagattttggttttacaggactcttagatctatggattaagatgtgtctgtaatattagatgtatcttagagaataattatccaaaatatacttcatggaacatggaggaactacagactaacattttctatggtaaaatatttgggaaatgcttcattttttctttcataatatattaacacgttaaaggccaaatcaactatttaggaaaagaaaataaaacaaaatttcaccaactttatgaagctaacatttcctgagctttaacatttttcatttgttattattttttgatactaggaaagccttcttgtgatactattaagatcccatagaacattgcaaatgcttgtccaaacctgcaaaaaaaaaaaaaaaaaaaagcgcacatcatgtgcagagacttcccatgggcattgggtgcagctatttgtaatgagaaacaaaataactgttggcttccgtagtggacttgtgagaaccagtagttttgcatggtgcagggatagataagaaagttgttttcgatatgctattttggattctctcactctaggaaataatcaagtgttgatggtattaaatttcctttagcatacatgcaaagagggcatgtttatagactttgacttgaacttcttctaacaggccttattttccctgagtatgtttctacttacttaaaaacagatgctctctgaaaaattcatgaaaaccaaaaatatgctggagactttggagagaagctcttcaccctgttattaaagttagattgtttctaacaatttttttttgcatcttctgcttggcagttaacttcatgaccttgaacaacctttctggctttcctgtaactcagtttccttcatttacctacctacttaaccagattgtacataaaaatacatagtatatatataaatggttatattaacagatagatcctttcaaacacacttatattggtggctttgttaatgaatattgcatttgtggcagatagacatgtttccttaaatgaaggttttcaaaactggcattgtaagtaaattttacatattatcagttgcttgcacccaaaactatttctactgtgaactggaatacatcttaagaaattattttaaaagatgtaaataactagtggtaaagtgatagagcacatcataactttcttcattatcataagtaatgtggctttgtccatatgttattctcatttgaattataattcttatttttattgtatgggggtttgcacacttttgtcctcaacttttcttgtttattttaaaaagggagtctcaggatttttcttctgaagttaaaatttaaccctaaagaaagatgccacagtagtttagtctgcttttctggagctctgaaccattgagggccagaactgacactataagcaggagcagcagtcccaagatgggattctaatatcaacctttgttttatctgattcactatgagtaagaggatacaatatgagtgaacagcaaacctgtgagaaacctacaagtataaaaccaatggtatttaattcaggtaataaaatagaattcttaaacaccctctaaattaaaaagccagaagatgcagttctaattacatgccttaactagaagtaggatatttgcagcttatcaagttttatgtaaatttgttcctttggcacaatttgcctatataagcagtattagttcagtataaaatgtttattagttattgaaactggctctagtgtaatttctgtgttttaatacatagtcccaagttttgtgggatccctagagagaactgtgtggtgtctatgttttgaataaacaggttttttgaataatagtaacttacatatctatagtctcttatctgaagcccttggggtcaaaagtagtttagaattttagattttagaacggtagtatgctactagtgctgtgtgctatgtgacattccaatagaatcttgggcaatggccaagcatgttgacatttcttagtgcttgaatgggataaagatcataaagagcatctttttcagctgaggtcaggttgggctgacagtgtgtttggttttccagagcgttttgcatattggaactgcagataagggattatggacctgtaatattaaatataatagctgacatgtattgtgtttattccaagccagacatggtactttacttgtattatctcatttaatctttgcaactctttgaagaaggtgatagtattaattttgttttacagatgaggaagagtttcagagaagttaagaaacttgcctaaggatacatacacctagtaagaaagtggtagagttacatctcaactaagtcgaattagacaccaaatctggtgtgcacaataactagttatcctcctcgtattcagtgtctctgatttgcagcccatagactcagtcttacatcaacataaagggaattaatacgaagggtatcaggtgatggagtatcaggcccaggggataattgggggaaagaatgagtctcagtagcaacacttctttgatagtctttcttggccatttccattagaataaatatacttctagtagcagtaagattcagatgagagagaatacttgagcttgtgttgctgttagctagggtaaagtggggtgtcacaaatccagcatgatggagcagtgttcctaaaggaaaattgattgctgtcagcaaaagatgtgattcacgtgagacagcacactcatgtaaaatgtccactgtatggatgattaattaattgcagatgaaactaacatttggatgaaaaccccagttagttttttaagtataatccattttaagtttaccacctgcttgataccagcaaaacagttaacttatcatcttgaatactcagattcctgtggcagttcagacactttctaggtcttggatctcagatctagaatcagtgagcttttttcttatttgtaatctgagagcaacagtacatctcccaatttacctagtgggcattgtgttagctaagatagcccaaagagcttctggaagttcataccctatgtgttcatatttctcatgctgattctgtgttgttcttgtataaccagcagatgcagtaggggagatcctgcataacttctgtggccaagtcataaggagccttgcagtgtccaccttattttcttggcatcttcactctaggggaagctactgccatgtaagaagtctgatcattatgctgtgaggaagtccaagctaaccacgtggagaaagatcaattcctggccagccagctgctattctagctctcccagctagtgtgccagacatgtaaattaccttggacatccccacccaaccgaaccattagttcatttcagtctaaagtgccatctgactgaaatggcatgaacgataccaagggacaactgcccagctgagcccagaccactcacagaaacacgaggggcaataatccacggtaataagtcactaggtttccccgtagtttgttatccaatagcagatatccagaaacaggtttgctgtgaagaagagagataatgtgttatattcctcaaatgaaggtgagcagctgttttattataattgctttgacaatccagaaagcaaggtctttctaatatcctcagaggtttcattacaatttgccattgtgatgaggatagtgatcatgctgtactctctggacagggatggagagtgttagtgattggccagcatccaagattgtcatcatttttccttagtgcaggagtttaaaacattctgccattttctcactcgtatttatattttcacaatgaatggggttttctctaataagattactgtcataaagtctcttatttaaaacttctgatggatcctcattgtggatgacagggcccatttctctgtttttgtagactgtccctctgtccagaaactacaggggaaataagatgtagattttgaaaaagtgacagcgagtcaaagaacagttggtcaaacagcttcccagcagttgggacaggctgccagagtgaatgtcaaagagaagttggttcttggatggttttacagaaaaacaagacaatgaaacaaagaaataagaaataagtaggaggcatgcagagggacaaaaatgaaggacttgatattaggacaccagagcaatcagtagtaggttggataggaggagttgagaagagggaggaggaagcaactaagggttggttggaacttcaacacttaatgggttcactccctcctgtctgtaattaattctagctttagttacttcattttctccttagaggaagataaagtgacctggactatcttctttatgttatagttgtttagaatcaaagggcattttcttaaagtctcttttcccaagtaattcttaagatttcttaagtgtcattgtctcttcaggtggagtcataaaatgcatctctatgaggggcaataaaatgcatggaggtgccttttatggctgttgctagcagaggactagaataagataatgatggtattttgcaaatagtgataaggagcaaattgcacattccaatgtcaatctgttctcaaaagagtatagttcaaagtttctacaaagctttttgaaagcttttcttttttgaaatgagtctctgatttctgtttttcctagctatacatagattttattttggggaaaattttaggtagtaacattatccttaatatttactgatttgctgtagaattttaaactggacaaatgaaagcccttgaggaagagaaatttatattctaacatagcgaaataaatatatgtcttgcaacttgaattgttgttaggaaattacttgtatgcctgagttcatgaattatttaatttaagattattttcctttttctaatttatcactggctaggtcctttaacaatcttttgatttattaagagtcattttccagaattagatttaaagctctattgttttcttatgattttcctatgaaaattgagtatgtctcctataaaagctatatttctcttgtttgacttatttcatttctctattatgaaaggcaatcattttaaaactgatgaaattttaaaaaattgacctaatctgaaaaaaccagcccatttcatgatccttcttcacttattggaaaagactatggagtcaggagttggggaatgtaccgacctccattaagaggtaaatgacttgcttgtgtctagaagcgtttgtgtcatttgcctctcagtgcttgctgcagttttaaggaaattgtcctcctattaaggttatgtatcagaatcacccttgaaactttttattaataaagattctctgtccccacaatgaggtttattaaatcagaatctccagggcactggtgtgctgaacgagtctcctaggtgatttgaattcgtaccccagtctgcatctgaaaactgccgcttttcaaagagaggcagacaggttgatggatgataggatccagtctgacacatggaaaagctacaaggagggagcatggaggaatccttcatttagggagacatgagtattgtgaatgatggtgtaatcactgctaaaaatttctcgggtttctaagaaagttttatgtcctcagttttcttgatggtgtctccagccaagctgtaatgcagtggttcccaactaggggcatcttggtctccaggggctatttgacaatggctggtcctatttttggttgtgataactaaggggatgccgctggcatctagtgattagaggccagggatgctgctgaacaccctcagtgcaaggggagccctgtgttagtcagaattctccagagaaacagaacatatatgatggcccagcttatgcggcagtcatgtgggagttttctcttactcagctttttgtcctcttttgatctccaattgattgggtgaggacctcccacattatggagggcaatctgctttacttagtctggagattcaaatgttaacctcatccaaaatatcctcacagacacacccagaagtacatttgaccaaatgtctacacaacctgtggcccagtcaagttgatatataaaattgaccatcacagccccttacaacaaagagttatcaggcccaaaatgtcagtagtatcaaggctgggaaaccctgatctagtgaagtgcagtgaaattctcaaaataaaaatattctaggggccagcattgaaaaggatgtggcagggccaggtaggagagcattagagatggcctgtgtggaccttgaggaagccagatgagataaagaggaggagagggcatgaacataggataaaagctcgagacaggaagagatggggttaaaatgaacatcaggtacttgaaaagagggatgttcatcaggtgttatttttcctagcagtgttatgtaaaatacgagtactatctgaaagtctgaaaaaggtagggccaatttaacatcagctttaagatagtaaatctctattctgtaagatgtaatggtagtttttaagccttgaaaattggaaatgttagacaatggtagcatatgtgagccagagagaatttgatggtaaatttgtagtacagaactttagacttgtttttaccaggaagaagcatcagagaaacagtgagagtaatcagcgcatatttgttgtatttccgaggctggtaatggagctaaagtgtgggggcagagctttttgtttgggaaagtgtggaaatggggctggtcaatgcagatgaaggggtgctatgggaaccttatgatgtaaaatacactctctcattgtcttcacaagtgtagctctaattgcctgacctatgtgcagatttgttgttcagaacaaatggggttaccataagtatggaaaatggttcctggtctacagcgaattggagagactagagaggcaagccagtgctcttaaatagcagtgacccatctaagttcatttttcatcacccttctggtaaatacttcctaattttctctaggggatgtgctttccccatgtttgatctgtttttttctgagaggtgtttggttcatcctggttgtagggttgggtttgtgatataggcatagcctctcagaggcatttggccataagtcttatctgggtatgggctcatgaccccaggtcaatctagtcagatctgctgatgttaattctgaggctcttttctttccttacttttgtatttggaggtgtaaggatgtaatcccacgttcttggtcataatcttgtcatactatagaaagggactttttcaaaatgtagttaattcaaggaagaccagagttgagagaccttatatcatttgtgctcctggatgaagctgtacctgaagctaggttgtcccagaattctgttagtaaactattaaatttcttttttggttatactagtttgtgttgtttctttcactaatgactgaacaaattactaaaagatacactgaattattaggagaaactgtccaattagtaagtgatatagccaactaataactaattaattaatgtttcatactccagtatttgggctctgtgtatatattggtgatattcttccattcttgtttgtttgtgttttggagagtttgacaaaaatgcataggctatctctggtaatgcttggtttaaagcatatttcatattcagaaagatgttgtatttgagaagcgacgtggtaattggttttgagagtatacatcttagacaattaaatggttacattgcttccttccttggtttaaaaaaaaaaaaagaaatccaagggtattccagttgtataaatagggacaacacagtttatgctatttgtaattacagataccactcaaaagaattgattccgtttacttttgtattagtgtactgtggaaagtcgttaattataatgtctgttcttatccaacaacatgcaataagtaaagatgaaaatatagagattattagtttgaataactggttgcatgccatccggttttatatgattgctgaaatgcaaaacaaacaacccctccccccgaagaaaacaacccaccgttcttaaataagacatttgtgacataacaaattagaatctaggagaaggaaaatattttcccagtatctaaagccattgaatcaaaataatcgtgtagatcacactttagttcagatataacctaaataaattctctagccagggcacccatctgtcaaaaaataaaactctggccctcatttaaaatggctcctttagactgaggtcatctagctgtatctaaattggacatgaaatgtcaatttcataccttatagtggcacatttcatattgctctacttaaggttatgtcagctttacccataaaatgcaagtgatttaggtcttattctaaatgaactaaccagatacatcagcaatgggcactgccttgccactgcagaaaaagggaatgtgtgaagggaagacagaaaccacttattctgtttcttaactctggaagtataggtattccaggttgggatgtcttgtctatattttcattccttgtgaatgataatttgggggtggggggattagaaagatgctttattcaaaatgaattgtattgcctgcaggcgattcacttgcttaagttatatttgtgagttattgtatgtaactttatcacattggaaagtttatgaaccttgtgtagaaaaaagattgcattttgggagctatgcacatcatggctttttcacaagtgacagaaaagtgctgcagatgatttaagcaggaagaaatgaatttttcgaaagattttgagtccagaagggagatagggcagtcagtcttggaagatgaaaaggacaaagccaaagcgggccaggcaggcaagggagtagtgttgtgaacgccctaccccacccctactgcatctgagtgttgcaactgcctgtgttgccactatgtaaacactgctccttaatatctgcttccttggatccgaattcagagccctggggacagtgcatctcattggctgagcatgtatcagccattggtaaccaagctgcaaagaggctgggaaagtaagtagtcggctctttcagcttctagctggaatgtgatcacctcccaatattcttcttcttctttttttttttttttttcgagacggagtctcgctctgttgctcaggctgaagtgcagtggcacgatctcagctcactgcaacctccacttcccgggttcaagtgattctcctgcctcagctccctagttactgggactacaggcgcccgccatcacgcctggctaatttttgtgtttttttactagggacggggtttcaccatgttggccaggctggtcttgaactcctgacctcaagtgatccacctgccttggcctcccaaagtgccgggattacaggtgtgagctaccgtgcccagccccagtatgtcttcttatagtggggggtatctaaaaacaggaagaagtttcagatgcttggcagctgacatggctaattttaggtcaacttgactgtatcatggggtgcctggataaaacattgtttctgggtgtttctgtgaaggtgtgttaggttgagatcaccactagaataaatggacttagtaaagcagattgtgagtggtcatcatccaattcactgagggcatgaatagaacaaaaataccgaaggggaaaaattaagaatttgtccctttctcttcctgcctgctggttgagctgggacattggtcctctcctgccctggaactggtatttataccatttcctggttatcaggccttcagacttgaactggaattacaccattagctcttctctggatctccagcttatagatggcagattttggaacttctcagtctccataatcatatgagccaattctttgtaataaattttcttctctctctctctctctgcctatctatccatctagttatctggatatatcgcctatgggttttctttctctggagagctctgactaatagagtagccaaagcaaagacagtttgtatgtgtatggttttatggggagtggattttcaggaaagcaggaaaaagattttttccagggcacttgggtagtgcatcttttttcctctaacaaatgggggagcatgtggccttctgagtactgggtttgcttaatgaatcaggagagccagtgtttataaatattcctttaaatggcagagcgtagatcctggtttgtagtccccttagtatatttgtaatgttttcatcatacccctaggccaaagaaaatactcaacattaagtagttttattcattaggtaggtaggttgaaacaaatgaataagaatttatgtactaacgtaatttgaaaaacatatatatcatttgaaaaaacacacaaattgaaataaaatatttttttcttaaataaccactattgcttactaatgggatatatcctcctgttgggcacagaatgacttcacatacattggaattagattggacactgctacctgattcccatccacattgattttcatgacgcacattttattacagcaatggctatgaacccagctttgcaaagatataacataatgaaaaggaatgtaatgcaatcaaatattgaaactgccaactacctcgagctatcctgacagttgagcatagcttgggagtggtagacatagattatcactgaaattctaatgtgagcctgatggcaacttgagttgaagggcattcttgcaagactgcttggttggggagtgtcacaccagctggatgtttccagaaccaagggcctgggaaaaactatgccagtgtgcacagtgcacactcttcctcagtgtagccactctgcttctgatgtgttttgttgtctaaatcagtcagcaacctatcacagatgtgtgcatcttttcctaccaatccacaaaacccacctgatacggtttgtctgtgtacccacccaaatttaatcttgaattgtaatccctataattcccacctgtcatggggggcacccagtgggaggtgattgaatcatggacacaggtctttactgtgccgttcttgtcatagcaaatgcgtctcacaggatctgatggctttataaagaggagttcccctgcacaagccctcttgcctgccgccatgtaagatgtgcctttgcttctcctttgccttccaccatgcttgtgaggactccccagccatgtggaactgagagtccattaaacctctttttctttataaattacccagcctcaggtatgtctttattagcagtgtgagaacagactaatacaccacctgaaataatgtaccccttaaaatccttatttatggattgatgagaaaacagagctttcattttatatgattaacagaagataagtgcctctgttgcccagatcagactgtcttagttcattcaggctgctataacaagttaccattttctgggtagctcctaaacaacagaaatttatttcttacaattctagggtcttggaagtccaagatcacggcaacctcagacacttttggtgagggcccacttcctggttcatagatgggccttcttgctatgttctcacatgggtataggaggtaacagagctctctgcagcctcttttataagggcgctaaccccattcatgtcctaattacctcccccaaagccccaactcctaatagcatcaccttgggtattaggatttcaagatatgaattttgggggaacataaacattcagaccatagcataggccaattaagaactaggtatatgtaaaagcatggctccttttttggtacaaagctggtgtatgcctcaaaatttatattttgcactcagaaaaattcttccttttattccctgaactgcttgttcatgtgatctctacttctgtatgtccaggtctttgatatgtgtatgagttgactgtttcattgtgtcggaacatcttttgattgtgtcaagagttccagcttcttttctttaaagatcctgttttataatctgccagcctgaccacactcagcatacagtcttcaaagttacaggttatgtgaaactttcaaatgagatattacttactcctgttcttcagctggaatatcagttgctgggggagctggagaaacaattcccaaaatgaagagcaccttagcatttctacaatgttgtcattgcagggtattgtgataggcagaatgctggccctgccccaaagatgccagtgtcctaatctctagaacctctgaatatgctacctcacatggcaaaagggactctgccaatatgatgaaggtaaggatcttaaaatgaggaaaaaattctggattatcctagtggacctaatattttataagtgtacttgtaaatgaaagagaggggcaggagttgtgattatgtgattgctggctttgaagatgaaagaggaccataagccaaggatcaaggtcagtccctagaaactggaaaagccaagaaaacagactctctgatagaccctccaaaaggaacaggaaggaagccctgcccagtcttaattgtagcccagtgagacccattttagacttctgatttccagaactgtaagatagtaaatgtatattgctttaaattactacatttgtggcaatttgtcacatcagtagtaggaaatgaatacagctataaagtggaagaaaccatagaaagttcactgagccttttgagattaatctttaactcatattctaaaatcatatagctccctgagtgtcaaactgataactacataatcacactttcactgttctcaggtttactacaagcagaattaccccatactggtgttcaggcagatgaattctcactatgaaatactttttaattggcgttcttatgattgcctccaaaatgtttaaaccttttgacagttgcatccattttatgaatccatcttcagtaataaagattgaaatgctctaaaccaccaaaaattagtggcttaatcagaaactgagggtggttctataaatccaaagctgctggtcattagacctcactaccatcattatgtatttcttcatcctgatgcatctcacattcattttttgacacgttaatgatttctgtcgtaggcatattaactgtccacatgtaaatgtgatggacactgctttggtttagcatggggctatttcgattggtcatacagccaaagaaggaagtaaaggatgtaaacagtgtgggtgcttatatttttttccaatatttgtggaagcatctgtttctacatatgactggcacaaatgatatctttttgtaaaatatttcataatttctccaaaatataccagctttctggttttgtttttagagctagagactttgtctgctctcctgactttttgatattctttctttcctttttttttctttcttttttttttaaagatggcatctcattctgtcgcccaggctggagtgcaatggcatgatctcagctcactgcaacctcacctcccaggttcaagagattctcctgcctcagcctccccaatagctgggattacaggtgcccgccatcatgcctggctaattttgtatttttagtagagatgggctggtctcgacgtcctgactgcaagtgatctgcccgcctcggcctcccaaactgctgggattagaggcgcaagccactgtgcctggctgatatgctttcatttttcactccctttttaatcttcccctccattaccagttaacaaactactacagctgcctctgcaaatgatagaagaacaaaaattaggaggagagggggctggaggaggagaagaaagaagcagagaaggagaaggacttcatagaaactacggctgctttcaggcatataatgtgagatcttgagagagaattaaggagtgaatttccacgtaactttcaaagattgtaaataggctgcctctattttttgcaattgccaggcaatgacagtgtactttacttctactctcctctgaaggagcaaaatgagtgctctatggccttaacctctatttctctcttaactggattcaaacgtatgtcatgctttgagccttcattacgtaagcgatttttctcaaggtcactgggagcaccacgttcactgcctctggatggttcactgtactgccgtgcagccttgctgaccatttcatgatttggggttcatgttcattttatagactggatttttttctgttttacgtttcccattttctttgttacttagaattaaccatgaccagatcaattaataaaatagttcaggttgtcttattctatttgtgcatttggtttgcagttaccttcacaaatattctggtggctaatgaagttaaaccaaagtttgtcaatctgattttacataagctgtgtgccaaaactgtgttaggttcaataatgctcattttcttgtttaattttcacaacaactaagaatattatcagattcatattctccttagataattaataattaatcacattattattctcctgagaaggaggtgatactattctcgatttagacataaagaatcttaggctcagagaatcaccagcagattgtaattttgagcctagatcatcaatgtctaaattcttgctcctcttattataccattctactaatttatcaatgataaatatttgttaaatgcatgttgtgtgctaggcattgcaccctgttctttatttacaaacatatgagttattattatctctgatttgtagatgaagaaattgagtttagagttaaatgattgcccaggattatgttgttacaagtgcagaatcagtaatcaaattgctgtgctgtgtcctccagggcctgagttcctacattgccatgagccattaaaggtaagatgctaattaaaggtatccatgactaattttaatggctaacacaagtttggtgaaattgatttaccataatattttggttactttttagggctactcagatacacatacttgaactgtaacagcaaatagtgagaggggaagtaaagattctgagcctcctttctgggtttacagcaatattttgaactaagaagatgaagtagaattagacatgagcaaagctccatccctttcttctgcaggtgagaaagaaatagagggtgtaggaggtaagcatacctacctagtaagccttcatgatttaggtatctggagcaggtgggactggagcaattgccatgaagttcacaattttagtgtggcctgtgatctgtttctttggctacagcttacatatcaggcctggggatttttctggattctgaaggttctagcttccagccttgaaattattctcctacttgtaggtcagtaaaacaagcgtttctttacttgaaagttttaagtcgacagttgccatgataaatcactcccactgatagtgttttagactttgttggttctaccttacgggattttcatagagtttctaaaagagaaagacaagcactagagtgaagaattgttcttattgtggaagaatcatcaaccttggctggacacacagatcaaggggttcagggatgggtggcaaaggatcattgagagggttacatgtgacccttgcctaactatagtagttaattcaactctgcctacacaatgacacggattaccgaggatatgacttgtattatactcatccctctgaccccacatcctaatgttaataatgattcttaaacctggaattgagaactcaaatataaaccagtgcccagcacatagcaagtcatcaattaagtttattgaattaaattaaatattggaattgtatctgtcaaagccatatcagctctaagcttcttaagagaaaaatctgcccagaatttctcaggagggatttctcaacatcgaagctgtcctgttcatattggatttattgtacttacataaacaggaatacacgagcagggaagatcagatcagttaccacaataagggttttgtaccatgatatacatcattttcgctcccctaggaaagcactgctgatgaaaacaattttggagggaggtggtctcaacagagtagatgttcaggtggaggttatctctggtgctctgggcttcttattcataattttctcttatgaaagagagtggttttcaacttcacaattcctttgctcatttggaaatatagtagcagaaagatgaagagagtttgtgacccacaactaaagtctgtgttctcttgtcacttcatcaaattagttctggtggcatttggttcccccccagaaataaatcactgttaaatgattctttataaagcagtccacacatttatcataccacagtgatctgaacccatttagggaattataagctacagttggtcatgttgcaggcctagcaactctggccttgtcacattgcatctctctccactccctgtgctaccactaatccttcaggactgagattcaaggctttgctagtaagaggcttggaaataatcatataaaacataatagtgtggcaaggtgagatcgagcttttaatttttttaagttcacagagagcaagaagacagataggaaaggaccggcagattgggaaaaatcaggaataagatgaaatatcctcagaactttagcttttatgattccacctcacattcagtttaattatgaaatttactggcagtgacaattggcttttggcataaattaatcatgccaagcattatacatgaaatgaaatttcaatcctatttgttgaacattttctaagagcttggcaatcttgcccagcactttacgtagggtttctccttatctaccttatgaaatatgttattattattcccacttttaatatgagaatatttggggattagaaggcttaagtaatttgacaaaggtcatatgggctagcataatagactagaaaacaaactcaggatgctgtaattactacactggaatcattcttagttttttttttttaaatgaagttggcattagttttgttttttaatctttaatacttttatctgagaattgataattaaccattttaagaaaatagttacataaatttagaaatcatttggaaaacaggtaaaattgctacattatttcaatttattttatttttaaaataaatgatattttttatctatatttgagggctatatgagaacctaagacttctattgatgttaattattgacttttatttactgtagttttagtgaataatttaattgacttctattaattcagtcatcatatgctaaacctagagtaactgctgttaatatttttttttttagctactacaaattgaagtatttttgattagagtaaaatttatttctaaaggtaacctgagtaatatctctatgttgtagatagatattactatctatagtaatatctatgcatatagtatctatgtagtagctttccaatttattttgctattatctaaaataagaaatacattttatattgttccagtaaatgcacacatataaacacatatatatgaaattgatacttcataaaatattagttacccttattataatcagtgctcacttgatattttacattttatcccattgtaaaatagatactggtcatgactcacagtattgatttcataactccctaatggttgtagcctgcagtttatcatttgttcaaatgtagtgtggtgggaaagaaagatgatatgactcttcagacagagaggtctggtccctaccctgatatgtgtcagttatatgtcaccttacctataaaatggtgattatcagtacttctcaggggagttgtaaagcctggtacctagtagataattagtaaatatcagtttcttttgtctttagagctcacacttcattccatagttttttgttgttgttttgttttgtttttttgagacggaggctcactctgtcgcccaggctggagtgcagtcgtgatcttggctcattgcaacctctgcctcctgggttcaagcgattctcctgcctcagcctcccgagtagctggaactataggcactcaccaccatgcccagctaatttttgtatttttagtagagatggggtttcatcatattggccaggatggtcttgatctcttgacctcgtgatccacccaccttggcctcccaaagtgctgggattataggagtgagccactgtgcctggcctcattccatagtattatagaaaatgtcgaactgtttaagcattccagcactttattttttaattgttattatttttctaccctcagcatgcatcagaggagcattccagccctttagtttggattttcttgctatttctgattttaactatgtgtgttcttcatatcttggactaaaaaataaaaacaaattaaaaatagcaaaaaaaaaaatttgcagtaattttaacagaccaacattaagtactctggaagccagaccagaagctaggggctcgttaatttttatgtatcatcaatggaaatgacttttatttgttaattattttttatgaccacctattgtaacatcttccaacacatatttccccctctttcccgtcctccactctttaaccttccttgcccattttttgtagagatgccagtgaggtctttctcagtcagtgcttcaatcccattatttcccatctcaacaggcttcactggctcaccattatctttcatattagtcacaggctcctcagcctgaattgaggcctttatgacacaattctagtctacctttggagatgtgcttcctttcagtgtcctctctgtatttcatacttactgctttgatcagacaagatggcctgtctttttccaaatggatctcacaatttccaggctctgtgtatttgcttatgttgtatcctctacctagaagtcttttctcctggtccatctgtcctcattaaaaactccactcctgttttcaaattccttgtctgtttcatcgtgactcttctaattgattctctttcactcccacactacttctattgatgttgatttctctgaagctggctcctagtgccttttttcttcttaaggcatgatagtgtgtctcaagttggaatgatttcatggctcccatatggttgattggttgtgggactttatcgctaatgataattcagaaaatagtagtaggactaattgcaattctgcagatttcaccttaaacatatgctgcttcttgggctgtggaagttggacacattgagataagattattcagaaaaacagcaaggccgggcgcagtggctccctcccataatctcagcactttgggaggcctaggtgagagggtcgcttgagcccaggagtttgagagtagcctgggcattataggggtaccctgtctctacagaaaataaaaaaaaaaaattagccttggtggtgtgtgcctgtagtcccagctactcagatggccggggtagaaatcacttgagctcagaagacacaggttgcagtgagctgagattgcaccactgcacttcagcctgggtgacagagcgagcccctgtctcaaaaaaaaaaagaaaagaaaagaaaaaaatattagtaggtctaactgtaattttctaacttctggttttaaatatacactgtttcttgggcagtgacagtagggtaaaattacccagtttgtgtaaatcttatgaggcttgataaatggacttaataattatcagatgacgaaattaaatgagtcggtgaatgttaatgcgtccctccttccatgtaactagatgccttgggacagttccaatatgtggcatttatattgtattatgatgtgttaataatgtggatcagagacaagcaaaagtcaaggataaatgtaatttcctgtgaaatgtatatttaatactttttaacatttagcggaattacctttggatgtcaattgaacattacatccccttactaccgtgactgtgtgtgtgtgtgtgtgtgtgtgtgtgttgggggggtggtgtctaaggagtaaatctattctcttactgcaatttcaaacactgaagtattataaactttctttaattgtatcgagttttatatattttgttgattctaagagtttttgtgtatgtgtgtgatatcagtgaatcaggcaaatttcccagtgtgtgaagcttttgggtcagctattaggttattacatcatttcagaaatgctccgtctgccttctggtggccttcagatttggccaagtagtggagtagtgcaaagactgctaatattgtagaaatcccgtgaccatacgcagtggtttttattttgttctaaggggtacacacttccatttgtctgttttcatgcggagcacatttatatgagggtaagttcaatggcaacttttagtctgtagagggatacgttgagaaatatgttactgaccataaattaccaatttgagatgaatgcatacttcagaggccccactagctcacatttttactgctgtcccctaaaagcaccttcaggtttatatgctgaagatggagaccttcatagttagaaaattgcattccctcaggccacaggaaatattgcttgacattctgtaacactatttgatgttcttaaaacagcatgctatgtagatactactctaggtcatgtctaattttttaatctgtatttataaatactatgaagcttgtggtttttaagaatagtaatgtttacatttatataatttgatgcaatgacttttccctgtaatataaaattaatttaatgtttagtataaaggaaataaccaggttgtatagttgtaggttgtgcaactacaggttgtgtagttgcaggttgtgtagttgacttgtgtattttcacttcctcatactgacaacataaccagaggcctgaccaatgctggtgaaataaccaaaaaggttgtcaggcagacctttgcgttttaatgcaaattcaacagggaatggggtgggcatagcttttttttttttttctgtattatatcaagtaagctgaatatatgcaaggttagagtttaaatgtaatgattagttttattcatatacatttaaaatctaatattctacaagatgcttagcaccatacttgacacattgtgagcattcagtaaactgatgttatcctttaagaagcatttaccacagaggttaagagcatatgctctagagcaaagttgcctaaactatttctgcctctgtttcatcatttctaatatagggatagatcatttagttcatagaacactgttaaatccatataaagcatctataacagtgtttttaataagtaaaaaaaagtcagctaaatattagttgtttattaattgtaatatatcctaaagcaacttatttcttaacgtagacttctgcacattcttggaaaattaatatctctttttttccttgcaatttttttggatatttgaaactataagtatcttcacccagttgtaggacatatgtttttctattttcttcccccttgttggagaaatctatttctacgggacaagctggttatttgtctacagatcctcccctggggattctgtagcagctacttcaaagctatctcagcttgcacttaatcatttgaaacatcagataacttgcttgttcattttatgcatgttttcttattgaggaaattagtcaacctaaaatgagcaccagaagattatttttcttggttttactcttaaagtcattctcaagcatgttatcttggaagagcagggcactctcctgcagcttttaaggatgactgaactggagaacattctgtttaaccacaaaactcatgttccctctgtttaatttcttaaagcttgccctcccttcaatgcaattaccatttttcttacacattaagaggacaaaatttgttggcttcctctttgggggaggatgtttatttatttagaagatactttttgagttcctactggtccaccgggaactatcgtaagtaagttgaggatacagggatgagcaaaatggacaaattctttgttctcatggaccccacaggagaagaaagacaatagctagtaagcaagtaatacatttttttagacagctaatttttgtatttttagtagagatggggttttgccatgttggccgggctggtctggaactcctgacctcaagtgatccgcccacctcagcctcccaaagtgccgggattacaggcatgagccacttcgcctggccaacaagtaaatatttttgactatgtggaaatatgatgaagaaaatgatgaataggaaaatgggactaagaggcaagaagggcgaagcatctatgaggaagtggtatgtggacagagatttgaatgctgacagggaggcagctaagagactctctgaacaaagaagtatccaggcagaaggaacagcatgggccagggctctggggccaaaacaagctcagtctggctgagaaagggaataaatgactgaacacatttctgtagccttctatgttccaggtgctatccaaggtgcttgggatacgtcagccaacatatttgcaatgttttgcatagttgtcctctccaaaactcatgtcgaaatttaatccccagtgtagcagaattgagaattggggcctttaagaggtgattagaccctgagggatctgccctcaagaatggattcatccactcatggattaatggattaatgactaatggactaatgagttgtcatgaaagtgggactggtggctttataagaagaggaaaacagacctgagctaggacactcagtcatgtgacagcctgtgccaccttgggaccctgctgagagtccccaccagcaagaaggccctcaccagatgtggcttctttattttggacttctcagccttcataactgtaagaaataaatttcttttctttatgaattacccagtttcagtttattttgttaacagcaacaggctaagacaataatgcatgattttttctaagtaaattatgtacaatattaactgatcagtgttttaaaaaaatgtttgtatgcagggaggtaagagtgcaggaataggtgggctacagtgtaaaacactgaggtcaaggtaggtctcatagagcaggtggcatttaaacaaagtattgaaggagacggggcaagtttgtcagatgggtatgtgggagaaggaattaccaggcacaggtaatagctagtacaaaagccgtaaggtagcagtaggcccagcttgttccaagtgcctcaagaaagcctctgtaactggaacagagtgagtgagatgagtgaggcggagaagaggttagagaagtgataagaggtggcatcaggccagtctttgtaaaccactgtcaggacttccgtttgattgaaacgaggtgccgtctggtaggtagctttggggtctagactggggaggggtggagcaaagttaggagcagggtgacttgttagcagaataatggaataagccatgagccacactctggttgctcttacagggccgtggtagagatgatgggactttgtcagattctgaatatatttagaaggcttcagaagtgaagtatgagagaaagaagaatccaggatgtgactccaagtgttttgtcctgaaaaaatagaagattgagatgggaaagactagtgctggaacaggattggatgaggtgaggagtggctgtgtaaagcaggagacacccaccgttcccagggcgtagttctgtatctgccttcctgagttaggcttggcagtacgactggctctggccggtgggtcatgtcgatgtgagacaaaagcagggtacggaaatgtactcccagatcgggctcagcctcttgtgatgcagtcattttcatgagaagagctttcctggggcagacgttgccctcttagcctggaccccaagtgaatgcaagtgacacagagccaccccagctaagcccagctcatcccacatttggaaggagggctgcccatggagcctgctttagattaccagaccctacagaatcaagagaattaatagctactgttgtaagccaatgagtttggaggtggtctgttatgcagaagttttgtggcaatagctcagtaatagagaatccagggagtgaagtgaaatagggagttggatataggagtctggagttgagaagaagtcttggttggagacaaaaatgtaagcgtcattggcataccaatggtatttaaaacctcaaggcaaatgagatcaccatgggagtgaatgtagtagagagggtgaccgaagattgcatgactacatcattacaatgtctggaagaagaggagcaacccatgaggaggaaggaaaatgccctacaaatgaaatggatgaaaacaatatctaggaggaggaagtgacaaatgatgtcaaaggcaactgccaagaattggtcattggatgtggtaacctggggagaattgttgactttgataaatacagttttatgggagtgttggaggtgcaagcctgattagagtgattttaaacacgaatataggcggagagcaactggagatagagagcaaagtaactttttgaggagtttgtgggaaggagacagaaatgaaatgaaacaatggcctcctcacaaaaggagcgcgaaaccatggtaagggtgtactttattctgagcggggaggtagttgaagcgtttaaataatgacctatttgtcttttagatattgctctgactgctgtatagagaatggcgtggggtgaaagggagcagaacagttataaggctatttctgtttcctaggtgagagagtgtgttggcttcagctgtagccctggaaatgtggaaagtcatgtgtaaatttcacatggggtaatggtattaggtagacagcagtgtgggatctttagcttaaggaacttaaaaaagtgtttgtgatcaaatgaaaaatcacaaatgtatatgagaattatgttttgtaacttctctttagctctaccttatcttatataaatcatactggtttgaagcaatatatattggttactttattaaaatttacattctgttatttttttaaataattcctgttgtctatgataaaatggatatgactggccaggcatggtgtctgacgcctgtaatcccagcaatttaggaggccaaggcaggaggatcacttgaggtcaagagttcgagaccagcatggccaacatggtgaaaccccgtctctacaaaaaatacaaacattaaccggatgtggtggtgggcgcctgtaatccccagctactcatgaagctgaggcaggagaattgcttgaacccaggaggtggagattgcagtgagccagtcgtgcctgcactccagcctgggtgacaaagtgacactgtctcaaaaaaaaaaaaaataaaagtggatatggtaatttttctcctttccaaattatattttgttccatcctggatcattcagtctacactggcgtatttcgctcaagtgacattagagatggtttctggcataatatccttgtctgagtctgtgtgcaaaataacttttttaaaaagtggaataagttctatgatctgtagttgggatagggattaaacaacaacagcaaaacagacttttacttccttagatctcagatttatatgtatagagaattggttttacacaaatagtgaataaagtattttgccaagtgtgctttcagtagagacttgaatgattgtgatctgttttgctcttattccacgttcagaggttcccatgggaaccactcccaattcgtgggaagagtggaatttaacaaacaatacagaaaagccatttaatcatcctctgtgtgatccacaaaagtgccagaaatacggaggaaatgaaatcactagaatctctatctgtatgggcctgcccagagaaaaaagtgctgctcatggtaaatagatttgatagatggcagaaaaacaccagtgtcctaaatctgacagtaacaaaaaacctctcccatcatccatctccttcagataccttttcaaaatttgttaagtgttttgtgtcctagagtttggcatcttgccattttaatttaactatttttcccctgaaagatttgtttccagaaaaagcttgggatcataatacagtaaaccttacacataatcttctcattatgttcagaaagctaattttaaacctaattttcccatctctgtctctctctattccagtgcttacctgcctgcattaattaattcctgtgcagcaatgaaaatttgactcagttacctgacctcttaccttctgattgcagaggctctgtctcttacaggggtgtgggacgcctggtgccacaggacatgtgaacacagattatccgtacctgggaggtgactttggtgagatcggagacattggagtcccccaggagcagctcctcagcagattggggataagaacagagggcacctacaacaatctatgtattacagaacacagctctttttcttttgcgaacacagctgtttttcttttgcctgacttgactgaaaactgtttttaagtgaattaagtgttttaagtgaattaggtgtttcagctatgtcgccagtgggcactgaatcctaaaacagtgatctggaagggtcttggtgaccatgctatccaagcaccatgagatttggacctccaagttgggttcatcttctcactctccccgtgctctctactgtgaaaccacattggtcttcgcttcctccaacacagctagctcttgtctgcaccagagtctttgaactgtggtgcgttttacgtgaaatacctccaaatgattcttgttcatccttaagatctcagaatagatgtcatttcctcagaaagcaccaccttcttgaccctccagcctacaggaggattccctggactgtgttgtcatagcacctttgcttttccatcaaaatatttaacatagttcataaattgtttcatagatgagggggtggttagctcgggttgctttttctcttctccagtaagagatttcagaatcactccccttagaatcatttatatgaggttttcccctgagggcaggccagtggcctcactgcttcagaagggggtgtaatcagggtgaagagcaaaaatgcttggtatctttgagggaaaagaaatgaagttttggagagctggtaggtgccagagccgttcctgcctcagtgcttccataaccagctggggacttaggaggtggctgtttgtgggattcaaaaaacggaaccatgggaaccttggaagcccaagtgctgggcgtcttcgatgagcttagcattcagaagagaaattgcgcttcataggccatgtggggtctgtgcataaacctgtatacagcagagttcattgcagcaatggtcccgcgccttcctcagcagcgtcctcaagcagcgccaccgtgtggcagcagtaagcaatggcagtgatcggattcctgtccactccctggtgtggatgtcctcggcggacttcctgtccattacgcatgtgggacatcaagagataaatcggaaaaataagaaatacaactgtatatgaagcccggtttggagaggcatttgtttgcataagtctgtaagatccgttgtagaccctcggtaaatgtttgttttggagatgaggaaatggaggcagagagaaggcaagtcatttatcacagacagcgttaactctgggcagagttaggataagaatatgtgaatcttctggccccagttttggtagttctgcagttgaaagataccatgaagaaggatgatgtgtattaagagaccatgatccgatcactctttatgagattactaagagctatggattgctagggctattcctggctatttggggagagggaagtctgaccctcttggatgcttattttatctctggcaaccattttggggtcattaatatttctcatctgcatgtctgtacctcttccttccagttttcctaatgaccttcttcctttttgcctgcctccttgcatttccgtttcgttggtttaccaaatagatttcattgtgagatatgtgtgtcattgagtcaaatgtatcttcactaaaagagaagttctggttcctgttctgaaatttctgtcttacacatttaaaaatggaagaagatatttaaaagtaaaataaattaaataagcacacattaatataatgagattacataagacctggtggataatatgtgagactgggttgagattgatgagtgatggcttcttagaggagaaagattttaaagatatgcgatatgaaagtagagggaggaggtgtgcactccgacgagaaatgagacaggtggggaagtccagtgtacatgtgtttacggggttagtgagaagagagttggcaaaagtgtatgggattattcagaacaatctgaggaaaagatatctggcttagggaaggagttcctggagtcaatggagacttaagctgttaaaggaaaataaaagtgaaaaaaatgaaaaaaactttggagtagtttttgggctcaaaatctcactttactgttactatctgggtgactttggacaaggtatttaagatatgaatgtgttttctcatctacaaaaatgtgcttttgtgaaaatcaagtaaaatgtcctatgagatgccctaaaacaatactggcctagaggaggtgttcaataaatgtaacttttacactttataccaatttcaaattctcatcactaagttatagtttcaaatgaatgttttcagtttatcttgatgttgctcctgacttcaaaattttctgtttggattttcttagaaattaataatctttcacacatagctatcaaataaatcattgttttcatttaagaaacatggataaattggcacacacacaaaatcattctcagaaatctatcaaaaccaattaaaggaaccccaaattaggaaggacaattgcatttgtcatgaaattagagtggagcctcagcctcaaaccctaaattacaaagactagtttttgaattcaatttaatagaagcttccaggatttcatacatatgttctttaattttgcatatactgcatatatgggaaatgagaatgcttgaaggggcttttaaaccctggtaattaggacagggtggcaaagtgacacatcaaagtttatgttccagaaataaaaaagaaacttgtgacaaatgacttacaaagggcgaattttttccccaaaagtattaatgtaagaagtttagatatgtttctaaaagtctaccatccctcattatttgtccatcattatttcagtacaaacatacccaatgtttcataaaatatatttcattaataattaagacagacaagctttgatttaacaatttcttaccatatgaatgtggttgtggtctcaaccactggtaaaagaattatgggggacacattcagctgctgcaataaagacaaccattgtaaatgcttacctcttagatgaaaatggttgggccggatgtcctcctattgtttgctcttccacatctgaaaagaacgtagactaaatggagtgaatcctcactgatacatggaagtgaatatgtccacattggcagcattcataaacagcagcaggtttccttaatatgagaatcagagtagttacagcatagatgagtttttgagcctgcatagaaaaagtccagaaaacatgcagcacgcactgctggtgagcattaactcactcttgtcatttgggaaagagaacccattgtttctagatcttcaatttctgcagaaaagcatggagtctgttactcttcatttttttgttttgtttgttttgtttttggaagagtgaaatctccagctttaaaaatgttggcaacaaatacaacattctttttaaagcatagtcagtgtaagcatcgttggtgggctagacaggacatacctgtgagccagatttgactcacaggctttcagtttgcagtctctgaggtctagtgtatgaagttggaatcccgagaggcagcgagtgggagaaaatgaaggctcagaacaagtcagacctcttgtagcaggcctataacttcttcctggagcaccttgactctcttagcaccatacaggatctgatctgagagagagttgtgtaagattgatgctccagaattatactgtatacttttgaccagaatattttcattttcagtatgaacacattgctctcttaagtattttttgcatttgtaaaagaaaataataagccccaacatatccctgaagcttacaatatctgtgccccaaactcttccttatgaactttcttaatattttaacaatatcaaaacagaaaaaaaattgttaggcataaattatctacttactctgacctatatcgggttctttttcaagcttttcaaaaggtgacacaaaagccagttcaacctgaatattggaaaagaattgcaggggtctctgagcattgggaaaggatacaaaaggcatcagaagtttggctttgagacagttgccatgaaaggtatctcattttcctgccctggagattttatattaaatggattatctgtctgtcaagcattttgagcattccccttcactgctttccctgaggactattgcagcatcttaccgtgtgaggtgggccatatttttttttgcagatgatttatagaatatgagatatataagcagccgttaacacatctagttttatttttaaagttatgtttgaatggattatgtttgtcccacaatcattttttaatctgaataataaggtcaatttgacacagctctttttttttttttaacatttagtttaatcctttaacaaaccttgccctcatttctgtttaaccttggaccacctgctttggctggttatgtaatttgcaaattagaaaatgactatttcttttttcttgttattggactccaaaactcacccaaattctttttctttgctttgtgtttcctctctgtcttcctaatttcttatgcctgtattaataaaatggcttgagagataatagtctagttaaatgcatagtttcctaatttgcttatggaaaagctaaagtagactggaaagaacatgttactaaattataattttaaattttttatcattgaatgtcagtctcactgtgatccttttatgactctataaatatgctttcttttgaatgctggaggtggaaggcaggttggcggtcacctggactaaaaccatcgttttactgaaaaagcaattgtgaactaaataggagaggtctcttggccaaggtcaaacataagctggtggcaaaatcaggagagagtcttgtatcctggttaagaggtataaggatccagagtcagacaaaactccatgtcctggatggccttatattagttatcttgctatgacttctggcaagtcaaataacttttctgagcctcagtttcaaaaattttaaaatgaagattatcatattgctcactgttatttataatgtggaataagtgatagattccacatcaactgcgtgacatctaacacctagtaagctctcagtaagttgttactgttattgctgcatctctcataatcatcactctgatcacctgtctatgtttgtgtcatcacacagctctagcaatgtttccaaaccaaagaaagggtcccttaaacttcctcagcaagggcttggcatctgttgtcatttgttgactgtttctcagatggttcaggaatgtatacggtgcgtattattaagtttgcagctccccttgatttccattcgtcacatttggtccataaattcaatcaatatgtattgaacaccttccttctgtacacaaagctctactagatccctaggatacagggtgaacaagaaggtataatccctcttgcctggggcttatgtttggagttgggagaatagaagctaaataactaatcatactgttgtttacttatggttgtgttcagtggttaaagttgagtaccaagtgctatgagtgagtaaaagaggggagtcaaagatggaggcttctcggacaagtaggtcttagctaggcatgacctaaggtataattatttttattttgaagggatggtatctgaggaggtacaggaagcagaagtcattgaaattttagggatgaatagaaagtcattgtggctgaagcaaggggatgctggaggataagggtggaaaggaaggaggggctgaaacattaatttttaggccatgttaagttttctgggctgcattataagaaaataaatggaatgttattgaaaggttatacacagaaaaatatcatcaccagatcttttataaagataattttagtgcttcatgaagaacaagtagaggaagcagagagaactgcttggggtcggggtggcttgtaatagagtgggggcagtggaggtggagagagatctgagaaatacaaagaggtacaaggaaccagcctggtgtgtgactggtgtgtcagtggaggcagagagagatgtcaagaatgactccacttttgacatgaactccagtcatcatgaatgttggagtaagactggtccatgatcatatttttttcctggtgaaataaagcacggaggagttctgagttctggaaaaagaccgattgaaatgagaggtgaaaagagaacgctaagtacgatgaggacagaagacatactttaaatatgttaagtagtaagaacatcaaatactaggagccagtatagttaagttacgaattgtgaggtttgtgtatgttagagttgaggaattcctgtttcttgctgttttgatgggcacagtgttcttccacgacagtaatcagataaactacttaggtcaactcaattaatctcttttaaaagaagcctggaataatctgctccgttctttgacataaattgattgattagaatgtttgcatccccaaattaaggtaaaaccactgccattttacagaaggtattgatcttatgtctgttaaaattgtatctttaaattttttaatttagttttattctttttcaatgagaatacagatttcaaactaaatgtagtgtaggtgtgaatgataataaaataccacataatttagtgtagttttcctatacgcattatattcatttcagcgcattatgatttcaactgtgtttgtacttgaattactcatttttgtttatcaacatgaggtttccatctgatccagaatcaaatagtttttattcagagttctattcatttactaaaaataatttcttatgaatgttctcatatatgcacatgcatgcatgttttaaaaagataacagaatcctgttattgccaagaaatttgggggtaagaccatggtggcaatttaagcaggttttgttttgttttagttttgtttttgagatctttatttctcccagctacctatcaaataatataggagggaaaactgtgtcccacaactggaaaacccataaggctccccagtcatctacctcaaatcttgaggagtctccagagctatcattgtgcaaagagatgtgggggagctgttctgacctgtttattgactcaatagtatgtgtcattcaaatttagggaatggagaaagatgctgttgccattctgctggccatgttacttgtcaaagcccataaccacgaatgtttggagaaaatttaaagttgaatataggagagaacaataatgatatggaagtttcctgtactactcaggaggatatcacatttatcaaataaaagaaacaataagaaaacagggctgggtgtggtggctcaggcctgtagtcccagcactttgggaggcagaggcgggtgggtggcttgagtccaggagtttgtgaccagcctgggcaacatagggagaccccatctctacaaaatatataaaaattagctgggtgtggtagtgcacacgtgtagtcacagctactctggaggctgaggtggaaggctagcttgaagccaggaggctgaagttgcagtgagcgaaggtcatgccactgcaccccagcctgagcagcaaaacaagaccctgtctcaaattatactacaaggctatagttaccaaatcagcatggtactggtataaaaatagccaagtaaaccagtggaacagaatagggaacccagaaataaagccaaatactcatagccaactgatcttcaacaaagcatacaaaagcataaagtgaggaaaagacaccttattcaataaatggtgcagggaaaactggcaagccacatgtagaagaatgaagctgtgtcctcatctctcaccttatacaaaaatcaactcaagattcatcaaagacttaaatctaagacatgaaaccatagaaattctagaagatacatcagaaaaactcttgtagatattggcttagggaaagaattcatgactaaggacccaaaagcaaatgtaagaaaaaccaaaataaataaatgagacctaattaaactaaaaagcttctgcacagcaaaagaaatagtcagcaagtaaatagacaacccgcagaatgggagaaaatatttgcaaactatgcatctgacaaaggactaaaatatcgagaatctgcaaggaactcaagaaaaaaaaaactaataatcccatcaaaaagtgggcaaaggacatgaatagacaattcacaaatggagatacacaaacagccaataaacatatgaaaaaatgcttcacatcactagttatcagggaaatgcaaaataaaaccataacgagatataatctcacacaagtcaaaatgactgttattaaaaagtcaaaaaataatagatattggcctgaaagtggtgaaaaggtaacacttttacactgctggtgagaatgtaaactagtacaaccactgtggaaaacagtatggagattccttaaggaactaaaagagagagctaagctgtgaggctgcaaaggtataacaatgataaaatggactttggggattcaggggaaagggtaggaggtggatgggggataaaagactacatgttgggtacaatgtacactgcttgggtgatgagtgcaccaaaatcccagaaatcaccactaaagaactatctgtgtaacaagaaaccacctgtacccccacaactattgaaataaaaaagaaaaaaaggaaagcaaaattaaaacaaagaagaaagagagattgcttgaggaaaaaaaaaacaacaacaaagtataccctttagtagagatagtaaatatcagaatggatgctactgaccaaattaattaactggaaggctgagaaaattcgcataactgtaagtaaaaaagaggttttataagagagaggatgacgcacataggataggtcttggggctcatctcataactaataataggaattttagaaatagagaacagatgagaggaaggaggagaactaacagattaccatttcctctaagccaaacctaattcttcaagccttcacattgaatgacctcactacaagctggtgaagattaatgaaaataaaaacttttagacataccatgatggaattttgaattccaaggtaaagagaaaatgtatacaaaagttgacacagaaaaacaattagttaccttcaaggaaaagagaatttgactattatccagtttctcatctgccacagaaaatgctagtggacaatgcaacattcctttcagaactgtgagtaaaaagggttgcaatcatagtattctctcaccagacacagtttgctcatgtttgacggaaaaatgtgcgttttgatacatgaaaggactcaaagtattctgcaaatgtactgtttaaaaaaaacaaaacaaaacaaaaggaggtagtaggaggagacttaaggatgtactatagccaaaatgaaaatgagtcaaaatatatcacaaataggtcacaatatgagaaggggtgcaagatatatgggtcacaaatgctgctacaagactggccctgggcagattgcattaatatcacctaaggtggccaggcctggtggctcccgcctgtaatcgcagcactttgggaggctgaagcaggtggatcatctgaggtcaggaggtcgagaccagcctggccaacatggtgaaaccccatctctactaaaaatacaaaaattagctgggtgtgatggcgggctcctgtaatcccagctactccagaggctgaggcaggagaattgcttgaacccaggaggcagaggttgcagtgagctgagatcgcgccattgcactccagcctgggtgacaagagcaagactgcatcttaaaaaaaaaaaaagacaaaacaaaaaccacctaatgagattttctttccccagctttattgaagaataattgaaaaataaaaattgtttacattcaaggtatacaacttgattattttgacatgtgtgtacattgtgacaagattaccacaatcaagttagttaacatcttcatcacctcacatagttacctttttttgttgtggtgagaatacttaagacgtactctctttgtaaatttcaagtatacaatacattattactaactatattcaccatgctgtacattaggtatccagaaatcattcattcattaggtatccagaaattattcaaagtttgtgccctttgaccaaaacctccctgttacccccacacctgccccctggtaaccaccattctattttctgtttctatgggttcaactcttttggattccacatataagtgagatcacgcagtatttttctttctgtgcctggcttacttcactttgcataataatgtcctctaggctcattgatgttgcaactggcagaattttttttaagactgaaaaatgttcagctgtgtggaatattatattactattaatattatatgctatattttatatataccacaattgtgatgggtgtaccacaatttcttcaatatcagggctattttgaataatgctgtaatgaacgtggaagttcatctgtctcttcgagagagctattttatttcttttggatatatacccagaagtggaattgctgggtcatatgactgttctatttttaactttttgaggaatctttactgttttgcataatggtatattcattataatgcataatgtcaatttatatccccatcaacagtgtttaagggcttcgttttcaccacatccttgctcaacattagtattcatcagggaaacgcaaatcaaaaccacaatgaaatctcatctcacacctgttaggattttttttggttattatctattatttttgataataattattatcaaaaagtgaaaagataacaagcaagggaattctgccaaggagactttaaatgctgattcctggagtccaaagtgagagattatgagagtgtaaacctgagataggtcccagtagtctgtatttttaataagttctccaagtcacctgacagccaaatttggtaacctgagagtaatgagttcagtaaaatatattacaattaaattattattgataatgtaagttatgaaatattaatgaaatggttaagaaaggatcctcaactgcaaggacaaaaatgcaatcatttttgtctgaaagtaaattctagcttatttcaagagaatctaggtgctgtgtgtatgttgtgaatgctgtgtagtgtaagggaatcactgaagacttagaagcttgtaaatgcctagccttgttcctgaagggggagctcttagagaccgtttagtcattgagattgatggagaaacattacttacatatgcttatatatttaaagattaccaacagtgaaatacaaataagatgaatagctccttaatggctagagaatgcaaaataacacataagaaaaagaaagcttcgatagtagagtaaaaatttggaagaaagaaacgagaaaatataaacaaacaactatgagtgatagaatgtagtttgatagtagtaatcatttcactatgtatatgtatatcaaaatattatgttgtgtacatcagacatagatgtaataaaaataaatttaaaaatatatatgcaagttacaattaaagtaggtaaattaaatcttaaattacaaaacatttttgcattagcttaagaaggataaaccaattccatgctgtttaaaagaagactttttttttaaatggcacaaagtaattggaaagtttttcactattatatctgcagctcttggcatgattggacatatggttcaaaaatgattgccacctcatggaatgaatggatgtggaaaagtataacagcctcctatcacaaccacaaccaaaaataaaaaggtaacgtgtaacaataccattattacaatacacttcaaataataaataattagatggcacatagggctatttttaccaaaaaatccaccattaaacaaggtataatagcatcaaacttttgtgcactgaaggacacacattatgatgaattggaaacataaacattcaagaagaaattaacaaaactattaccagactgggaaattttaatacatctctcagaattggactagtcaaaaaaatccaagacaaatgatgtaatattttccacaatattaagctcataccaatgctttgataaccataagctttttaccttgtcatttaataacattttaattgtaaaataaagtaaatatgatgactaaaagtaaatgaaaacattcgaacaaaatacttctttgttttcaccctggcccattttaatatgtccacttggcttctaatagtatatgatgtttccctttcctcgtttgagaacccctggtttgaatattacagttcagttaagatttatttcaagaccaggcatggtggcttatgcctgtaatccctgaagcagaaggatcacttgaggctaggcgttcaacagaccaagcaacataggaagactccatctctacaaaaaattttaaaacattagctgggcatggtgttgtgtgcctatggttctagctaggctgagccaggaggatcgcttgagtccaggagttaaaggttatagtaagctatgatgaggccattgcaccccactctgacctgggtgacagagtaagaccttgcctccatggttggaaagttatactctacaaatgtagactgtatattgtttcaaaaatgtttttggaatgtttatgaaatttgatcatatatgtaaagaaaatttcaaatattaaatattaaaaatcttataggttatattgtctaattaaagagcaataaaattataaattagcaaggaccaaaaatatgagctacttggaaattaaaattaaacttgtgaatggcttttgggtttaagtggaaatcaattatactatgaactatctttaaaacaagtcacagaaaataattattcaggattctaatatgtggtcagatgtttactgagagagatttttaaaaatgtaaatgcatcattcttaaatatgaaagattgaaattaagtaatctaaacatttaactcgagaggctagaaaatgacattataaaacaaaataaattaataaaaagtgaatagttatttaaaagtagaaattaatgacttgtttacatataaaatatatagaattaaaaataccccatatttgaaaagacttgtaaaatcaacaaagctttgttgtttctgattcaaaaaaatgagttcataaatgtatgatattaaatttaaaggagataggaccatttgtatgtaatacattttcaaaatcagtagtgcttgttatggatgtaatacttgcaagcagatttggtgatttgcttggaaaaagaaagaaccactttgttttttcgaaaagaaaaatttcctgcttaaatgaattgccaagataaagcaaattaaagattgtcttagatttaccctcagttctgcaaaatacacagattcagatggcttcctagttaagtgctgaagctcaagagacaaatcattaccaagtgatttaaaatgtttcagaattttaaaactaaaagtaatagggaacactttctatcttatttaaagttcatgttttgagagtctaatatatattgtgaaattttagaaaggctgtacgaagtaacattaaaaattgtagaccagcttccttattattactcttgtaaatatgattgaatcgcaggcatcatcaagttaaaagaatgatatacacttaccaagtatatttgttctaaaaatgcaagaagagttcagtattcagaggtatattaatataattatttataatacattgaaaagataaattccacatctctattttgaaagatgtttaacgccttttgatgaaatcaaatcgacattccccagtaacatttttagaacattaggaatgataaaataaactttttttttttgagacggagtctggctctgtcactcaggctggagtgcggtggcgcgatctcggctcactgcaagctccgcctcccgggttcccgccattctcctgcctcagcctcccgagtagctgggactacaggcgccgccaccacgcccggctgatttttttgtagagacggggtttcaccctgctagccaggatggtctcgatctcctgacctcgtgatccacccgcctccgcctcccaaagtgctgggattacaggcgtgagccaccgcgcccggcctagaaactttaaagctattatgaaagatatgaaaaacagtagtgaatataacaattcactgtaaacagtaaaactgtttctgttttaagttaaagaacaaatactctttatcaatgctcttagtcaacaatgctctgaagattatagttggtaaaatgaaaacagaattaagaataaataatgggaaaggacaaatattactattttcagattgtatatgggttcttcaataaatttttacaattaaaagcttttagaactaatgagttcactacatgatgagagataagataaatgaaactagttattagctaatacttgcaagaatcaaaaaagtaagggaggccgggcgcggtggctcacgcctgtaatcccagcactttgggaggccgaggcgggaggatcacaaggtcaggagatcgagaccatcctggctaacacggtgaaaccccgtctctactaaaaatacaaaaaattagccgggcgtggtggcggcgcctgtagtcccagctactcgggaggctgaggcgggagaatggcgggaacccgggaggcggagcttgcagtgagccgagatcgcgccaccgcactccagcctgggcgacacaccaagactccgtctcaaaacaaaaaaacaacaacaacaaaaagaggaataatattatattcacagaagaaagaaatacaaaaaaattagaagtaaacttaggaaacttaggaaatcatcaagacctacatgaaaaaatagtaccattcactatatgatataaacaagtgcttgattgaaaagtaaacacactctcctcctaaatgggaagtcctgtcattctaaggatgtcacatgtgcccacattaatctgtaagtttactgaagttcaagtaaaaatctttacagtttttctgtttttgttttttgcttagaataaaggcagaacttaatgaacctaaatttgatttggagaaaaaagtgggtagagaaatgtagggagtgaacagagccttttggaagagggaatgggagactttactagatataaatatgaatgtaaaagccaaaatattttaaaatgtactgtcagtaaaaacttatgcagatgtagatggatcaatagaaatagaacaaaccgtagttataaatttaagtggatattaaatgtcatataaaatgaattgtaatatggattgataactcagcaaatactgaaaaaatggtctattttaatacttagatcaataccacttcaaacaaaagcacattactctgaaacttaaatatagaaataatcacatactactatacgaaaatacagaatgtttctaacttttaagcaaggacttcctcagcctgattttagtcgaataactataatagaggaagatgtttctttaaaaaactaaattctgtaaaacacgaattctttataaacacaaagtcatatataaacaaatgtttattgcagtattttttattacatccaaaaaccatgcacctaaatgtccaccaggaaatggacagataaataaaaatgatttgctcttaccaaaaatgttaaaataactttaaataatgataaggtgggtctacatgtatggacctggaaaaatgccattacattttcagaggacaaaaacactcataaaataggatgtaatatgtgatctcatttttataattccacgtctttgcatttttgtctgtcttttgtgtgtagaaaaagaaaataatgtgaaactaataccaacttcaagaattaaggggatgaaattacacagtggagatttttaactttatttttatatattctgaaatatttgaatggtgaacagtcattgctttaataattggaaaaagtagagctatttccaatttgggttaaaaaagtcagtgggacattatcgtctatattctacctgtatgattgagatcctaagccaaaccaattcttagagatattctgaatgacatatcccaaagcgcaggtaagtacactcactgttagactctgctcatagttatgagggaaacatagtctccagtcacatcaaaaaccatgaaagacaagaaaagatcattagtatactgtatttacttgagttacttactgaatagtatgtactgggctcttggtgtgtttggtattaatattgactgttgggttctagtctagactcttggttctgtggtgctgtcatctataccattggtccttggaacaggagcacctaggaacttgttagaaacagaaagtctcagacttcattcctgacctcgtgaatcagaaatttctggagcccacgctcaatcagcaagcactccaggtgattctgatggatccgaatgtttgagaaccactgctctgctgcatccaggggaaagctatttactaagtcaagttttattgtaagttgatctttctcttttgagtatatcagaatttattaagaatgattagaaaattgattgcaaaccaaagagtggataaagaaaatggggcatatatacaccatggaatactactcagccataaaaaaaaacgaaataatgtctttttcagcaacttagatggagctggaggccattattctaaatgaagtaactcagaaatggaaaaccaaacattgtatgttctcacttataagtgggagccaagctatgaggatgcaaaggcataagaatgatttaatggactttggggacttgaggggaagggtgaaatgggggtgaggcataaaagactacatattgggtacagtgttcattgcttgggtgatggctgcaacaaaatcccggaaatcaccactgaaggacttatccacgtaaccaaaaaccacctgtaccctaaaaacgattgaaataaaaaacaaaaaaaagaaaactggtggcaagtaggccagcccatgaaagccgtttaatacttggttaagtagactgacattcttttcgtagatggtagggagctttaaagatttctgaatgtgagaaggacatgagtggttgatgtccatcaggacaactgctctagctgcagtgtatagcagattgcaggagactgacagtggagatggagagccaagttagaaggcaattaaataggtcaagcaagaggtagtaaaaacctggattggagtagaggaaatggaattggaaaagagacaaatgagaaagagagattgtgaaagtgagaacagtgcttggtccctgatggcatgtaggggccaaaagagaagaaaggcaaagatgattgacgttttaagcctatgtgacaggtattattggcactacagatcagaacaactatcagtgatctgcaacgtggtagattgtgctgatatcagtcatcacacagaagattggtttgtttggatttctaaattggggcttttcagttcattggaaggatggttaaaaatctcaatgattagcattagaacaaaagagaacagaaatacagttgagtactttgccagactcatcaaatatgattttgatgggctaagaactcctaacgaggacacagtgatcaactgagcaaacagaccatttggcttgaacagaaatgtcaacataggcataatctactaagttgctaattagggatggtactagccggttgatggacttcagccaagacatacagaatggtgagaagccagtgcacagagcctctgggaatctgaatgatcaattatttttcatcccataatgtaatttacctgtattagaatttatatgcagaattaaacactccttcttcagagtttccacagtattctagatttttattgaagtatttattttaatggtttatttatcttgggcagagctttttgtggggatatcaaactgttaatggatagaaagggatagattgaatattcctgagagttggatcagtgtgaagtaaagttgaagttggttatactatggcaagtatgatgtagagaaaatctttcggatgttcgaaggtcaactcagctacttacttccttttataatttggttcgacttgaacactatgattcctcatttgttaaatagaaataataataatagtttacctcatagggttattataagaattaaatctaaaatccagttgacttgaactctaaaagataaaataaaatttgaaaaagaactaaaggaaaaaataattaaataaaattatgcatatgcaatgttaaaaaacagaatcggaaaaataatttctcaaagagggtagctgttgttgctattatcgttgttttattttattgtcaaacaggctgtgagagtcaactagaagggtgacgatcttgaggtaagaagtttttgcatccctctagcatattttacaagcagcatcaggtacaagctaaatgagtgtcgctgagcctgaacttgtttggtgagtagttgaataagggaatgataaggcccacattcatttatttttacttttaaggtagaagggtgcagcaacttggtttctgcagaatgtatcacttgctgtcttttccgtggaaaagaggctatagttgttcattcagattgaacaactgattgtaaaattgtaatacccctagatggaggtgtataagaaaactaagccatttcttttcttataaatatgcatacatgtcttagttcattcatgcttctctaacagcataacatagactgggtggcttataagcaacagacatttatttctcaaaattctggagactgggatttccaaatcaaggagctggcaaattggatgtctggtgagggcccacttctggttcatagccagccttcttctctctgagttctcacagggtgtaaaggaccaaggaactctcctgagtctctttgatgagggcactaatctcattcaaaagggttccaccctcatgatctaatcatctaccaaaggccttacctcctaatagtatctctgataggccagtcttgtgttgccagaaatgaacattctcaagttcatttcatgccagaaaggaatatctgagactgggtaatttattttaaaaagaggtttaattgactcacagttctgcaagtggtataagcatggcattggcatctgctcagcttctggagaggcctcagggagctttcagtcatggcagaaggcaaagcaggagcgggcacatcacatggcaaaagcaggagcaagagagtggggaagtgccacatattttcaaacaactgtatatggacactcattattgtaaggacagcacgaagccatgagggatcctcccccatgatccagtcacttcccaccaggccccatctccaaaactggagtttacaattcaacatgagatttgggtggggtcaaatgttccaactatatcactatcacattggtgattaggatttcagcatttgaatttgcaggggacataaatatttgatctatggaaatatgtataagacatttatttaatctataaaataagatctctaatgaatgtgttataaaaggtagcttctaggttcactgtcctattttaggaaacttgcaaatgttcattagtctcctaaacctctgccgatagcttgccttttctttgtgaccttggattttttttttgtaggattccctgtctagaatatcctagcttgtttttcctaaacatggaaatcactaatccttcatggccgagtttaccatccttctccttagtaatttcgctttatttcaacaaggaaaaaaagtctgagaaattctgtagcactttggtccattgttatgacatgcatttcaaatgacctaacactgtttatatttgtgtagaaattttatttatcttattagattgtaaactccatacaagaaagctgaaaaaataaaattaagaatacggggaaaggtttgaagcagaaggtcagagacagaggcttcttcaatgccatacagaggattgggcttgagtagtaactactgcttgataccagatgacttaatctctctaaccatgatgtaatgaaccagaggtgggtccctgtccccaaaggactgtgatccttaataagtgacttggtaagagctctggctaactggtgtgttgaaaatgtcacaacaccctaacctgatctgatcatacagacagaatgagcagagtgattggactaaagctaaaaggcagagagagggcaatgatattacaggcaagcagctagcacagcaaaaaattcaatgtaaataaaatagtagagttaggagaagattatctgccctctttaccaaccccttcatctttaagttaaatctcatgaactcaagttacctgaaaatatggtttattccatgtatgtgaaaaaaggcctgactagtacagcatcattttgtaatctctttggcagaaatgattctttttatatgttgagtctaaatgcactgccttgtagcttccatgcacaggtacttgtcatgcttcctgaaatcacacagaacatgcattaactatgtagccaatgacaggccttctaggatgagcagattcttcaacagtagggagatgtctttcacaggaaacgaatgagtatttgtcagggcttcacttgatatactttctaccactgtcccggtaaggaatagcagaatataaataaagggtctaatatgtacttattaatgagtttgctaaatagaatatatataccacttagtgagtggtactatgattgttttgggtacatacctaagattagcttttgttttaatagtagaaatatgtatatattattatgtatattaggaaaatataaccagcatggaaaacccatggcttccttgagtctattcattaagacaaatggaaaatacatatttaaatttaaaataagaatttaacaatgctaagtaaacagttctagtggtatgcacatatggccaacataatggaggatgtttgctaatgatggtaattagtataacactgctttaagaaaaagtgtcaacagattagcatgatatgccacaagcaaactggaccaagattatcacttttatttttgctttctaatttcagcggttaaattttaagatatttgatatagcttaggagattgattgctttgaaaaccaacttaaatatgaaataaagaaactatactagcacaagtaatgcaagaaataaacatcacttcaaggtcaatatcaagaaattggaaccctttctgaatttataagaatattttgagaaacaactttcctgtcaaatggaagtcaggagaaaatcaacaaagagtcacctttgtacccaagaaaacctatagacacatgtaacagcatgcagaaatataaaggtaaaaaaatcactcaagagtcagtgagaattttttttagtaaaggtcatttgatgtccacttccttgtatatcaaatagttaaatgcggatgaaagcaggagatatgaataatactagaccgtgtatccattaaggaatcatgaaaacaaaagtttaaagcaagaattgctaaaaccaagtgttttctcaaaagagctcttaagtcaaatgtagaggtaagaatatatgactttatcactgtatcattttattacaggatggaattcaacattttcaatgtgattttcatgtattttattgatttgggaaggttagcgattaaatattgttaataacattctacctggtttctcaacatctcatatcttttttcctctgacccatcagaaatactactggcacacttgtctccccagtgcacttcttggattgtttttgctcctctgctcaccacacttcttgaggctgcttcctgaattcctccatacatatgaattctttagcaggctattcagcatgcctgtgctgtctgtgccaaatctaacttccagtcattttcctttgcacttgtgtttggctacttaggtttatcttaatatgctctatatgccagggctcttcagagaagcagaaccaatgggattgtgtgtgtgtttgtgtgtgtgtgtgtgtgtgtgtgtgtgtgtgtgtgtatctccaggaaacttcagtttttacatttaaggctttcagctgattggatgaagatcacccacattaaggagaataatctcctttacttaagctgaattgattatagatgttaatcctatcaacaaaatactttcaaagcaatatcaagactagtgtttgaccaaacaactgggccccagagcctagccaaggtgacgcataaaatttaaccatcacaattgccttgcttttctttctctatcgtctggattttaaaattttttatactttaccttatatgtccttattccatattcctaaatttgaatacccttcaagccccagctcatttctctcttattttcaaagtcattaccattcacttcatcctggaatggtagctaggacctgtgaaattctgtagcaggatgcactgctttcatagcatgcatttcatgctgcctggtgttgaaggtatttgtgtaaggcttttatactctgtgagagctttgagcttctcaagggccagagctgtaacacatatgtctttgaattaatatataattcattgctctacacaaaggtacatacttttttttttgttttctgaagtgcagagtgctattctaagccatcttaaactcaaagaattatagaaacgttctggcatacagtcagaatatggaataggaagagtgtttcacaaagtgtgataggcatcctaccacacaaagtagtgtttgctttaatagattcatgttcatgttactgtgatttagaaaaaaaaaattgtaacatcaaaccaatgaattctcagatattaatgtttaggatggtgttaaaacagagacttatgttaggcttgaatcaatgattaaatatttatttgagggtcaatgttcaagtatgacaatgtagtaaaatagtatgtgaagaaactaggtttgttccatgttaacttaatgcagttctagactggaaatgaggagaattgaaattctataggcccatcactcattgtgtgtgtgatcttaagacatttttacctcttggcatctgtatcttttttggggggtaggtattctgttatcatctaactctaaaagtgtaatttgctactaagatgcctataaatacagccagactacaacacagatggtgcacacaggaagaaaatctctgattggtagactaacccaaaataggctgtgtatatattgaatgaaatacgaccaaaaaatctgcaaatagcagacacagagcatcctttaggttggaactgagtaaagtagatttatgatctaatcttacttattctatgacatttctgtttaatgaatgtccctgatcctcctgccatcttactcacatttctaatgtgctcatactccgaggtaataatgatcatttgcaattataaatgtcctgttatcaattaatttgcagttcaccagtaaccatctgattatctctaacaaagctgcgctggtgtggtaattatgttgagagtaatcatcatgtaattgcacataattatttgtaccttattaagtgctcatatgattaaaatatttctggtcaaataaaaattatccgtgagagtattttttggaggggggaaataagaaatgttgcttcctggtcttctgttctttgaataaggtaaagctgtctagctgacagtccataatgccccagataggatgaattagtaaggagagaagagacttagatttcattaatacaataccttgtacctccaatgaagttgagataataaacttcaacttccagcatggatgaacgctttccctgtagtagctataacaaaaaatattaccctattaagagtgtacactatgaatgtcattgaggacaatgtgtttttcatgtccaacaccgccattagcaattttatactgaacttttatttttctcatagtactctctcttcaaaacttttaatattcacttatttacactcagtgttttttttaatttccagggactgtgtttagtgagatgatctacaggtataattccaaaagcacctaccaaatttgtttattcagacattcattaaagagcaactctatatactagcactctcctttagaaatattatgtgagctacgtagccaaatttactttttccaggacccacaaacaacagcaagaaataggtaaaattaatattagtaatatattttatgtaaaataatcattacttcataggtactcagttgtaaaaaagattagtgaaatattttacattttttgtactaagccttataaatctagtgtagattttacttatagcacatctcaattcagatgagcaacatttcaagggctccatagccataggtagcttatggctgctgaattagatggtgcatatatgttgattgtatctacatggtagataaaggagagtcctaattaatagttagctctctgattttatagatgtttttatgagtttcaatttcctaatctggtaaataatacatctagcctaaaacatttctttttaaattaaaatgttttctagaaggatagggatggaactaacattaagggactgctttactaggtcatgtaggatactaggtatatttacatttattatcaaattcattcttcacaatagtctagaagggtatgttactttacaggttagaaaagtgagatgtaaagtttaaccttatcaatagtagaatagtagaactgggattcaaacttggctatcatctttgaccacagattttgtctcatgcttttcaaataagaaacacatattttgggtccacttgctcattgataggtctagtaagaggattttacttccctgaatactgtgtaaaaggcttgactgcaagaaagttactgattagtttgatttttagggtttctcctgaccttccttatccatgtttcccagtccagtttcttgaattagtctctcctgaaagcttgttctttccagcaaacttatctcaagtatagcataaatcatcttccactggcattttaactgaaagtctgttgactatcacgcacacttacagaaagcctacctttggggataactgagtgactgacagcgatgccttagcaaccatctgattgtagttacagaggaaatttaccttggattgaagaatcacatgccattgtgattgacagagtctgtaagacaatcaaggtcaaacccagagtaaattgagtatgtggctatgagcattgacagataagtcatgtgtcaaatattgcctagccatctggttgctactcatgattagactggattcattgtgtttaatttcttattgaggacaactacatgggaaacttgtttgtttttagtttatcagtgaaatgtgctttatctgctgacataaaatgtttctgcctaaagtgaacttgcaaaatcattagttttatgactccagcatgacctacaaaaaattattatttaaaagtgattgatgcattattgaaaaaaatatattaggtgctgaaagttacactcatgaataaaagcacaattccttaaagaggaataagaaaacaaatgtgatcaccccgagggtttttagaagcccccaaatgtttaaagactattagccaaactgggtaccagatatgtgggtagtgagaggtgatgagatgtcagtgataagtgatgtataaggggacaggtgccttgtgtgaaattctgaaaattcacatttagtagaacgtatcaaacgccagtagaacgtatcaaacgccagcaaatacttagtttatttttgaggacaaaagtggaaaacacagggaagtgaaatcaattgtcctatgtcacattgtacttggaatggggctctgagtcccctgactactaatccagtgcaatttcctcctgtaactttgctgcctttgtaaatgattacattttaaatacaagggctgtttggcttattaattagttagtgttaaaaaaagccaaagttgcttttcatcactgatggattagtacctttcattctgttttcaactaccatattgtccttttaactgaactattaaaaacatttttccttgttgatcacagcttgggtgaacaaagtaggggctaatgaaaataaattcccggtcagagaaaatggcagttgcacgagttttggtggtatgatagtcacatttgcatatgtaaagtataacactacataagcaaataatatgacccaattttaggtggtgatctatatgtcattgctggttcctctgcaagaataaatactgaatgcttctaggcatttccagtaagcacagtaaatccatttcaataatgaagaattcctgagaaaacaatataatagaatcaacaggttctagcaaagtggaattttatcataaattacaagttccaccatgttaacacgtacattgcaacatgttttggacagtacttctgaggttggaattctcagcaagtggttcctattttgacatccagacagtgatagccatttgtaggtggaaaattagttatcagctgtgccttgctttttctttacttgggtttctctatttctctgtctttttacacacacacacatacacacaccccacacacatatacacatatatatctatccttggatatccaaaaaaagattctcaataaattcacaacactaattgaattgagatgatataaagttgttgattatttttaataaagtctagagatctaacattagttgtagcttatttcttcactactaaataagaaattccaagttaagtcttttcatcttttcattaataaatagccaatatgtaatatctgcccatccatatatattatgaactatctgaactactccttataattatggggtaaccagtcaaataaaagtgttgaataaacagcttattgtatatgttatgaattacctgacttaaaattaggagtcaattagtcaaaatgccatgggctatatgactcattgtaacattaataaagtaaaatatgtcttcctataatccagttattggtattaaataatattgaagctattttccaagcaaaacttccgcataagtttgtttttgtcttggttgagaactggttcttttgagataaagccaccaactcagcacaggtttttttttttttctcctgaatggttttgttcaacttaaaatgactgttcctaacagcaggtgctctcttctttgtttcagattatattgaacatgcttttggtcttcacaaatactgaaaatcaactataaaaatgctggatgaaaagaactatatccatatggtaggaagataaaattttagctctaactcatatcttctctgaagaagattcttcagtaagttcaataactaacattatacattcagtcttttaggaaatccttggatctattttcaaaatatatccagaaacagaaagcagctataacatttgactggatctctcattatgagtaaaataaaatctttaacagctattaatcttatacatgatatgacagccgtgattttacctttcttttttaaaattaattttaacagctttggagatccttcactgagatatccagtgggttcaactgacaaagcaaggcacaatttatcatgtaggaatgtacttcacgggaaattttcttctacatatgttttctcttggttcccagagatgaatccgtaataacaataggattctgctaactttgtttttctgattccagttttcctctttactaattccatggctctttttttggggctcattttttgcccaataaattattcccgcttattgacaggactgatttgggaatttaaggtctgaccatttggtgatatctataagtagattcattgtttatagagacctgttctctgttaggcgagagacaatagagaatctagttgttagtctttatctgtttgtttgcttgccaacactgacctcaaataaattaagaattttgtggccactgggcaagagaacagctctttgatatctggactgtatataactggaataatggttatgcacccaaagccatacatggaatgtcatatttgagaatgatagtcacataaccaccccaagctactaagatgccataagtctttaccccaaatgtgtcagaaatggaagacacttctctcctattagaagaaacaaatacgtttggaaaaaaatatttttggataggataacagagaatatcctctccagagaacagggtagtgaaatatattttgttcacataaactgaattttttttttctttttttgagacgtggtctcgctctgtcacccaggctagagtgcagcggcgtgatcatggcttactgcagcctcagtctcctgggctcaagagatcctcctgcctcagcttcctgagtagctgggaccactatcacacaccatcacacgtggctaatttttatgttatttttattattattttggtagaaacgaggtttcaccatattgcccaggctggtttcaaatgcctaggctcaagtaatccaccagctttggcctcccaagggttggaattttacaggagtgagccaccacaccagcctgaaattttcattaaaaggaacttcccttccaggaagggatgaaggaggacttttagaacactagaaatgacagcccaaagagacagagcccagagcatgggtgagggtgagctgtggtgtcttgaaacctagacacttgttggtggaaccagcttgggaacacaggctaattgggaagtatggaaggaggatgcttcagacacaattgaatttttcagtgttactaggacatctattcctgtgtatgaaccacccgcctgctgtggtttgaatgtttgtgtcccctccaaaactcatgttgacatttattctcaggtgaaacaatattatgagggagggcccttaggaggtgataaagtgccttataaaagggcttgatggggcgagttacccctccatcccttcatgtaaggacacaacctcatcccctctggaggatgcagcaacagggcaccatcttggacacagagagctgccttcactagacactgaacctgctggcaccttggtcttggacttcccagcctccagaagtgtgagaaaaaaatttccatgtttacaaattactcagtctgtgttatttggttataacagcacaaatggacaaagatactggcccttctgcaaaaattcaggtcctcaaaatctttgtgaaggatgtggcttttgttactttgctttgcttaagaagggagagtggtctacaatcacagggttgtttacctgcaagctcctcctgggcctggattcctcattgtgcaactgttgtgttatcttcagtgtccacaccactcaaagacaactttggtttgaatggagcctggcctgggctttttacagaggctgacattgatttggcattctgcagggcaccttgctgacttttgttttctctcttgggatgtatccactgagacaaatgactcatccattctctgaatttagttttctgaggagtctgtcttctttggggcagaaatggggacacattgctcaccacggtctctctcttcctctgacctttgcaggaaagtgctttccctctagtgtgtaaagtccccaaccctatgtccaaattctggattctttactaattggaaactgctattataggattcccatttttttcacttggctctaaattagtatcccagatctttcaggagggtctgaaacttaggggattcgagctcttgctaccccagggcactttccatatgctctaagtggatctataaaacatgggaaggtgccatatccccacagtgtatgctatggggatgaggctgtgagccattagcaaattttctgggtcagtgggcacttcagttgtacaatcatgagcccggctctcagtctgtgcctctgtttagagttttaactaagaagaaagatggtcttcggggtgtgatttccagagatcttggactgccaataatggtacaaagtatttcttggttattacagcccttagactactcaaattgtcattgaatatttgggagattctaagctaattagttctctgtgtgcttaatttattttctggttttgttttatgaggcatgtgggactccatagccttaattataacatatccttggaaccattggtcttttcttttttaactgtttttttctttttttaattttttattattatactttaagttctagggtacatgtgcacaacgtgcaggtttattacatatgtatacatgagccatgttgctgtgctgcacccattaactcgtcatttacgttaggtatgtcttctaatgctatccctcccccttccccccaccccacaacaggccccagtgtgtgacgttccccttcctgtgtccaagtgttctcattgttcaattcccacctatgagtgagaacatgcagtgtttggttttttgtccttgcgatggtttgctgagaatgatggtttccagcttcatccatctccctacaaaggacatgaactcatccttttttatggctgcatagtatttcatggtgtatatgtgccacattttcttaatccagtctatcattgatggacatttgggttggttccaagtctttgctattgtgaatagtgccgcaataaacatacgtgtgcatgtgtgtttatagcagcatgatttatattcctttgagtatatacccattaatgggatggctgggtcaaatggtatttctagttctagatccttgaggaattgccacactgtcttccacaatggttgaactagtttacagtcccaccagcagtgtaaaagtgttcctatttctccacatcctctccagcacctgttgtttcctgactttttaatgatggccattctaactggtgtgagatggtatctcattgtggttttgatttgcatttctctgatggtcagtgatgatgagcattttttcatgtgtctgttggctgcataaatgtcttcttctgagaagtgtctgttcatatcctttgcccactttttgatggggttgtttttttcttataagtttgtttaagttctttgtagattctggatattagcctttgtcagatgagtagattgcaaaatttttctcccattctgtaggttgcctgttcactctgatggtgatttcttttgctttgcagaagctctttagtttaattagatctcatttgtcaattttggcttttgttgcaattgcttttggtgttttagacatgaagtccttgcccatgcctatgtcctgaatggtattgcctaggttttcttctaaggttttttatggttttaggtctaacatttaagtctttaatccatcttgaataaatttttgtataaggtgtaaggaagggatccactttcagctttctacatatggctagcctgttttcccagcaccatttattaaatagggaatcctttccgcatttcttgttttagtcatgtttgtcaaagatcagatggttgtagatgtgtggtattatttctgagggctctgttcggttccattgatctatatctctgttttagtaccagtaccatgctgttttggttactatatccttgtagtattgtttgaagtcaggtagcatgatgcctccagctttgttcttttggcttaggattgtcttggcaatgcgggctcttttttgggaatcattggtccttgaaggcagctctaatttcacctcatagctctgctctctgaagcacgcctctgctatggctggagtcccttgggggcgtgattcccattcttattcctaggttcacgatcagctgttgtgtaacttatagttagctctgggttgcccttttggcccccattttagtcacattctgccgggttccgtcttagttgtagtgtgtgtgaggacacaatatcgactacatgcagagatgtatttaccgtctgccctaacctgatgagtctatgcagggcccttgcaaatatcaaagcaggaccaccttatgccgctagccttgcttactcacaggagaggactagatgccacatttttctcccatgattatctgttttctctcagctcagattttgagtctgcctctgaaacatgggtttctgagtagggaaaggtggcatggtaaaaaggccaggattgagatgttctcttttgacaccatagttttatggattcaaggaccatgagaagtgcatcctacttctgccacttgtgaaagcaaatcaagtgggttttaagatgacagcaagaatgaaaagggagaaaaaaaaagtgggtttgctatacttgtcaagtgcctggatcaaggaaggatcaaggaggctttctgagccccttgattggttaccttttgagcccttccccaatcattccctaggcagaattttctgcatcttctaagtagaattttcctgggtgcttcagtacaatccacttgagatccttgttcctctggcccttcaacatggaagtccatgagagtccatatttgcctttccattgagaggtccctaataatttatctttaggctgcatcagcaagagtccctaggattctgtaggcctggcccctctcttgttctgtgagtccatgttgaaggccgtgtccaagttgcttcctcatctccttgctgaaaacaaatgcttcaggaaagatagagactaggacttaggatgaaaaggtcaagttctcctgaggaagattgggagctggagggatggaggcttccaaagatctctgggcctcagtgggtaaataaagtccagaaaccttttagctatttctgctgcagtgccatttcaggcatagaatttcaggtagggtgagaaactgtacccatttctgggttctagggagggatactctataggcattaatctgagggagagagggttgaaatctggcctctcaggtacctgtgaaccagacagaaaggcagtaattagggcaaagttgcaggaagatgctggtgctgggccttggggtgggaaacaggttgcagctgaggaagcagtaggaattctttagcctgcattagtatttggatggcaatgggctttacattgaataaacaaagggagactctgttggggaacagctaccacagactaagactatcagctacaaagactccctgtgccctcccaggagagttaactttacttacactgcaaatcatgccccaagttcttgagagttgggagatgctatgtacactgcagctgctctggttgcccttcagtgctctagagggactgaggattttgccctgttcatcattaagtaattctgtggaattcagaaaattcagcccataacctgacctgagatgttttggaaatgacctttccttctttttttattttctgaaatctgaaaatccagtttctttatgactcatatcttcaaatgcttattgacatccaggctaaaaaagaaaaagttgccagcttccacatgcagggtgtgcccaggcaggggtctgtgatgtgtgaagagaaaaatgctcttgatgtaaaacacaatgtgaggaggtagggaggaacaagtccttcaccgatgcctgccgctagaaggctgacctggaagttggggtccatgcctgagtaccttcaaacagaagaggctaaccagctgaagaactcagcagatctctctgggatggtactcagtgcaataacaggcacaacagattgagttaacgtggtatatggtagtgctggaatagagagggtcagtgttgtaggatgtcagataaatgaatcagtttgatccatggaatgggctgaaggttgagagagattgataccctgagagaggagtcagccaaggccatattcttctcgcctccatgttgtccctgaaaaacaaaaaaagaatgaggggctggagccccattctgactttcctctctctaagcaagatggcgctcttcattattcatgaaaaatacgatttccatagaactctgtgtccattcctatgttattcattttttttaaagtgactaaaatattttctaatgctctttgtgaaactctaataacgaactttcagtgagtgattctcaggttactctctcgtcagtagccttcagccaaggacggatgccaaattttagacctgtgattaccggaggttatcatctgatctgatgactttagagactcatcattgctcctcaaatcagttgtgacacaaaggcttggaccagtgtctcctcatacaggaaggtgatgatgaacaagtgctgtgagactctgctctcctgcagataccctgtgctttcttaatagtccatttcaaggtcactgaatcagtgtttgggattctaccccagagtcctctgtgagtttatgtgtgagcgttggcaagaagctttctgcccaactctaacctttgccctgctcagtctgttccactagaatgataatgggcaaatatttcctgagacatttcttctcattgatttagtaaaattcaaagaataacagaaatgacaaaagtcaatctaagcagttgggtggatctagggttcccacatctgacttgtgtgtgtgtgtgtgtgtgtctttgtgttttttttttctgaaataatgataaaaaaagaatttttctagaggaagcacaaaaacagaaggaggtgtcctacactatacagggaaaataaaatagataaaatgcttcacaaagttgagctggagctcatccatgggcataaagggtctttaggagctggaaagatttctccttttttttttctttttttgcatcacattacttcctttagaactgggtaccaaacatgaatactctagtctacagttccaggccagcatctcagagctacgggacagtctgcatgggtggtaggtgggagggcagtaaaagatgaagttacaggacccccattctccattcatcctagcagatctcaccatccatcctgagcctattacatttctacagctttctttgggcttgctgttttctaaattcaaccttgcagcatagtgcatacattggtatacagcttaaggtgaggactttatgcacacacacacacacacacacacacacatacacacacacacataaatatatatctcgtacacacacacacaccactaccttagtacaattttctatacagttcacatatattcagatattagctgggctggtctttacgtctgaagttcttgactttcacctcaccagttcaagacccttgaaagtcttgagttttcaaggaatttttctgatttcccagggcttgactctctcagaatctcctctatcctcatctcaagcttactggcataatgtatttttgtttttgtttttatttggttttgaagagatggggtctgtcttgctatgttgcccaggctggcctcgaactcctgggctcaagcgatcctcctgcctcagccttcctagtagctgtgactacaggcacgtggaaccatgcccaacttataatgtgtttttaatgtggcttttttttttttggcattaacccagacatagaactcaactaccagattattctcaagtttacccaaaataatctattttcacaaggaaaccattactgatcagtatagcccctacattaaaggttttataagtgatacaagctggagaaaggtgggagcacaccccgtagtagacaatttaaaagccattcttagtaattgtcctctatgtcccttttgggctgctttgaccagagacctctcaaacctcccttctgtactcatgtggtgccgccactaggttgatccctctcttccatgacacctctagcccgtaaatatttaacttttttttattagctagtcatactgggcaattcaggtcttccaagttcaggccccaactgcctacaactgaactggaaagtgagtgaggttatctatttaacaaaattctatgtatatatatatatatacacacacacacacatacacacacatatatatttattatactttaagttctagggtacatgtgcacaacatgaggtttgttacatatgtatgcatgtgccatgttggtgtgctgcacccattaacttgtcatttacattaggtatatctcctaatgctatgcctcccccctccccccactccacaacaggccccagtgtctgatgttccccttcctgtgtccaagtgttctcattgttcagttcccacctatgagtgagaacatgcggtgtttggttttttgtccttgtgatggtttgctgagaatgatggtttccagcttcatccatctccctacaaaggacatgaactcatccttttttatggctgcatagtattccatggtgtatatgtcccacattttcttaatccagtctatcattgatggacatttgggttggttccaagtctttgctattgtgaatagtgccacagtaaacatacgtgtgcatgtgtctttatagcagcatgatttatattcctttgggtgtatacccattaatgggatggctgggtcaaatggtatttctagttctcgatccttgaggaatcgccacactgtcttccacaatggttgaactagtttacagtcccaccaacagtgtaaaagtgttcctatttctccacatcctctccagcacctgttgtttcctgactttttaatgatctccattgtaactggtggaatgggatctaattaaactaaagagcttctgcacagcaaaagaaactaccatcagagtgaataggcaacctgcagaatgggagaaaatttttgcaatctactcatctgacaaagggctaatattcagaatctacaaagaactcaaacaaatttacaagaaaaaaacaaacaaccccatcaaaaagtgggcaaaggatatgaacagacacttcgcaaaagaagacatttatgcaaaattctacttcttgtgagagcagttggagttatacagagcaatattttgatttgttttgagctacactcatgtttacttgctctgtgaatggcttactgatttttctcttctactttctaactttacaccaaaaccactattagctccccactatttaaaaaaaataaataatgaggtcaaacatttgttgttgtcatgggcgacatggtgtgtactggtgtgggtgtgagagtgtgtatgtgtgttttgctgtgtgatccaggcatataatagacttctaatacagcttcactattaagatgacaactgctgaaattcagtactgccttttgccctctctctgatttccttatttctctcttagtgtatcagccatgggaagacccaatctttcccttacttatgatgcatctttactggagttgacagctcctttctttgcccatattctcctgcaacacaagtttgtccatagttccatcccctgagaaaacttagacttcaagctgtacccccttatctattatctcttcagtacagaatttcattctttttggaaaattccctccacatatcctagcatctatggcattgtcatttgtggactgatctggccctgacttgtcctaaagcctcattactcttctattaaaaaaataccttctaactttgaaggagaaggaaaaaaaaaagccactcctgatagagaacatcagggtgatagaagggactataaaaatggctcatcaactttattcttcaaaagtatcactataatggaagaaaaaaatgctggaaacttttactggttaaaggatactgtagtaaagagatgtgataactaagtgcagtatgtggccatagactggatcttgaagtggaagatgtacagtgttgtaaggcatattactgggtgaattaacaacactgaaacacagccagcagattagataacatttctgtacaaatataatcatgcaccacataatgatgtttctgtcagtaatgcatcacatatgcatgactatggccccataagattataatgcatcacatatgcatgactatggccccataagattataatactgtatttttactgtatcttttctacgtttaaatttgtttagatacacaaataacattgtgttacagttgcccacagtatttgggacagtcacatgctatacaggtttgcagcctaggagcaatatgctatcccatctagcctaggtgtgtagtaggctatatcatttaggtttgtgtaaatacactctataatattcccacaatgataaaattgcttaatgatacatttctcaaaacacatccttgtgaagtgatgtgtgactcttttcagttcaatgaagttagtaactgtactatgggtacataaaaaaatgtccctgtttagaggaaatactgaaatatctagatataaggttcatcatcatgttgtctgtctcaaatgttcagggaaaataattatatgtataattatagaaagtgaatggggccaggcatggtggttcatgcctgtaatcccaggactttgggaggctgaggcaggaggatcacttgagcccaggagtttgagactagcctgggcaacacaaagagatcccatctcttaaaaaaaacaaattagccaggtgtggtggtgtgctcctgtagtcccagctcctcaggaaactgaggcccaaagatcacttgagcctgagaggttgaggctggaggaaaccatgatcgcgccactgcactccagcctgggtgacagagtgagaccccatgtcaacagaaaagaaaggaaagaaatcaaatgggatacagtgttatattaataataaattgttattggttgaattgtgtccttccaaaaaagatattttgaaatcctcaccacccgtccctcagaatatgactttatttgtaaataggattgttgcatgcgtaattaatttacataatgtcatactggagtagggtgggcccccaacccaatatgattggcatcattataaggagagggccacgcaaagattgacaggcaggcaaaatgccatgtgaaaacagaggcagatattggagttatggagctgcaagccaaggaatgccaaagtttgttagcaaaccaccagaagctatgaagaagttttcgtgacaaattttagagggagcatggccctgctcacaccttgatttcagacttctagcctctggaactgtgagacaataaactctgttgttttaagccacccaatttgtagtacttggttgctgcagtcctggaaactatatatatatatttagattgtagtcaccttgctgtgcggtagatctcaaaacctattcttcctccagtctatctgagactttatatcctttgatccccattccctccttccctacacttgcagtctctgggagctatcctactatccttatactctctgcttctgtgagttcaacttttttagattccacgtgtaagtgagatcatacagtatttgttattctatgccgggatcatttcacttagcatgacatcctccagatttatccatgttgtcagaaatgacaggatttcattctttttcatgtctgaatagtattccattgtctacatattccacattttctttatctgttcacccattgatggatacttagcttgattacatattgtagccattgtgaaaaatgcttcaatgaacacgggagtgaagatgttcctttgatgtattgtttcagttcctttggatatataaccagcggtggtatatattcctggataatatggcagttctatttttagtttttcaaggaacctccatattgttttccttaatatttggaaataactgctattctgatgcaatatagaattttgtagcctaagataagacatatgggagggaaattagcatgtgtttctaagtttggttacctacacaggaagagaaatattcaacacctttacatgtttggcacttgttctgattccagaatatcggtaagcccaccactgacaagtgtcactctgggaatcacatggctattctattcctggaggtttgccatcaaaaacaaaggagcttggcttcctaatattttaagagaaaatattccgtgacacttagttacctagtttggcttgaagcagcctaaagcatcttctaaatgaacttatttctggagatggaattacattcttggcaggaaataaaagaagtcaactttctctgtgaattttcagtaaggattgtggcattaccttatatattgttaagcttttgataaatactcacatgtttgtctgatccatttttgagtataaacttctggaaaaaatctagagatgatatagaaataaataaacttctgcaggtcctataacccatggtatctatgcttaatgaaaattcagaagaccctaatttatacaaagctgttatgtcatctcctaattatattctgtaaagggaacaggctggaattgatgtctctttgctgtttttcagatactctgacttttttgtgttatttggaaaggactgatatgaggtatgtgtgtgaagtgctgattgtggagagaattttcaaaagtggtgtgagagtgtttgttgacatggccaactttatatttttacttttctgtgaaccctactgtgaatcctggcttctatcatggactttaaaatcttttacttaaagtataatctgagaacatatttgttcttttattcattggttggttggttcaatagactctttgtgcatttgttcaatccttcattttatcatttcttcatcacttaattatacggccaatacagaaagtatttattgagcatctactatagtgctagtcatgtaacctctgatttattttccacaatttttgttggtaccattcattcatcattcaacagttactagtacgtaccctataccaagcataaagaaatatagacaagggatcttgctggaaggccgttggctttgttgactggggtgtgttatgtgtgaatcactcctatcttgtttatgctctaagcagtgatccatttctatcctatgaaaaagaaatgcctgggccgggcacggtggctcgctcctgtaatcccagcactttggaaggccgaggtgggcagatcttatgaggtcggaagttcgagaccagcctgaccaacatggagaaacctcgtctctactaaaaatacaaaattagccaggcatggtggtgcatgcctgtaatcccagctactcaggaaggctaaggcaggagaatcgcttgaacccaggaggcagaggttacggtgagccgagatcatgccactgcagtccagcttgggcaacaagagcgaaactcggtctcaccagaaaaaaaaaaaaaaaaaaaagaagaagaagaaatgcctggactcagaactatttcattagcaaatcaaggaagaaactttcttgaagttatagcgactattaaggaacctttacaatttggcatcacttccctagttctctcttctccatactggccctgggcctctactgctctttctagctttctgcggatgctctgtttacctggattcatcctgtgtatgtagtggagggtgatggcacacttttaaactgcaaaagctgtcattttcttttcattctttcttgatttgctagccggaattaattgatatacatttatgaaagaagaagcaggaaagaatccgtatgaattattctgcatttacaatttattgagtacatatcatgtgccaggatcatagttcagtgccttaatgcactacatttctggtaatctgcaatataatcctgtggggataggagttgcttttttcattttataaatgggaagatggagactcataggctttgtcagtcttccatgttaaaatatctcatcaatggtcagatctggatttgaatttcatgttttctggcataaattttctgctttcagctgtatcctaaataaaaaataccagtcttgtgaaaaaatgagagatgatggatatagatacatactttttaaactagagaattctgtccaggcacggtggctcatgcctgtaataacagcactttaggaggctgaggcagttggatcacttgaggtcaggagttcaagaccaatctggccaacaggtgaaaccccgtctctattaaaaatacaaaaattagccaggagtggtgttgcatgcctgtaatctcagctacttgtgaggctgaggcaggagaatcgcttgaacccaggaggcagaggttgcagtgggctgagatcacaccactgcactcccacctgggcaacagaggaacagaggcaacagacactctctctggaaaaaaaaaaaaaaggagagaattttggcaatgtagaattctcttgacgggaacagtatagcagatatttcagtttcagcacatggggttcctgattagtgacaaattcatattgaaccataaatctgtaatactgtcatacaaggagtaaaatgtagttgtcttcttgctaatgctccttggaaagtttcagtcttttcctattaacttggttgctctcagttttattaccatttgaaatatatatcttctcatatcacagcaaaaaataatgactttggatgatgagtcgttttaatgtttgaacagaattacacatagaattcaaactgttgtcagctttcaagtttgtattatgctgtttcctagcaggtacatgcagactgaaagtatttgtatcatgatgatttttactaactttacagtaattttacttatgactttacttatggttgtgaaatcatacagagatatgttatatcagaatgtcaaaatgcttgttttaattaagatcccagaaaatatttatttccaaatatccaaatttataaataactttggagctctgaattagcataaaatcagtcaagaagaaaaagagagtataaaaaaataaaatatatttcctcctctcccttccccatcatcagggactttcatagaatatactcgagacttaatctgcttcattttgaatttcattttcaaagctatttctttttcaggctgcccattacactttatttgaaaaccagctcttatcatttagtcattattgtcacagatcccaagttcttaaattatgctcatcacaaaagatactagttttatgttctcatcccattcaggggctattccaatataccagccgagggccacattggtgacattcagcacagatgacagcttttgttctgagcaggcacacaaagaaatgactggggaagccgaatcatcgtttcactaaggcaaggaagaagtgtctttctgggtcatgcagcccatggccaagagatgtcagaatacctacagcaaacatataagcagtataattagctcattgtctctagctgggaggaattccccctcacttggcattattaatccagacctcctaaaggccaaagtgttgatagcctgcagtttgctgaaatacatattgaactatgcattcttcaaaatgcagctttagctaacctcctgcatgaaggattctgtgactccaccctctacttccttcttcccagttgtattatgttcctaccactattctggcatttctcacgtgtacttttaaagtgtgtgtgtgtctctgtgtgtgtgtgtgactctctttttgattgtgagtttttctactgcagagatccctccgtaccttctctccccctgtccctaccatatttttattataaatatttttatagattgatagctttgaaatgattggattttagcagtataatagaatgaaacacctggattctgcttctgactccatgagtacagggagtcattgaataatgattcgttattatttaatgcttttatttaacatgtgctaattgagtgcctcctatgtgccaaactgttctggtgctgggaatatagtgatgaacaaaatagtcaaaatatagacaagacaccgctgttctcctagagtgtgcatttctgtgaagaagacagacagtaaataacatagcatgtaaataatcaagacaaacacccaatacatggtatgcagagaattaaaacaggaaatgtgtaagttgttactttaggttaggtagttggtgtagctgagatctgaagaaaccaccaatgaaggttaaggacgttcttaacagagggaataacttgtgtagagactccaaagtggcaatgaacttgtcatattctaagcatatgaaggtcattgtgatgagtatgttggatgaagatgagctatcagagaaataaaaaagatgagtggtttggattttattcttgatgcaatgggacagcattggagactttaagctgcacaaggttatgatttagtttattttaaaaacattacccctgcagtatgtaaagaatggattcacgaggataaagagatggtagggatcctccgtaggaagttattactgtagcccaagcaagagatgattcattgttctatgtggtggtagtagagatggagatgggtggatagattttgagatatgtttgagatagagttaaagatgtgctgatggtttggagaagttaagtaaggggagaaatcaaagtcttagtaaactttggtaagtcacttaaatatttctagtaacaggcccttcataaaatggggattacagataaatcactggttcccaactgagagcaactttgctcctctctgtttcctcccgggacatttggcaatttctggaggcatttttagttgtttatgtgtgttgagggggaggggttctattactaacattggtaagtacaacccagggtccaaaacatcttacaatgtacaggaccaccccttcaacaaagaatgatctagcccaaaggtcaatagtgccaaggttgagaaaccctgaaatagcaccttacaaggtggttgtgaggaccagctaaattaatatattttaaagcaggatgaaagttttaaatgctctgcagagacaaagtgttattgatgcctcaattttacagtgtctgttggggtaaagataattcattcttgtagttccaaagaatctcttctctcctggtcctgaatgaatgtggtgcattttgaatgtgatactttgggccatagcccccttatgcttcagtagagaagcagagaagaattgaaaatttgggcttcaagaatttttttgactccactacagccataatttaaaattttgtggtagaaagtctggttataaaattcactagaaatgagttttaaagtaaacttatttttaaaaggaagtagtgggtgggtgaatgtgagactttagggggattgtgccaccttttttccctgagaaatgccaagggaactaattaaagaagctgaagggagagcaaaggcacgaatagagtagcctattctccattccttctgtgtcaaacaccccacgctacactctacactaagctcttgttagtaacctcccacaggacagggcatttgccctccagaaagttggaccttaaaatgagggaaacaagtaactcttacctgtaattagcttcaagaatactccctcaaatgaaagagaagttaaaaaaactgcctcaatgagttcttaattgggtacaagataatgttggtagaagtttaaaatatttaaccagcagtaaatattcaaggcagtcatttgaagtaatcaatagctaggtgaatgcatacattagctggcagagaatcacttaatcaacagttcaaataaacaagaggagaattcaaaatgcagatctgaaaatacagagaattagcaaagatgctaattacatccaggtaccttcttcctccagtgactacttaaacatttgccaaagtattgctaaaaataaccagttctgaaaagattcatttcttttcagaagagctgcttacttagagagtgattgatggccaggtccagcaggcagctagaagtacccaaaaatgaagtgctagtaggtgacctcacaataaaaagccttgagaatccttcagctggcatgcgctgctggcaaaaaaggatatttttttaaatttttatttttagtctttaccacttaaaattttcagacttttctccccgcttcagatattatatgatagattttatcagatagacagtgagccatttatgataatatacagaaactgacataatgcatgatttggttcatttaaaaaaatcttacttatcttcttttcccaatccttctcaaactcgtctacacttcccacatataaaataaaatatattaaaaaggcttaaatcttacacaggaggctatttttagtatctccaactagaagactgaagctcttaactcatctactagagtcacttgttagaaggagactttcctacaggcatttttattttgctttttgaaggaattatgacaccccctccccaccaccaaagaattgctgtttctacctctagcttcagtagccattaagcagttcttcattttgaaggatacatatagatccagaaacattttctggttggagaaaaagtgtgtattttcaaggttccctatctttaaggttcctagttcttattaaagtagcaggataatcagcttaatgggtggttgcttacgctttctgtgggaaaaccatgggggtgggagttacaagtatttgttctaatttcagcctcattactaactagctgtgtagacttgggcaagtcatttaccttgaatttcagcttagaggcaggattgttaaaataggatcaatttgtaactggatttgaaacctgatcagactattagaaccctactcaagacttaattactgagtctaggtgtttccaaagtctcaaggtgatggattcttttacagccagtgtttgtgcatcactgataattcattcccttcactttgcagcactgataattcattcccttccatttgcagactatagaaatttaagtttcagagaagcttagtaatttacttaaggtcacatagctagataataatgaaacttgaactttaaatgtaacttactgacccccaagatattgctgtttccctattattaggtgcttatttaaccggagaattgccatgtgttttttgtaacaattacattttttttttctttttgagatggtgtcttactctgtcacccaggctggagtgcagtggcgtcatctcagctcactgcaacctccacctcccaagttcgagattctcctggcttagcctcccaagtagctgggagtacaggtgcatgccaccaagcctggctaattattttttttttttttgcatttttagtggagatggggtttcaccatgttggccaggctggttttgaactcctgacctcaagttgtctgcccgcctcagcctccgaaagtgctgggattacaggcgtgagtctctctgcctggccacaattacaatttaatattaaaatatatacatatgtgtatttctatacatgtgtgttgacttttacacagtatttaacattttcaggtgtgtaaaatgaaagcattaggactaaatgatcacatagtgactatttggctcttttagagagaatgtgaatcactacctaccatttcactgatgcacactgtttaaaagatactatgctaggtgttacagttagaccctgagaaatggggtgctactatgatgttgttatgatagccatgcatgtgaataatatccagattctgcttggcccagatacctctccttcctatcatatttctgggagaaatagatgcttaaaaagggaaaagaaagcaaagtagagcatgttatatatacctgggtctttggccaaggtacaacagtataatgtcatgggccatgagaaaggctctattttctctaagttaattagagaaaatgtacctgctccagtacgttcctgaatagatgtatccttatacctttgtagagggagcaggcactaagtcagctcactactccaattcatcatattgggaaagaaaaaagagaaaaagctagaacatatccaggtacattggccttctgacctccttgaaagcacaactcctaagaggtgtggcccaactaatgctgtatgattgtccaaaccagatcaataacactccttttggtagaagccagtaaacagaatgttgagtataacctgtttatacagatgagaaatctgacacataagttcaaattacaggcctaaagttgcttactgcatatttcttcccttttctttcatagcttcatatatgtgtatatatgaatatgagtggtatgagtgtatttcaaacatacatatatattccaaagattatcatgtaaatgtcataaacaattgtaacatttaaattcttaaatttaatagtaagatatgttttataacatgtatctgagtttttatattcattcattgttatattccatcaggagtcatgtgaatacttaaaaatgcagagcaggtaacttttaagatctttgattatacactttaataaataggttcagtaaaattcacatttcttgacatattcattactcagcaagaattgcatacatctttttaattattcccaaacattcaataccttcaactcttaacaatgaattaattcctttgaagttattatacacatttaataaaattatatgtaactacgcagaaaaataatataagcttctcttttgatcctaaaagtagctaattcaactgtttctttctgcagttgtaggaattgttcacagattcttcttgaagttttgcacttttgtgtatctctacttgttttattggttaagcaaagtaaaacttctgaatggcttttgaaactgtacacaaaactcataaacacaacctttaaacaactattgttaaagtaagaaaaaaacaattaacttataaatctttttcctcttttcagatgtaggtcacaaaggagaaatgctcctctgttaatttttgtttttttttaaaagaactgttggttttaaacttctttttagcctactcactattctcaaaggatgcaaggcccccccatgggataaagtcagctttgtcagaggaatatcagcatgtcagctcctgaagaaccacttggagtttgaatagtaacttattgagtggataattgagaaagctgagttaggacaggatttctggccctaataacatatgaatgtctcataattatcagtacagaatcctatgaaatctaatgcttactttgaaacatatttatttaatttatatgtaagtatttatttatttgtactagacagatacaggttgggaattacttaggttttgcttaataaaatagttacttttttcaaaaacatgaattatcttttttctttttggtgagaagaggtcatgtaaacaccaattgtctagcaagatttttgtattgctttttattagggactgttggttttaaattgctttttagcttactcatcatacttttaaatacatggatagttttctgccatatccaagatatttttaataataaaaagtttttttatttctaaatatcaatattattatgatttttttccaccagtgaaaaaatacagtgataatgcagggaagtataattactaatttattttgtaatataattataaaatatatgtaatataattataatatacttaatattttgtaatgtaattacaaaattaaacctaattttatacttctttgaatattttgggagtcaggtggtttttctctaactcaaacttctaccagagacttgggatcccatgaactgtagggacttctgtattcctggaactggtttgggcctcaaataaaacctgctcaagttctcactcaatcgtaagctcccaaagggcagagatgatgtctctctgattttcaagggactaacccagtgacaggcacagaatggccatttagtaatgaatgacaagggtgctcatgcaattttaaaacatagtccctcagcttttctgcctttgagtccaataagcatactagaaacccagaacgaagctagtaatatttgttccagtaaagtgacatgtatatggttttcaaaaaaacagctgtttgttttttttagaagcataagattattaaataaacttctgtaatgagtggataaaatggtgtatcctatgaaaacaaccaaagaatcactgaatcagcagttctgaaagataaaagtctcattttgaggaaatgcaaaacaactgaatgcattttattactttgcatttaaagtaggaaggtggcaaatactcggaagggtattccagttctgtttctttgtaggcagttatttttactgacaggtgagagtgtttcacctttatttgttttatagatacaagctcttacaatgttctttttccttccatggaccttctcctcttctatttcttaccaagtaaattattgaaacaaggctattttgaggtaaaacgaggaagagaagtaatacctcactgcaacctctttccaaacaatagggaaacatcaaagttagggtcaaagctaatactgtcaacttataaaagagctcactcatcatgtctaactttctttgacagtatctacaaaggcttctgtatctagggatgattttattgtcaatatgcaatcaggcaggtcaatgttcatttcatttgtgaagaaaactacatcaagcaaatttcattataaaacctaaaatcaatatacatttgtgtcagtgttctctaaataatgaatgtgaatactccttcaccctgaaataacatttttaaggattggatttttctgaaaaaaataagaagacatatttggtttttctttgaacaatatttgcacttgattctaagacagtgataccaggaatgacttttggagtcggttttgttttaaatatgtttattgatcaattatggcccctatacaagttgagactgactcgagtaatgaaatattcagacctatcaactggtaatattagaatagtgataataagcatagctagtatttgcttagtatgcattatttatggatactgtgaaggaattttctttcatttttcacatttagtctttgtaaactgccttaatatagaaatacaatacagggatacctcatccgattgcagtttgcattactgcacttcgcagatactgcttttttttttttttttaaagaattttaaggtttgtggcaactctgagttgagcaaggctattagtgacatttttccaacagcatatgctcactttgtgtctctttgtaacattttggtaattctctcaatatttcagactttcttcttattattatattgttacagtgatttatgatcagtgagctttcatgttactattgtaaatttggggggtgtcatgaaccaaactcataaaagatggtgaacttaattgataagtgtagagtgtgttctgactactgcagctaccagccgttcctagtctctctgtctctcttaggacctccctattctctgagacacaataatattgaaattaggccgattaataaccctccaatggccttgaagtgttcaagtgaaaggaagagtcatacatctctcactttaaatcaaaagctagaaatgattaagcttagtgaggaaggcatgtcgaaagctgagagtaggccaaaaaggtaggtctctggcatcaaacagctaagtcgtgaaaacaagggaaaagttcttattgaaaattacaagtgaacagacaaatgataagaaagtgaaatagccttagtgatgagatggagaaagtttcagtggtctggatagaaggtcaaaccaaccacaacgttcccttaaagacctaaccctaatccagagccaggaacgaagtgtctaaaattatgtgaagatagagaggtaaggaaactgcaaaaagaaacatttgaagctagcagaggttggttcagaagtttaaagaaaccagcaagtgtgatgtagaagctgcagaaatttatgcagaagctctagttaagatcattgaaggtagctacaccaaagaagagattttcagtgtagatgaagcatccttctattggaagaaaatgccatgtagggttttcatagttacagaggagaagtcattgcctggattcagagcctcaaaggacaggctgactctcttgttaggagctaatgtaactggtgactttaagttgaggccaatgctcattgaccattctaaaaatcctaggaattattttcaaaatattactgctcatccacaatgcacttggtcacctaagagctctgatggagatagacaagattgatattatctccttgcctgttaacataatatcctttctgcagttcattgatcaaggagtaattctgactttcagctctaattatttaagatatatacttcataaggctatcagtaccatagatagtgattcctctgatggatttgggcaaagtaaatttcaaaccttctgggaagaattcaccattttctatgccataaagaacatttttgcgaatcaaaggaggagcccaaaacagcaacattaccagaagtttggaagaagtttattctgaccgtcgtggatgacttacagaggttcaagatttcagtgcaggaagttaactgctaatgtggttgaaagagcaagagaactggaattagaaacagagcctgaagatgggactgaaattgttgcaatctcatgataaagttgaaatggataaggagttggttctgatggatgagcaaacaaagtgattttctgagatgaaatctactcctggtgaagatactgtgaacattgttgacataacaacacaggatttagaatattatgtaactaggtgataaaggagcaatagagtttgagagaattgactgcattttgaattgactgcatttctgctgtgggtcaaatgctttcaaacagcaccacatgctacagagaaatctttctcgaaaggaagggtctatctatgcagcaaacattgttgtcttattttcagaaatggccacagtgaccccaaacctttagcaaacaccaccctgattagtcagcagccataatactgagacaagaccctctaccagcaacaaagattacaactcactgaaggctcagatgattgttagcattttttagcaataaagtatgtttaaatgaaatatgtacattgttttttagacatactgctaaaaaacaatgcacaccagatagcctacagtgtagtgtaaatgtgacttatacacacggggaaaccaaaaactttgtgtgcctcactttattgtgatattgttctgttgatctggaatcaaattcacaataattctgaagtgtattcctgtagcctgggtaggctaaatgctataagcaatagccccccaaatctcagtgtattaacacaatagatgttttaatatcgcctagcagctgaatacaaatgtatccttctatttgtggcccactattttacagagcctctgagtcctctgctatgttcctgtcaatctcacacaagaggagagagagaaggtgaggatagcacagatcttttacatgagtgggcactgggagaggcacctatctcttcatccacattccctttgggaaaacccatcatttggttacatctaactgctaaggagcttgggaaatataatcaagttggctgatcaagtagctatcctctcccataggtagtgttatacccctttatagatgatgaaactaagacttaaagttcaaacagtattccataccatcagcatcatctacgtgtataatggtaacactgagtctccctagtaacaaaaaaggtccctgttttttaagcactgtggtctccttcaaccctgtgctgggtagtttgccacttactatgatttaccctggaaacaaatggtatcttcccattgaaaaggctagctggggagatgcacagctgagattttgactttatgttttattcagggtccaacgcttgattttgtagtagctctattgataaagctaaaatttaataacagaagtaataagtacaacttctggggaaaattttaagaatcagttggcaattcctgtgctccttctttcctcctattatgaaacaggcagtgttctaaataaagctattctgtcaaactgggtccgtattgactttgataagcaagtgctctctgtgggcccatattggatgtgtaatatgagtaaaaaactttccataagtccccgagagctttatttttattttattttgtactggtattattatcaaagcatagcctagcctttcctggctgatacacactttagcctagaatctctactttcagtgtcttacaaaactatttaccaaggtgtgtaagatatgtatgtccctgtatctatttgtctatccaatgttgttcaccagagtcttgtttaataagttatggttgagagaattatgcttgtccatacaatggaatatgtgaagctgattttaaaaaatgatatgatagatctgtatttacctacatgaaaagatgaccacaagccatgattacatggaaaatacataaaagtatatgcatgatatttcacagagtaaataaaaacttattattattgtaggagaatagacttcccaggaccctgaggagctggaggaggtgacagcacgctgcaccattcccaatgtagtccaaggttccggcataccattgtctgcctaaatcaccaagttagcttccttaatggtctccttaccttcagtcttggccccctccagtacattttccacacaatgtagccagtgtaatctttataacagatgattcacctattaaaaaattggggattatctccattgatagcatgtaaaaatccatgtcttagccttgggttcctaaaaaacagaggctaagacaaaacttaaatgttaaacctttcctgggatttacagtccaatgcagcaagagtgagagtctcaactttgcttcactcttctctatggtaagactcatctgtctcctagttgcccactttgtttcacggctttcttgacatcttttgtctttttgaatctgcccatttccttcaatacatcaaaaggtctttggaagcaaaggcgttttgttattaactgttgtatcttcagaaataaaatcatagaagaaaaacaaatcatgatgttttcaactaatgtttgtcaaacaattatgtttagcccataaaacaattttcctgataattgggttttcagagaattcttgaatcacgcagtgtgtattaggccatttttgcattgctgtcaagaaatacctgaaactgggtaatttgtaagaaaagaggtttaattggctcacagttctgcaagctgtacaggtggcatggtaccagcatctgctcctggagaggcctcaggaagcttttacttatggcagagggcaaagtaggagcaggcacatcatatgtcaaaagcagaagcaagagagagtgtggcgggggttgggcgccacacacttttaaatgaccagatctcgtgaaaactcactatcacaaagacaacagcaagccatgagggatccacccccatgatccaaacaccccaccaggccccatctccagcactggggattacaattcaacatgagatttgggtgaggacagaaatctaaactatatggcagcatctgttgctttagttctgcctttttctgtaggttcagagcaaacttttcctaccgtatgcgttgtgtagttttatgtcactctatgccccacattgattttcttcccttatcaatagaaaactatgtgtacgttttcctacatggattataataaaccccttttaaaaaattttcatatataaggcattctaaaacctgtatgataacacagatttgtctgtaccaactactaatgaggaatttaaaggaaaaatttagtgaattcctcacattgaatttaaatttttattttttttcttggttgttagtttaaaattttgaaatctcagtctgtagcattcttccacatggccagccgtgacgtgactcatgagtcaccaacccatttagtcagtcaaattatttaacaagcatttaccaagtattctgtatgagcagacttatggataggctaaggccaactctctgacatatactgtatagggtatgtttttaaaattttccctacattaatttctgttgtcatttttgcatttagctcagtacagatattctgattctgatgctttaaaactgttcctttctctttctttttttccttttgagatggggtcttgctctattgcccagacgggagtgcagtggcacaatcacagctcactgtaaccgcaaactcctgggctcaagcaatccttctacctcagtccagaatagctgggattacagatgtgtgccaccatacctggctatttttttttgtattttttgtagagatggggtctcactatgttgaccaggctgatctcaaactcctaacctcaagtaatcctcctgtctcagcctcccaaagtgctgtgattacaggcatgagacaccacatcagacctcctcatcatgttgaaactcttcttgaatggacttaaaatgcttctgtattagtctgttctcttgttgccaataaagacatacgcaagactgggtaactgacaaaggaaagaggtttgattaactcacagttccacatggctggagagacctcacaatcgtggcaggaggcaaatgaggagcaaagtcatgtcttacatgacaccgggcaagagggtttgtgcaggggatctcctatttataaaaccatcagatctcatgagacttactaccacaaaaacagtatgaaggaaaccaaccccatgatgcagtgatctctacctggccctgcccttggcacatgaggcttattacaattcaaggtgagatttggatagggacacagccaaaccgtatcagctacctaccaatttttaaataaactttaatttagtttaaaatagtgttttttcaattgttgcatatttgaattgactgaggactttaaaaaatggcagtgacatatccctgctcttagagattctgatttaatttatctgagatgagaaccaaagatattttctaaattcaccttgtgcaattcccatatatagcttgggttgagatttttgactgaaaataatatttcccaaaatgtgatccacagatcattggagatttttatgaatctttgagctcatcagagcgctcatgatattaatgtggatttttttcctgaaatgaaataatgaatttttcatttttaaacctcctaagtatcttctcagaatgggcatcaatctcataaatgctgtggtttgtttggtgttagttagcaagttaggaatctggttcactgaatgaaattactgttttaaagtatcagaaaggacacactgagaatgttggagttgagagttttagtcaagcacatttaatttatggatgaggaagttgaggccagagaaatgagatgttttgtctaacttcacatagctggtctgttcaacactacggagaatctggggctcgtaactttcagtccaatattctttctgctttatttaccccttgcctccctggagccttgtcataggcttcaggcttcacttgttccctctgagccatgtcctaaaaattccaccatttgttattttaatcccaatgctaaattctaattaccattcagtgaattactgtacagtaagcagatgtgtgttattttctaggggaaataaaaagctggaatgtgatctacacctgtaccttcagcagtgtttctccaccaagaagtagcaatcagcattaatatataaactcaagttgccagagtctcaaatgtagcatatgcagagtgcagggtaagggtttctcttgccaacagataaaatgcactccaggctcccattggtgttcgcaaatgccagtcaccaaaagtcagctttccccctgaaaagcaagttttgtttttgcacaattaaatggtaccttggtgaaatgagatagagcctttctcataggaagtgatttttctgggagcataaagtaacaaaatgaatctgttgtggatgtgtttttgttgttgttgttttcttatattgcacacaactttttaaaatgacagaagttggaatgaggttggcaacaaaccacgatgggctcattggcatgctatagcccttattgtgttcagaaattaggatagaaaatgcttggaggcttatttcgtactgtgattcattgcatcatgtcatctagtggagtattatgtttgtttcattctaatttcatggtgataaattctgtacttttcccacctgggcttaacctaagtggtctccatgattgggaggagggaatgattttttaaatgtatatttgctcaagatttgctcctggatctcctgaagataaggtgagtaatgtggtgaaagtacttcctctcctgagtatggaaatctggttcagtggtagcttaaggggatacacacttcaattgaagtctgaagcctgcatatttctacatcctcaaacaggttagcacttcggagcagtggggggtttgtctctcaatttagacacctgatgagtagattatagtgaccagtttcaaatatgtcttcatggtagtcatccatgatcagacaaatgatcagatttccgtgtatttaatattgagtttttataaatgtctgtcattttcttttcttgaaaggggtgatgtccatgcctccatctttcttttacctttcaaaaattagtgatggtagcaaaacagacagtttctcagattgaaggagaggaaaattatgcatgactgaattttgacattatgagttgacatcacagcatacatcctcctaaagtacaatttgacaacaaaaaaatcacaaggtcagaaagaaaatcatagagcccatccactcaatctcttgaaatcaatcataatgatcaagtgaaaaccatcaaacccttaggtaggatagcatatctgtgaggagagtgttaggctgcatcccagtaggtacattaaaaaaaatctcagtgagtatactctttagcattgttaaatataatctgatattcttatttaatagtgattcagaatattggaggtcactcaaaaagagaaagttttgcaaagaagaaaatactctttcgggattttaatttttaaaactaaattataaatattcaaaacataatgtacagaagttgataccaattcatatccatgtattcacagcctttgaaaaaatgggattatcttgctttaggttcagtttagttacagacgcaattgaattcttaaactacagatacaaacatatcctttctcacctctatctcttcttttctgcctcttcagatgtattaaatattccaaagtgaatgtttccttcttattcatgagtttatacttttgttacaaattcatttatcaaaaaatgtatagtatttggtggtgttaacatatatttaaatgacatgctataatacaatatccttggctgctggcctgcttccccctgtatttgatatgatcaacatggattctagttcatttattttaaatgcagtgtaacactattttctgactgcaccatgatgtatttacctgttcttgtactactgggcatttaagcttctttttgggaaaccacagcagtgagtttttcctggtatatacagcctcctgatataaacatttctctagggcatattcccacagatgttgaatcactgggttgtagggtacgtgtgtcaactttactagtattgccaaattgttttctgaaatggttgttctaatttatattcctaccaacagtgttaagagttcccttaggctgggcgcagtggttcacgcctgtaatcccagcactttgggaggccgaggcacgtggatcatgaggtcaggagatcgagaccatgctggctaacagggtgaaaccccgtctctactaaaaatacaaaaaattagcccaggcgtggtggcatgcgcctgtagtcccagttacttgggagattgaggcaggagaatcacttgaacccaggatttagaggttgcagtgagccgagactgtgccactgcactccagcctgtgtgaacagagtgagcctctgtctcaaaaaaaaaaaaaaaaaaaaaaaagagttcccttaaacttctacacttttggtgggagtgtaaattagttcaaccattgtgaaaagcagtatggcaattcctcaaagaactaaaagcagaactaccatttgatccagcaatcccattactgagtatatgcccaaggaatataaatcattctaccataaagacacatgcacacgaatgttcactgcagcactcttcacaatagcaaagacatggaatcagcctaaatgcccatcaatgatagattggataaagaaaatgtggaacatatacaccacgaaacactatgcagccataaaaaaggatgagattatgtcttttgtggcatcatggatggagctggaggctattatcatcagcaaatgaacactagaacagaaaaccaaataccacatgttttcacttataagtgggagctaaatgatgagaacttatgaacacagatgtggaaacaacagacacttgaggtctacttgagggtggagggtgggaggagggagagcagaaaagataactattaggtactgggcttaattcctgggtgatgaaataatctctacaacaaactcccgtgacatgagtttacctatgtaacaaaccttcacatgtaccccgaacctaaaataaaagttaaacaaaaaaagaatgcaaaacaaacatgaatcaacacctagaatgagtaattacatgagcatgttaacaatattaatattttgttaatgaaactaagggtggtggatttcaacccccaaattttcatagtgtgtgttacttttataatggaaaatgtcccaataaactatttttaaacctaaaaaaaggagttcccttaatttgcttatagttgatgttatgccctggctggttccagtctgcatacccctcctcactccatagttacggcctcttgaaaagtcttgcggtctcagtcttatcaacttttcttgaacagatattgccctttcttagcaggtttgatggagctgcaatccactaccctttagctcattggtgggttgtgcctgctgcaagtttgggttttattttatgacttcaaataactagacttctcttttatattaaaagctcttggccccacattctgaaaagtagatctttctactctatctcagctgttgctttaggatcctacatgaaatgtaggatgagactttatctgacttaaagtttctctcccaaggattgaaattcagcctctgaaattcagtctgcttcccgggactttgattgatgctcctgggcttttctgtgacatgagtcttcctcctcatgcttcaacaaccctctcttgtctgcttttggacttctgtctctatttctagaaggttgtcctttatttgttaccatacttgcaagcagtgtgttttctgactgggctccctgtcttgtcgcctttctgacctcgagggctggtctagttccaggatgagttaatcttgttcctctatggattctgccattgatgccattaaagaacaagatttattgctgtcacctccagaagtgatttcatgctgtttgaaacaatcttgtgcaaagtgttgtcaattaaaacaaaaccaaacaaaactgtttcctttttgagtaatctttgaaaatcataatcactttcaggagtacaagatattccaatgtcttctccatagatgtgactaatattcacattctggtggccaagctgcaaatgactgtctttggctcaaatatccagagaatatcgcaaaaccaaaggcctgagaaaagcattataaagagagagagaaaaaaatctctttaacaagggatttctgaagtaatatgtgttcattttagaaaatttggaaaaatacagcaatgcaaaaagagaatcatagatgaccttagaacaactattaactttttgcaccagttgagatataaacatacccacgagtatattagtttaataaatgtctgagtgcctacctagatgctaggagtaaaaagagagtgataaataaatcaaacgtagatctaccacttagggagtttaaagtctatcagagggagtcaagtaacagataaataacgaaatttgtgaaaaattggaaggctggtatttctgacaaaaaatcatttcctctgagtttcacaggatgagaaaaacaggcacgtgaagatcaagggggagagtgcttcagggaaagggaaatgcatgtgaagaatgtatacaggcatgagagaggttttattgcctaaatttaggaagagacaataacggctttttatggtggagtcaaagggagctaagaatgtatacactgttaaaatgtgcaatctaattttaatgtacaagtagtaacagatgaattaaaaattaaaaagatgtactttagaataaaataataggatatatttttattttttatgaaattgcaaacatgtatatactattttaccactttcttttaaagcataagtctagctaggcatggtggcatgtacctgtagtcccagctactcgggaggctgaaggaagaggatccctcgagcctgggagttcaaggatgtggtgtgctgtgagcgcacctgtgaatagtcaccacatgccatccaacctgggcaatatagtgagaatccatatattaaaaaataaaaaaaagttttttgacacatagccaagtctaaacatgtagaaatttacagattggcttaaatatttgtgataactataaaaattccacatctccagctgtctatatgttattcttacacacgtatgtagtactaaaccaaagggatctttttccctgatacaaatgtggagtaaaagtttacatacagcaaagaaggattgattccagcctacaattctactccctagaatttttctatcatgaatgaagcccttccatttttcatcacgataggagtggtttatcagattttcctagagcaattccaattttgcttatcagttaggactaaaatgtgtcatcttcctttctatatttaggaactgtaggaagctgtgctatggcatgtgagatgtgaggagcatctgttagagagaatgccggagctgaaggtgtgagaggtttcaagaaacgataagctttgggctcagcttccccctaggattacaaagggcttgcacatattagagagctaatttttagcatatttccatgaaggcagattttatcttccataaatgcttagattcatagaaatggtgagttggctcaatgctgatccttttatgtctagcttgatgtttacagtaactctggaggtagagggttagtgatttatattttaaccagttccttgtttaacacaatcatcttatcttggctattgcttaacactttttttagggctccaaagaaatacatacatatgtataaaattgttttggatttttgtgtcccagtgttacagaaaatttctagaaatatgcatgaaccagtcagatattctctaagtgagtttaattttatttctttgacttacattttatttctattagtatacctttcagtgttacagaaaggcagatctaccatttgtgttacgttggatttttcaggccattgcatccttttcctgtttattatgttgaggccccctcagttatccactgaactgattaccaaacaacctctcctagagttttggtgttatctctacctgttttttcaaccacgttctcttgaaagaatctttaatttaggctcatatctacaataaaatataataaaataatggctttatttttgttttaattatgacaaggtaatttatgcctgatttgtttatttacttagaactcataatagttattcacatttcagcctgatttaagcattattttttatggttgttttgagatggatcttaaaccatcaaatgttcccagcaaaagatggcatttttttcagaaatatagacattaaacttaatgaaacttactttgccaaattcataccatgcttctatttatttccctatgataaataccttcttacatctcatttgtttcagattatctttctacttcctattacccaagaaaatattgtttttttgcttgttcaggtcaaatgtttaaatcaattgatcaatatttcagtacttgctgttagacaaatacaattactcatttcttctctgccatcactcagagtgttttctccttctggtatactgttcctctcttgtcatgttcttttactttcactgaaacccttcctcagttttaaagtggagctcaaatcacacattcctggtgtcagtttgtccattttctggatttccccagatcttctcatttggaattacactctcccttcagtaatcattcatcatactgtgaacacttatcaccacctgccttgtgttctatgtaggtgaggatgtttttgttttcccactgtggtaacaattactaatggacaaattccctacattttgtaaccctcagggtacttaccttattcataatatgtttccaggaatgttgagtacattaaatgagtaagtttcttagccaaggtattgattccattgaatttactggtcttcaaatatttgtatctgtctactttgtcaagatatgtaagaaaggcaatgaatgacattaatattttccatggaaactaccgactttcagttctatgttacctcctttcagttctgttttacgtctgttttagccttgcgttatcaaatcaattaacttttgaagcctcagtttgatcatctgaaaaaaggaaataatgatatctcctcattgttgtgataattacatagataataattgcaaggagcttgacaccatactgtagcatatagaaagtactcaataaatgccaattaccatcaacagatagtaataactgttactattgtcttcatttttaactttttactcaggatacatcttaggtatccaaggagactgactctggaaaaaacatgaattagaactcagatttcctgatagtatctttatcagaaaaaaggtagagaagtgaatatttctgtccattttatgaaaggacaatcttgatgcacattaatacttcatctcaagccagaatgtaagattcggactggggccatcaaataatcctgcttgagtgattctaccttgtttctaagtagtcattgcctgcagagttttgatgaaacatctaatagagaaattgtggagaggtatcatatgtaattgacagaatacaattggttgtactgaaatatcttccttatgctaaaagaatgaaaacattgatgcatcccagatttgtgggcctttcgttggaagtttgtggagatggaaatttaatgtaaagggaaacatttgtttttcctctgaggaagtctgaaaacttctgcatttcagattttaggttaaatttttcattcacattaacatttctgtcttttagctgatgtatagctcaaaatatctcagatcccctacctcacaccatatacaaatactaatttaaaattaattacaaatcatctaaatataagagccaaaactctgagaagaaaacatgggagaaaaatctttatgacgttggattaggcattctcttgagataagacaaaaaaaaaaagacaagtgacaaaaggaaaagatagattgcactttatcaaaattaaaaaaaatttccttcaaaggctgccattaaagaaataaaagacatcccaaggaggtggagaaaatacttttacatatatatctgatatgggacttataactagaatacataaaatctcttaaaattcaacaataacaagaataataaccaagttaaaacatggcaaaggatttgaatagacacagcttcaaagaagatatactagtagcgagcatgcatatgaaacaatgctcaaaatgattggtcatcaggtaaatgcaaataaaagtcacaatgagataccctgttacaattactaggatggttaaaataaaaaagacagtaataacactttttaaataataagcaaaatgtgcagaaattgaaaccctcatacactgctggtagaattataaaataatgcagccaatttggtagacatcttaacaattcctcaaaatgctaaaatagagttaacatttcacccagtaatgccactactaggtatatacccaagagaaatgaaaacataaatgaacaccaaaacctgtgtatgaatgtttataacagcatgattcatagttgccaaaaagtggaatcaacccagatgttcattaactgataagttagtacacgaaatgtgtttatatccaaatagtggaatgctgttcagcaatgaagaggaatactgatgctacaaaatggataaaccttggaaacattctgctaagtgaaagaaagtagtcacaagggatcacatattatatgatactgtttatatgacatgtccacattaggcaaatccatagagacagaaactagataagtagttgccaggggctgggaggagaggagagtaggcagtgactccaaagaaaacatgggagtaaatgtatgtgggctgatttttgtgaagatgaaaatgttctgaaattgggtggaaactcttggaaagtactaaaaaccattgaatcatatactttatttttaatttttttaaataggcacagaaccaatacatgaattgtatactttgaaggagtgaattttatattatattaataatatctcaataaaactcttgagggatataagaatttatacgcacaaccccccacacccccaacacacaccccagggtaccaaacagaaaaatgagtcagattcaggctccctagtaaaacttatcattataaataagctatcgttggccttatcaaatgtgcttcctgaaaagaatgctgagatatatggaatttgtaagtcagattgtcattctgtcatctttctcatctttctctaaactaaacaaacactggaattaccaccattatgtttgtccacattgtttattaccttccccaacccctaaaagccactacagacttctaatccatcataaaagaatctgacagaagcccaccacgatgacttaagtatatcacagggaagtcacattgcttgtgctaccatgttttatgccccattttgcattctttggatgcgaattttggctcccaccttagctgcaaaatcaggttgcattctgcttagggcttgttttctgtgttagggtttaccaaatattgagagttaatagcttctgagaaccttcaccaaaggggaatggagagccagtaagtaaaggcactcctttactgttctaggtggacaacttggaaggtaattttacactgttccgtccagttgccctgtgggtgtccgtggtggtaaccagtttaataaccctcccttggattacctttctatccctgcttttcccatgcttcctaggcatccctccatatatccttcccccttctgtttcatggtatcccttctaaaactaaacttcttgtatataagcccttaactcagtgtctgtttttaggagatgtcaagctgacacactgtctgatttttagaatatcaaggaccctaggtgaactacttaatgtttctgtgtctcagttgcttcatctatgtggaataataattattattgcctcctgtgcagaaaagagttgacagagtaggcctgataatgctattcttacagaggcctgcttatgagaatgtcccttggctggcatctgggatcgtggctggtacagatataaaattctcccttactgattagagtggatcaccatgcctagactgtacaatgtggtttatgctgcatgcctgcatccttctgggagtttggaattgtggtacatggtagtataagggagggaaaatggcttcccgctttgacacaaggctggttaacagagaaaaaaaccctaattacatatgtaagtgcagccatcccacaaaacggggtcccacaacttgaagaagggtcagatgattgaagcttatgtagcgtcctgagcttacacaaagggataggaatttggggcttcttggggggcaggtaggtgtggagagataagagacaggagggtgaggtgaatacaggatatcttcttatgcagataaatgtctttcaggtaataaaagttgtctggagtagccctcatatagatattttttactaacgtagatttcttttatagatttaagtttcttttacaaaaggacagcttttcagagctactcctgtggctgcagtttcttagaattaccagccaaatgtatgccaaagaaatatattttagggtggcacattctggtcttctacagtcatattttcgggtggtgtgtcctgagcctcaacaataggcagagcatacctatgtgaccagcttctccttcctcacctgctcctctcaaaaaatacccacctgggcactgagttcctaataggcatccctggacggaaatagtccacatgtgttgttgcatttttgttcctgggaaagacgatagtctgtgagaccacctcatgggagagagagagcataaggaagcttgcacatgagttcctccaaattctacctgggtcctttccccttattattcaactgtgtaccattactgcacagttgtcatatatttttgccatgagtacaacttagattctgagtcctgtgagttctagtgaatctctgagtagaggtctggtcttgggaatccttgacacacttgctatggttgttgagaagattaaatgaggtaatatagaagactttagcacaatgcttctaacatcctaaatgtgcagtaaatgttaagatttactaaagtacatcctgtcagctcaatatggggtatcagttggctctgggattcccgagttaatcaggttgactcaatctgtaaaagtcatattagatactcaagagccataaaatgatattagaagtactaaggtttgggtcgggcgcggtggctcacgcctgtaatcccagcattttgggaggccgaggcgggtggatcacgaggtcaggagatgaagactatcctggctaacttggtgaaaccccgtctctactaaaaaatacaaaaattagccggttgcggtggcgggcgcctgtagtcccagctactcgggaggctgaggcaggagaatggcgtgaacccgggaggtagagcttgcaagtgagccgagatcgcaccactgcactccagcctgggcgacagggcgagactctgtacccaccacccccaaaaaaaaagaagtaataaggtttgaatttagcttagtaatgctcagtgcaattgctttaaaacccaggtcctgccaggcgcattggctcacacctgcaatcccagcattttgggaggccgaggcgggtggatcacgaggtcaggagttcaagacaagcctggccaagatggtgaaaccccctctctactaaaaatacaaaaaagtagccgggtgtggtggtgggcgcctgtaatcccagctacttgggaggctgaggcaaagaattgcttaaatccgggtggcagagcttgcagtgagccgagatcgtgctgctgcactccggcctggacaacagagctgagactccatttcaaaaaacaaacaaacaaaaaacaaaaacaaacaaacaaaaacccaggtcctttcccttcatctttggtacagccaatagaaaatgaacaatactatctcacgacttttctattctcgtcagcatgggcctcttccacaagcactccatttaaagtcattgatctaaacttattctttactgtgctgctctttttactgttcacgtctgccttgacaccattccccatttggggtgcccttcctttgccatcagctagctcacatctgaccccactcatcatggactggctcacatcttctgtctaggaagttgtcatgaaggacttgaatcttatgggtctctccttttaggggatagagtgaccctgctgtagttttaaaatcttggatttgagtacaaggatctggattctgcactatagcttttcctctaactttaagaccttgagcaagttacttagattttctgaggccctgttttgtaatccgtaatgccaagataatttgtttaccagggattatttgccaggctacagtgggatgggggaataaatgtgtttaaatactggtaaaagcattgtgtagatataagacatcaaaatacggcacccacgttttgctttttttttacatatataattcttacctccttgctgtatggttttatgttgccattacattcttacttatgttattatgttttatttcttcaggtagattataatatccttgaaggttggacttgcctcgtctacattttgacactccctatcgtagttagcaaagtagtatgctgctatttgggctccgtaagaatcttatcatgtttattgatgaggaattgtgagtttggaaacaatagtttaaggggatttttggaagaggaaaaagcactggattgagcataaccactttacatacagagcaggagctactgaagtggcagattttcagggttactatggggaagtcaaatcttctacactgctggttaacagcaccttaattattagctgctttagaaataagtgccctattgccctgtaatttcatttcattaattatgctcagaggtagtggtatctgaggcaaacaacccttagatttccactgcaccttcatcataggcaaatatttatcatggatagggctattaagttcttcattaagaactttattaagtttattaaaactttctttctcactgagatttaaaaagagccatttagtagtgacctatgaaaatgcaagtattataaagcagtaatatagactatatattattgaataagaattttagcctttttttaacaaatgcagataattattattatgtgccagacattgttacaagaactttaaaaatattaactactttaatttttgtaactctttgcagtagctgtgatcattatttccattttataaatgaagaaattgaggcacagagtgttgtgtaaattatctgatgtcacacagatatgtaagtgactgagctcacaaaagccagtcaattttgctgtatagaatgtgatagaatgtaccctattctatgctgcattctgttactacctgcgtatttatttatttgcagatatgtgcattcattgtgatgttttttaattatttggggaccaatggcatgtcatatcaaaaaaaaggaaagagacctactttgtggatttgcaaacttctattatttatctttacattcctatattttcacttttcattgtaaatacattcaagaagataagttggtagatgataaaatatggatagattaggaatgctaggtaaatagttccaaactctttaatttgatgccaagagagcaagtaatatgaacctcaacagtccatccttaggtgcttttgtcagccagcttcatagtctcatcatagctgactaatagttagtgtcctttttcattttgcacataatccagcattaaaagcataaggtatgaaaggatgaaaagattatgccccactttacttattcgactaaattattatgccttgaccttttgaccaaatcagattcatcttctctctctctgcacttccacccattttaatgctgcggcacagattgaatggattgggagtctgtgggtaagtaataagaacacagagaagagtggccagcatgattaagattttatttgtagtgtaattccattataattaacattatgtaactgtagaaatatggtgtttgcacctcttcctggcagatgcttttaagtcagtggcagagaggagattaaatagtaaatgaagacctatttattgaaaattgtttctacatcctgtattgttggattcatttgtttgtttcacaaaccacagttaatttagtaaggaaaataagcaatatgtttaacaaacactcaaagtaaatttgtttgcagtgctttgaagtaccatagttgaacttttgatattagaagtaaagtattactgaaagatctgcaaattaagggtgtttaaatagtgaaaacaaaatgtttattttttccaaagattactaacagaatttaagtaaatgaaaataatatggttttgcatatggtttaaagcatttctagttacaagtgattttttttcaaaaataaattggccaaataattatgtatttaatttatatacattttgatcagactcctctagccaaggaattggcaatccatagcccactggccagatttgtttctcttcttcttttttgtgttgcccccaacctaaatgtggtttttacatttttagtagtggaaaaaatcaaaataataataatatttcattcacaataaaattatatagcatttaaatttcattgtccataaataaaactttattgggacacagtctcactcatttgtttaagtattggctgtttttacactacaacagtagaggtaagtagctctgagagtctgtatggcctgcaaggctgaaagtatatatcatctggccctttgtgaacaagtttgcagatctctctaccttagcaaataaacaaaacatcatcatcaacagtaatgataagactgtgataagggctttatatacattatttctaatgtatcaaatgatggtattatagacatattattatcttcatttatagatcagaagactgagggtctaatgattaactaatttccttactgagagctgagttttagttggaatatttatagcaacttgtaatatatatgaatgactattagagtttagacttatttaaaaacaacattgtgagtattttgagagtgagattttcttctataacccaattaatatttattaaataggattgggttgattgatttgatggtggttattctagaatatggaaatttggacatctcagttaatttagagctgcaaactaagagaaaatcagtgcttcattttgatgatagatgtcagaaccacttttctgcatccatatggatcttgtttgcttctgctgtatataagaatgattacaaattgctccaacttttattttgaggacgctaatgcattagccttgtagaattggcctatagggactttctctggaattccttgccattcattcatttattgtagaaaaaataagttggctaagatgatggttgttcatactaagagtatattgaaccaggtctgtgaaaggaattgagaagttatcgatgtatttcatcatttatctcattggaccacagtaaatgattattgcattaggatgtggtgataatgggttttgggtattattaaaaaataatttcaaaggaggtccaatatataatatacttagcctagctttaagagtggtagcagagggaaccactgtttccacatcagcttcctgaagtccagtgttaaaagattgattaaatgaaatctgttaggtaaaatgcatttcagttcataaaagtcatgaggcttcttgaataggcccttagaaaaatcaagactctaattatgcagtgctaaacattagaattacagccgaatattcatatagttacgtaagtatttgaaaatatctaatctaagacttccttagatatagctgaaagataatagtctagataatatcttgagggcagagcctctgtcttaaagtatcttcatgtttatatagtaaataaataagagtaagtattattattttaactaatatttactgagaactatgcaccagaaattgtgctaatttttgtaatcaatgcctcatttaattgtcctaaaacctgctgaataagtactaataattattaataatttattccaattttacagggtttacaggcccatatcaaacattcagattagttgagcttaacaatcaagtatctccagctccaaagcttaacaccttttccactatgctgtgttgtgtagcgtactccaaatgtttgatgagtgaatgcatgagaatgtgagggagttatcaggaaaccatcttcatcatggaattttaatctgttcttaacctaaagtttctctactctgaatgctgctactgtggtcatcattattaagctttattagagatccctactctatttacttgttttgaaaagataccatttctgagcaatcccagctgtgacttaagattgaacaaatcagctgtcacctgtcctacacagcagcgcattgacagcacaggtgtggtatttttgctccagtttggatgggttgccaacgatcaggttttccaaatgtgatttgtttagataaaactaaatattaataccacctcaagtgccatagtgtgtacaaccagaagagctctcatatataccttgcgtgattttcccagcaatacggttgttcagatagacaacaagaaacttgcagataagaagagggactcagaaggtttaggtgatttgtccaagtataccagctggaaactcaaactttctgatttcaacaccgtgctgggcattgcctcaatttgagaggggaaaatttggacccacataatgggattgcaccagccttcccatgcccagtgaagataggattgtaccaataatatgggttctttccttttagaaactaacttaatcactggaaccatcaaagcacccacgggtacatacaaaagaacacatgtcatatacctgtgtcatgaataataatgttatgtgtctgcactgtttaatagaaacatgatgtgagggatgggtgcggtggctcacatctgtaatcccagcattttggcaggctgaggcagatggattgcttgagcccaggagttcgagaccagcatgggcaacatagcaaaaaccctgtctttataaaaaaataccaaaattggcttgagcatggtggtgcacgcctctagtcccagttactcaggagactgaggtgacaggatcacttgagcccagggggttgaggctgctatgagccatgatcatgccactgcactccagcctgggcgacaaagcgagactctgtttcaaaaaaacaaaacaaaacaaaagaaatatgatgtgaatcaaaaatataatttaaacttttttggtattcacaccaaaaagtaaaatgaaacaggtgaaatttactttaataaatcattttagttaacacaatatgtcaaaaaatattatcattcaactgtaccaatattaaaacaattaccaattagatactttacactcattttttgctctaaatcttcaattcatactagccacattgcaaatactcaatagtcacatctggctagtggtggttaccaagtaggacagcttggctctgaatagcatgatagtacagttgccatgcttaggcatggagatgctcagagaagaggactgggaggaaatttccctaatccatccccttaactcccccacattttgtcattcagatgatctcctttttgtttaaatgtaaatgtctttttatatttttaacctaactggctattcatctcactgatattcaatcatctgataaagagcttctattctcaagagttctctgaggaagcagtacatctatgcaaggaaatacataaacatgactccagtgattggaacaaaattagaagatttctgaggaaaaattgctgctataatttaagaaatgtaccttagcaacatccaaggctcacgagaatcaaattggttattttgggttaaagtcaaataaaagcactttttcttcacatatttttctttttgtcatttatctaaaacgaatggttgataatgattaaaatgtaattttactatagaatgagaagaaaaagccagaaaatatttgaagtactcttcaatttatttaatcaattatgtcctgataaaaatatgctaattgcaattcagattgcaaggattttggtattttttcttagccttttaggtatttattaacacaatacaacacattcctatgaaattaacatataggattatacctgaattatatatttctataaagaattttccctaaatgacaaagcttaccagagagcatttaaataacatgttttagatatagatatatatagtgcacacatgtacttttcttaaaccttcgtgaatatgactctcttctgagacctgtctgaaattttatatttcctaaaatgacttgatcacatcatcatcgtcatccaataataataataaaaacaatgacctgaaccagaaattgtgcttatttttacagtcaatgcctcatttaaatgtctaaagcctgctaaataattagtataattattaataattgattccaattttacagggtttacagggccatgtaaaacattcagagtagttgaacttaacagtcaagtatctctagctgcaaagcttaagatcttttccactatactgtgttgtatagcatactccaaatgtttgatgagtgaatgcatgagaacaactgttaagatttatcaatgcttattaatactagtacaatgcaagtttttttaatactctttacatgccttatctcattttatctttacagcaaccctattttggtagctattctgaccaataacaggctgtctaaaaactatatagctaaaaattggtatgctgtttttagttttttataaatattgctaaataactccatagagtttgtactaatgaaggcactcaccaaaaatgtatgtgaatgtctattaccccaggcatttatcaacagtgtaacacttttgatctttgccaactcaatagacgaaaacattgagtgaaaatatatttgttttcatttgcattttttaattataattgagatcaagtttttttcttagctcttatcactctctacctctacataatggcttgatcaagggattaacaagctctaaatgagatgactttattatgagtgggaagtcataagaaaggttgagtggaaagaagagacagaggaggtttttgacccaggaagacagattctacttttatgaatagtccctattctcttctctgaaatgaatcgagcacttctgatagaaatctgagtgcatgcaaagaaattggttaatggggcgcctgttaagagcagtcaaactattcaagcatggctagctgctgtggctgctatgattatatttttaaactaatgggggtcagactgaactgtcttgagctatgacagttattaaacatatacccacagaaaccccaaagagaagctaataattgatggccttttatttttacataccagattcttcactgatccctgtctgaaatccactgttgactcttcactcaataaaatcatatgaatattgagtattttaatgtcagtagatggcattctccactggaaacacacttcataactccaccgtatggcctctacataacctcttaagtggtcgatcaagaagcctttgcctgtttttgtttttcgcagtcttgtgatatattctgcattctccgttagggctatatgcattgattagcatatagatggctattctgaactaggccaatactattcagcatgtactacttaatttaggaataatagtatttatgtaaggattatttccagtgaaccaggataggcatagatggtttgagaaatcaaatctgttgagaatcttcagaccgttttcttggtgctaatttcagtgtccaccccctcacccccaattgaaccgtttaacaaagcagccgtataatagaatcatcctagatcatagttattatctgttgcagggacatgaaggtcatctagcttactcctctaattttgtggatgaagaagttcattataataagtaaagacttttctaagaaagtcaatggaaaagtcgggactccctaatttgagcccagtgaattttcctttctcagaattatccatgcccttttaaaatacgaagtgaaatacacagcaaaaggtagaagaaaatcaaacaaaaaaatcacctggaaaatctactttatgcaattagtattggtaatgcttcttcacgattccagcaatgccatataattcctttctctgttaggtatctagtaatttttccttgttttcagctgataatttgtctggtagattctgaaatggcaacctgccatttgacaagaaaaccagtaatggatatgcatttaagaaattttcttgggaggccaaggcgagtggatcacttgaggtcaggagttcgagagtagcctgaccaatatggtgaaaccccgtctctactaaaaacacaaaattagctgggcatggtaacgcacacctgtaatcccagctacttgggaggctgaggcaggagaatcacttgaacccaggaggaggaggttgcagtgagaaaagatcgcaccattgcactccagccggggcaacaagtccatctcaaaaaaaaaaaaaaaaaaaaagaggaagttttcattgcgtctggctaagacttacaaacttcatcagcttgtggagttagtctctgctcatctcatttatatacagagctacttatctgatttgactttattcctgacactggaccaagaaattgttgatggggatttatgctgctgattctattaagaaaattcattaaatgcccttttatgaaactagcaggattgggtacaatacctaacattaggaaaaagtcaaataattttctttagcatgaggcagatgcattgttgattgcctttgtcataaagaaattttatttgaatctttatcagcgactccaaaataagcttgatcattttatgagtgtgatcgtcacaaagagcatatttctcttttacttttttctcttctctttttctcttgtttaagaagtagcaccaatttctttgccagaggaacatgtgattgtattttcagtattttctcactcacaaaagattcaagtttatgctaactggagaccagaaacttgtctttcttgttgcttgaagctttgacaaaatctgtttacttgctttgaacagtattgccctgagtttatttttttggggaaaaaaaggccatacttggaaaaattgagttcttatttatcttggcttatctgttgtatagataacatctgctgtctcagagcttactcagaactaacaaaagaaccaagtggcagagaacacccgtaagtttatacatttcagagacaaaaaggatttatttttgcctgttctatttgtcttttgactacagtttgaaatgagtgattattgtgaatagtttgagatgtaatgatgccaacattatcaatttgtacatttatcaaggttatgcatactaggattatgcatgctatgataacctaaaaactatttaggttaagcagcttattaatatccaagttaactttgatacagttacaaacacagaacctcaaatatctatccaggaaaggaatatcttagcctgtttttcaacatgctacagtaaatatttaatatttaaaaattttgacatttaacacattcagtatctttttattttcctcccctttttctaataattcctataattgtttttataaatttttgaactcttctctctgcttaaaataaaatttctccccaatgcaaattgtgttgtctgttaactgtttagtaagaggagctttgctatcctatatgatgaacacttgattatgtattttgattaatggttactatgccaactagagaactagatttcagtaaaatgatcccactagattgtaaattttgttaatttagaagtaacaagagcatctagtattatgcttattcttgggctaattcatttctttactatcatttattttatattaactcatttatttattgttacaatacatccacttaacacccaggttttcaatggccactctgaaagaggcattgttctaagtgctggaatacaaatacgaggcattatcttgcttcagtacacatacaatgtagttgaaggaaagatttcagtaaactagtcaaaaaatttagtgcaagtagaaatgttattataggagatacagcagtgggccatcttaattcaatggagaagggttcaggaaattgaggttggtcaagttgagttttgagggatgttaagtaagtgcttctttagatataaggtactataagttgtacacattattatgaaagcactgtgtagcagcaacataatcataatcattatgaagttacaggatagtctcattgggagcagttgttaagtttacatcctctaggtcattgctaaaactcggtaatttggcaggaagtacgtaggagctgaagataggagaatccactctgctgattagcaatgaaaccacaggccacccactgaacctctcttactttacttccttatctgtgaactgggataataccattaggtgctcatttaatgtcatttaatgcttgatataaagtctaaatgacgtcatgtgtgtggaagcatattgtaaattgaaaagccctataaagtgaaactgactttattctatacatatttattcacacctgctgtgttcaattcattgaactacatgtgaagagtaaatagttttgttttgttttagtcttcaggaagcagtgagcatttttaaaaggtcgttattgaacccagtactttttgtttggaggctcaggaataatgttaattatttcccttgggaatgcaacacaagccatgtctgtgtccaaatgggacattaaaaaagcatgtcctcaaactatcatttttatttattcactttaatttcactcactaatacctattggatgtcaggctctgcactagacatcaggatgccactctcatttggtgggcagttaaggctgcagtcacaaatcacacatcataaaagagagggagatagcaagggagatcacatatcaagtagggagatagaatgagtaggcagaagacggttaagagagatcgtgccagaagaaagggtatgaaatgggaaggaacatggcacattttaagaactgaaacttcttcagtgtagctggactgcagagagcaagatggaggatggtagaagatgagatggtgggaatatttggcaaagaccagacagtgcagggatttgtaggccaattgaagaattttggccttttctctatgagtaatgggaagacagtgaagcatcttaagagggttgaggtaagagggacgatcatactagctactaaagtttgtggagtcagtagtggtaggttgtggggaggtggtggtgaagatgaagagatgtgaatgaagtaaaatggtcttgacttagtggtggattggctatataggagggatgagagggaggcagaatatcacattgaatttaaatttagaaaggtttactgtaagctgggtgtggttactcctgtttgtagtcccagaaactccagaggctgaagcagtaggatcgcttgaggccaagagttgaagctgcagtgagctataacccaccactgcactccagactcagcgacagagcaagacactgtctcaaaaacaaaaacaaaaggaaaagcgaaaagggagaaaggtttagtgtaaaatctttgagagtaaaaagagagagggatttctaaatcttggattgtgcttatgccatttaaaagctttataattgttgtgcaccttctctaacttatttaatataaccttcttgaaggttagatttcaggttttaaaaaatattttatttctggtctaaaaatttggcagggattttaaagaaatggtaagtgataagaagggagttgttttcatttagtttgtaaggaatgaatattggtatttttatgatctgatgaaatttatcctttaatttcaagtgagacagtttgactttcatatgaagattaaataattaattttgcttacttcagatattcagatttaaattagcctataggccattattaaaatagatttactgtgataattttcttgctcatcagggtaacttattaaacagattataaaatatcataataaaatcaggtcctctgtaaatccagtgaagaacgttttttaacatgacttgccattgagacgtttttataaaaccagtgatacccctggaaagtaattgactaaagaaaaaaaaaagtccaggtttattcctcattgtaaaattcactttttaaatttgcaggctatgaacaattgaatttgaggaataacgtattttgggatatgtaccattttatttaaataagtaaataattatatggtgaaggaataataaatatgtattatcttctaggaattgtataacagttttgattactgattttgacgggactacttttccttatgaattatggaatatatagctaaatcttatataaacaatatataatgcaacagcaatatattttctattaaactataaaatagtaggttaattttaacatcagatttagtccaaaatttatttgccaataaaatgaataatagaaaatttttaatcataaaatttcatttgctgatgtataataaaattgtagatttttcaaaataaaaaaatcttagaaaatatcttaaatttgttatctgaattgctaaatacaatcttcaatgtatttaatgctttcccttcagctatttatttggctttaaatatttggtgatttttaataaaatgtatgtattttgctatgttaaaaatccgaatgttgccaaactgtgcgttttggaacctaacttactcctgtaaaaatgattttatgtgttgtcatttttaattatcagttggctctgtgttttttttttgagacggagtctggccctgtcgcccaggctggagtgcggtggcgccatctcggctcactgcaagctccgcctcccgggttcccgccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagtgagtcaacctaataccttttaattttgtgcaaagttctctgttttaataacttttaatttagtgcatatatcatatactggagaattatcaatttatttgattcttttagcaatttatattttggtaattctgtgttaataatgtgatttgtatttggttacgcagttgccgataatcctgtggcattacagagtttgatttatgcggacgatccttggacttaaaaaggattactgaccatttaagaaagattaattaatgagtataacattgagtcctaactctgctaatgcttgtctaagctacacacagatacatgcacagacacacataccctcaaatctcataccaaaaatgaccaaattacaacaaaggggatagtatcctatcctgctaggccatcacattatggatcagcagtgtagagcaagtcttgtggggcctgatcttgctcttacaagctttgggatcttgggcaattcagtttccctaagctcagttccttatttatagtcagtgagatgaatcctatggtctcttaggttccttttatttcgtaattcaaaaagttgaagttagaggttaataattttgtattggtaagactgcaatagcagtcttcttcttataattaataaattaagaagttacagggaccaagggagaaaggtaaattcatttatagggataagacaataaaagggtacaattaatttatttggtcaccagtgttcttgttttcttgctgaattttatgggatgggaacagatctaggaaggaaggctcgtctgtacccttttgccctacctgacgtaaaactcaggactgacccatcctaaaatcattcatttagaaagaatccctcataaccatgttagctcaaggttatcttgtatctgatttctctcttcctgcataggttgcagactgaagagcattaaaatatctgttttcttagtggttttcctttctggatttgaataattcacttgattcttccaggctacttaaatgaaagagtgttatctaagaatgctaatcttagttccttttgtttgagattagagaaatcaatgcattatatttttagtctagatagtaagtcctgaatgccctttactctggccatttaaaaaactaaattattttcagttggctttcatattgtggggttagatattcatttgagatatgttttcttttttccttttccgttcctttagttaaaacgaaatcttaccctaaagtgggataataaggggaaagatccattgaatttgagtattgggcttagtttgcattaaatgctccttttgttcctgtttatgtattattttaagctcgtttttccaaatataccaacagcagatatcaaatgaccattacttcatactagaaggaatttttataaaccaggccaaagacttcactagatttctcaaactttgtttctaactctgaaatcctatgattttatgatttttaatatattagagtaaacctacaaaattgtaattttgtaggtgaacaatagttagacagtgtcggtttcatatgattcaacctacatatggaagcttagtcattgcattgtttaggaaaactatgtaactcatgtatgaaaatggtaatgtcaagcaacgaagcttattaagacactaacatcatttttaaaatttagttttgaatactagatattaaaaattatattttaaacgtttgtaaatccagtgagaataaaatgttctttgcatatcttatttcttttcacagggagttttttcctgtgttttatgagaaaaatcacaggcattacagtttgaaatcaatttcattgttttcattgcaattgctacatagctgttgaatatttgtagtaaggtttaatgactaatgaagtgcatgcttgattatatgccattagtaaaaatatatttttatggcaaagggcggtttgcagcatggcattgacaaaagcaatatgtaaatgtgttactccccttcaaaagaatgcaaatcagtataaacaaattttaaggaaaatatttaaaaataaacaattaaaataatggatatttattgtttgttacttattgagatgatatgaatatgtaaatagagcacttaggtctacttattttcagaggccagtgtactactaattagaaaagttgtagatatcataattactgtagtaaattaatttgtctttattgcttacattttattgcttggtattccaggcattggatagatagttacaatgctgacatcaagagtgttcccacgattatttctccgcttttctaatcatcaactcattatatgtcccttatcctcctgctacttattatcacttgccatttcactcattatttgctcctatctctctgtctttgctcattcaattctcttttctagggataccccttccttccagttcttacctgccaaagctgtgtttggcttctaatgtttagcttaatgtctgcatcttctgcaatgtctttcagatgtctgcagtcagaactctttactcaaggtcactaccgtcagcttgtctttccactggagctcatccagaacacattgctttgtgaccaaacacattctctctgtatctgcctcccaattagactgtgtacttctcttccccatgttccctcctttgacacaagtcatgctcttctaagcaatccaggcttgttcagttgaattattttctaaaattaaaacggtatgccagacaaggtaatacaagtctaggcttgatttttcctgagtgttgtgtttgcggtgggtgggccaattatttctgttccttttcaaaggatctcacttatcttcttgttttctgccccattggataaatcatctcatgtcatcatttatttaacttcaaacacaatttctaaatgttgaggaatacgagaacaaaaagagcatgtctgcatctgcatacatggtcttaggtattgggtgaaagaccatcaaaaacttatattagtactaggaagaacacaattattttaaaatacattaaatgcataataacttttaaaattaagggtcaggaagaaatctctaatagaaatcacaaaacgatagacattttctttgaccattcttgctttgcttctctaatgtatatttaatattaatataaataacagcagtaatgacaaccataatggccactaccatgtcatagaatgtactatatgcattcacgtgtttcatctgatttggtccacatatcataacatgaagttggtgaggctgaggctatatatgttattcagactcaagatagaaaggattcattaggaaagggttcatgagaaaaataagcttaaagcacaatgttttcttccaactttccatttcaggggtacatatgcaggatgtgcaggtttgttacataggtaaatgtgaagcagagacacttttttaacatcagttctccagtgagttcatagcagattacagggtcaaaatatatatgcatacaccatagtaagcaccatttaaacttgtagaagtaagaaaattgtccttgaatagtcagttcaatcttcctgtgctctattgagtgtatctatctgtggatacaaaatgaataaagatggatctggacatttcacccttccgcatatgggagtaaaacctataaggagactaataatatcatgcatcacaaattacttgctgcagttaaagaagttttattcagatcctcatgatctcacagggatccagtatcttgagagttgacgaactttccataaaaacactaatcacgtataacagttcagtcaaaatctactgatatagatattccaaagtatggcaggaatttagaacaaaagatggaaaatttgaaggctctgatctgtaacatttcttcttaaaatatttcagctgacttgcttagcctggtatgcagaatctggtgcaagctgagcacggtctaagttgcctcatcatctcagctctccatgcttctgtatttgtatacttccatacttagcaagtaactgttctccctccatggaatgtattattatcctctgccactgtcctcttaaacctggcaaatgcataactttcttttgagacctacctttgttaagacctagctctttgaagacttccctgattgtccaaggtaatgttgactttactttgtaactgtatgtatttttcttatgtcagcaaccactgctctgggttattactatatttttctctcccaaataagacaagaggttctgttagaagtggaaccttaatatccatttttatgtgatgaatttctaggcccatgtgtgggctgtattaaaggattaaagcaagcttgttcaacctgtggcccaggacagcttttattgtggcctgagacaaattcgtaaactttcttaaaacattatgagattgttttgtgatttttttttagctcaccagctatcattagtgtattttatgtatggcccaagacaactcttcttcccatgtggcccagggaagccaaaagactggacacccttgggtgaaagcttattagtaatgagtaaataaacaaaatggagtggatgaatagtgtagttcactatggacaagttaaataatgcttttctcaatgataagggcaaaatgaaaattctgagatttctacatgcattatccttgaaacctttagtattttacatgtagagaggtcattgttcagactcgcatttgatagagtaatcagtgttgaagacattcccaatggtgtaagttgccatacttctgcagtataggctggttgcccacaggaaaatattggagacaaagctgaaagcaatgtaaaaaccttgtgaaaaagcagaatgtatctttgaagaactgcacttaatatgttattcagcctaatttgtgcattttaagtaacatgttgatgagttgtacggtagttttcctttatccatagcccataccacaactccaagtagatgcctgcagatggtactgaacccttatatatactatgtttttcctgtgcatacatacctatgataaagtttaatttataaattaggcacagtaagaaattaataactattgataaaatagaacagttataacatcatactgtaataaaaaaaatctatgtaaatgtggtttctctctctgtgtgtctctctgtcatctcaaaatatcttattatactgtactcacctatttttggactgtgggtgaccacaggtaactgaagctgtggaaagcaaaaccatgaataagtggggactgctgtatgtgttgtagagctgtgctgtccagtctgtcagccactacttacatgtggctactgggaaatggaaatgtgtgcccaaagtgatatgtgctgtaagtgaaaaatgaacattaggtttcagaagataagtacaaaaaaaggaatatgaactatttcactattgtttctctgttgaaatgatattttgagtatattaggttacataaaatatattattaaacttaattttatccctatctctttactttttaactgttactgctagaaaatttcaaactgcatatgtgtcttgcattatatttccattggacagtcctggaaaggaaattatgattatccagagaataaagtcattaaataaaaggaaaggttaaataaagtatgacccgtcaggagagagacaaacaaggagagggaacagggtaagtcagccaagcatggaaacatgtggcgattgctcaagggcttgtgctctgaatctgaaaatgctgtaatggtctatgaaaatacttttagagctagtaaatgaaaataagtgcttatataacatataaacttaaaaaattcatgatatttaatgttcaataactatgagaaggcttaatcaacctactgtaatattttaattaaaaatcattctaacgtcaaataaacggagaaatactgtccgtcttccataatagatacaatggatggtttaatgttaaataccctgagaagtcttacagctaaaaatttatcactgtttcaaacagaattgttcccatatctggatgatagaactcactcctcctatgtatttaataatcagtattctatgagatatattttgggagatacttagtagaagataaagtcactgtattttattagggatgaaactgaggctagggagatccctaattcatttgagatctaatatgtgggcaaaatagacagattggtgcaatatccagcacagtttaacaaacactttccgagtagctactttgtgccagttattcattctggcaataagacgaataatacagccaggttggtgaatatcacaattcatagattctcaggtgattgttctcatgttttcagaaaaaggcaatgacagtgtgtacactgacccagagggtgattgtcctgctatacttaattttccaataactcctattgcattgaaactgttgcaactattcttcagaagtatagacattgaaataagtaaaataaaatagtaacgtacattgagttttagaaatgtaccatgtacatgtttttagaactcttagcattttgatttaaaataataaaaattggtgtacgtattttcttttgtagacaaaagattgtagggtgaaaatttgtaaatttaacctaatattttattctcattggtcacatgttatgaaaaattatatacctttcagctacctgtaactatgtcttctatgagtaatcatgaactgtctagctctgctgaagtttttatatttttcatgaattcgtacttaaatcctagcactagagttccttttttgagaattattccttttctctcagctcttctttcaactttaccagcaacaggcacacagagagatacatctgtgtgcacacatgcgtgctctaccttacactctcacattctcacactgtcagatgctcttagataaatacctttctggatgttagtttttcagaatgtcagtggtcccaattattttcctcaggtacagattaaaattttaaccctacattctctgataggtttctgtttaatagcactgatgtgtttttttaaaaaaaatatcatacaatgcaattgcatattttggacattctcatcctgcaactactttccctccccaaaatgtttagattctgtggctgagatacagtaaagtgcacaaaatcatgcaatcatttacttattcattcagcaaattgtcatcaaggcaatgggctagcaattgtggggataataaggaaagcatttttaataccccttatcctgaaaggaaacctttaatgggaagatatttttgctatcatattacatttttttgagtaataaaattgctgtgtttaacatttgccttaagtaacttccatagatagttactttcatgctggcccatagctgtgctggggatagtggtaggcacatctttaactcgggaattagtttgaagttgcagaattgttagtaaatgtagtatttgttgatttattacacatattggcagcaatgcaatgtgtatatactattataggaaataccaagaaaaataaaaattaaaagacaaacagcttataataattacccacaaagggctttttaccatgaaaaggagagaggggatggtgggttcaaacaaattgttctaatagaagatgagttcctaaaagaggcatagatgaagtttgatggggcattcagaggtggggaaaagtcctctcagggggattcagggaatgttcgtggaatgagttggcagtggatttgttcagtgtaatgtggctgcgatttggacatacagacttggtggagatgttcactgcaagttgagtaagtagtgcaaacatacacatagagacaagaaaagtcttagggcgtggatgtgaacagcaactggaggaggttggttaagtacaagcatagaatgggaaatgaatgtgaatgccatgcacaaagcacatatgcattgtgttctactatatatttacacaggtgccttttctttctctggaagggagatttgcatggatgcctttctaggtggatgtcatacccagcgaattctgttgataagctattgccgttgcagtgactgcaataattcttgagcatgccatctttaccagctctgctagagtgttgaatgttcaaaagaaaaacccaagtacctattaaatcatcagatgccatagtgtgtttataaaatcagatgaaagccaatttctgtattagagcagatctacttttctgtgcttggttggtgttgtaaggagagattattctgcttccctaagaaggttaagctgtcatctagttaaatatggacttaaaataatgctgccaaagcagttgcctcttgtgattgatgatgatgatgacagatgatgatagttttgaaatcagttttacagggaaaattgctatttttctactttggctgatgttgtagttctagatttgcgaatttcttgtcatattcgggaacatttttgattaaaaggaaaattgctaaggactgtattcttgatgataaaatggctctaaaactgagctatggggcaaatgattataagttgacttatacatattatttgagcgacagcagttattcttggctttacagtgtcattatgagttatattttggggaacaaatagcaacccatgtctagtcagcaaaagtggcagaaagtgtggtacttagaagttatgataataatagtgtcttactaaagtcatcaaagaactttcgtatgtattactattaaattttctctacaattctctcaggacttcatgcatgtgtttcctctccttgaattgtttttcccctcagatacctacatggcttgttttctttctctagaagaatagccgcaccctctctgcagtctctcattcctccatggcatttatcaccacctgacatgtgatatatgtatttgtttactatctcctcatgctaggttgtaagccgtgtgaatgctgagactggtttcttcagtgcaataaagtaagaacctataaaagttcctggctcataataggtactcagttagtaattcttgaatcattagctctatgaataaatctttattttatacatagacgactgaatattgtggtcatgatataaaaagaagctaatgtttggtgccagaatcaaattcaagcttttcagtttatttaaccaaattgctttggtttgtgtctatgtaagtaacatagacaacaaatagccctgaaaaaaaggagtaatagtgaagacttactcttaggtgtgaaccatttctgtacctcatcacattctagaatcaatcaatcaattttgtttatacagaattgctggtaatggctactctataccactgcattgtgtgagcctgtgcagacactggtctgaaaaagccattttcaggaaggaaaagaaaacagaacataaaccccccaaatattttttaaaggccaataacatttgtatccattgggtaaacacgatcaatcaaagctctacaagccttctatgggttgcttccttaacaaatatgttttttgccttggccattcatcatatctggaagtttgggtgatgagcttgagcactctcttccgttaatactgaaaatagccacttagtggctttgtgaaaagaaaagcctgttaaagcgacagaacaaacatgcattctcctgacgatataaaacaggatattgtagattgtttatattcgtgtgggcttggtgtaatgaaattcagctgaattttaagaagaggatttgttttaatgggaaattaggttgtgaatggaaaaggctacaatgcagatacgaaaggtattccctcgtaccctccaaacgcataaggagttttctaatgagactgagagtagtagctgctaaaagcaaagtcatcttatctgttgtctgagatgaattaccttaaaaaattgtaccctgacctcattactatacattacatatattgaaacatcactatgtatctcctgatatgcataattattatttgtcaattaaagaaaataaaataaattataaaaaaacattgtagatgggcttaaaaagtgaagaaataggtagcttctgtcaccagcactatttagagggattgatgaactattttgagaaggttggggctgggagaggagtactatgaaaaatgaaaagtcacatctctggaagcaggcatgtagtatcacatccaaaggacactgtacatacaaggtctactgcagtcagagagattaaaataatcttccgacctctgaaataggataatacaccaattataagtgatctcatgactagaaagtgtactttttttccaggacagttagtgtgtctgaaagtgagcagctagaaagttcaaggaggcagactcacttatttttggttatagaatgggtagggtttgggccaaataatctagcttgtagagtcaagtttagtcatttgttgaggtttacaggaagcacaaagagagaagagtagttgaaacagcataggttgggcaaagaattaaatggtgggataaaatgggtcttggtaaaacatgtaaatgagattaaatgagctggaaagaaatcaaccaaacaaatttcaaatgctgaaggtaatagagtgggtaatggttgtcccattatgtggtggctttagttttcagtcctagtaccacaatgccccttgccatagaccttttctttaaaacaaacaaggaatattcttatgccttattttctacataatgagtgtttttattgattttagatttttttcaagatccctatagagggattttgaatacttttcatttcctgctttaaccaggatgtctgccagaaatggatgtaaagcagtgcatggattttaaaataagaaagctcttagaatttccttatccatttccagtgctttgtgcattgctccaaaatattgctgttttcagtatgggttttgggtctcatatagagaagatggctcatttgatcgaataacatttcatataattgccctttataatttaacttttctatgtaaaatcatattcacttctgtgtgatcaattacaaatataaagatttaatttcatgagaattactgctccttcaattaatagactagagaagaagagattctacattttcccttaaatggcataactaattaatagcgaaatgtgactagaacccagattttctgaatcatggactcagtgttgtttctcctacgaagagcagatagagtacttgtagttaaacaaaattagattaaaatttcagctatcaaccctattagcaagttatttatgctgtaagcctcttattttttaatctataaaatgaagttaataatagcatttctatagcattgtaggatgactgtagttgataatatatagctagagggaggatattgaatattcccaacacaatgaaatgataaatgttcaggacgatgcatatgataattaccctgatctgatcacattacatgtatggaaacatcactatgtgggaaataaccaaactgttttggaacccttgctcatgaaggaatttgcattttgtcacactatttgcatgttcatttggttttggactgcattatgcatatttaaaacatactaaatgttatccctcaaagaatgtgtaatcttaacagtcctgagtgaagacaaaagtagacagtgatcgtggaatccagaacatactatccaatgatcaatataatacctagtaatttaaaatagagccttttactgattttgctctagttctagttaatgaagaaaagaagagatcattttaaaggaataattagtaaagacacctgcaaattttatgcataagtctgagtaagagaaattctgctgataatgctaatattatattgtcacctatatatatagtgtcatatctaaatattttaaaaataccaaataagaatatcctgctttttactatagaaaagaagctaatggaaaaccgatcatctgaccaattattaaaatgcatcctctctcctataagctctgttgttaatttcgtgatacaccttgaatatgccacaagcaattggtaatagcatcaattaacatttgggaagttcagcatggccacctaagatattaaatatttgctacaggaatgctaatgaaatccactgatgttatattcccaaggtattgtttaccaataacagcaaagctaagggttaccaaataaatgaaggaagatctacttagagctgttttcttcaattattctaatttttgtgttctcattttggttctgagttttctcacctgcatttgaggtcagagtctggaaacagggctttcagggatgcatcactaatgtcctttaggaaatatgtctttgcataatcaacgtcattgaggagacttttataagaaaatgaaaaaaagaatgaatttgactttcccttcactttttttttgtagagccattgccgtttctgtatttggataggagagaaatgaagcattgttatttaatttagcccttattataacatattatgtagtctcttagggtggcatgttaccaaaaacaagatgttctattttaaaagttgatttagtattacttcttttttttaattcacaatacattatgtaggtaggtttttttttctgtacattacacaccacagactgtattagaaaataatgttggtgtagttttattgaagccacatcatgaaacataagtattataaagagaaggctgttttcccatttcaatcagttgtctagttgatgtgtttatttttcatccaatttattttatatactaaaaaacagctcttaggaaagtgagtacatcaaactcagtttcattgatttaattttatttattttactttaggctaagttaattcaaatcaatagcgtgtatgtatttcagtgtaacctgtgatgatttctgctcaaactctacattcacatttataggaatcaggatattgccagatacgcactgatttaatgaatgaagacattgcagatattagaaacaacagtctctaatgaaataattgaatttatttttccctccaacatagttgagtggtgaaactatactcttgataaagttttttattataatgtattaagtacagtggtaaataaaatggacttcattttcaaatggatcttcagcaaaacattaggtttttaaatcacctttattacatttttatgtatctctttttgggatcttattgctttattagtatataacgtttttgatatttctaaacatgtttccaaaaatctgaatttacacattgataaaaataaaaacgacttagtcttctctgtcactgtgttctttttgcacttccattgactatgttccattcatgaataagaaaaagaaaaaaattagaagagatttattggaaagcaaaggtaactcttactactatttcatagaccatctctttgattttgcaggttagtttgtcctgtctgggggagataaaatgtagatttaatatggctaatgatttagaatcctgtctactatgaaacttaactcacacactaagaaaggtgatataaatgctgaatccctttaagtacatcttggcttgatgatgatatttgatgatccactgatttgtcttccaaaacactgtaacatttggttctttctgaaatcatcaatattattgttgtcgaaagacttcagaaagccagattgtctcccaaattgtttaatacttctttgctttttggtacgttttcttatttagttattaaataagttcttagtctttaaagctgatttttaatttttttgtcttttagggactactatattcacaaaagaataccagtaatacatgcacagcacaatgaaaaaaaccaatatgaagtagttgtttgattagtttcagcaatataaatggccactgcaagtagtttaggagccaaagagcattcctgcaatctagaattagtagtttcatttttttttcaattgaattgaaattggtcaaggtaactagataatgctaaatccccagtctactttgtgccgtgtagttattctaatcgtattgaagaacgttgtccatttgtcagcattttacaaagtgtgttaatgacttctattcctgctaccttatttttctgcccattagaataaacagtgactttatgtcacataaaagtagccttatagcctttttaaacgtttatttttgacaggagttgatggtatggtatttatgagagctgagaccagaattaaaaagttgtaacacattgttttagtgaacgaaacaaaagaacaaatattctgccacacgatttataccataattctagaatttactttatccttttataaattcaacagctaaaaaggtctactgactaatttttcttaattaaattattttcttgaaacagaatataagttcctgctactactactactaatctcatctttattggaatcagttaggtcatattgagccatgattactttttcatttttttttttttattgagacagagtcgcactctgtcacccaggctggagggcagtggtgccatctcggctcactgcagccttaacctcctggactcgatctatcctcccgcctcagcctttgaaattgctggtattactggcatgagccaccacacctggtcaagatttcttattaatttaacattttcaactatttctgcatagttgatatgtgtcctattgctttctgatttttttttaatttgttctttttggttattatactttaagttctgggatacatgtgcagaacatgcaggtttgttacataggtatacacgtgccatgttggcgtgctgcagccatcaacccataatctacattgggtatttctcctaatgctatccctcccctagccccccacccccctacaggccccagtatgtgatgttcccctccctgtgtccatgtgttcttatagttcaactcccacttatgagtgagaacatgcggtgttgggttttctgttcctgttttagtttgctgagaatgatggtttccagcttcatccatgtccctgcaaaggacatgaactcatccttttttaatggctgcatagtattccatggtgtatatgtgccacatattctttatccagtctgtcattgatgggcatacgggttggttccaagtctttgttattgtgaacagtgctgcagtaaacatacatgcgcatgtgtcattatagtagaataatgtataatcctttgggtatatacccagtaatgggattattgggtcaaatggtatttctggttatagatccttgaggaattgccacactgtcttccacagtggttgaactaatttacactcccactaacagtgtaaaagcattcctatttctccacatcctctccggcatttgttgtttcctgactttttaatgatctccaatctaactggcgtgagatggtatctcattgtggttttgatttgcattctctaatgaccagggatgatgagcgttttttcatatgtttcttggctgcataaatgtcttcttttgagaagtgtctgttcatatcatttgcccactttttgatggggttgtttttttcttgtaaatttctttaaattccttgtatattctggatattagccctttgtcagatggtggattacaaaaattttctctcattctataggttgccttttcactctgatgatagtttcttttgctgtgaggaagctctttagtttaattagatcccatttgtccatcttggcttttgttgccgttggttttggtgttttagtcatgaagtctttgcccatgcctatgtcctaaatggtattgcctaggctttcttctgtggtttttatagttttaggtcttaggtttaagtgtttaatccagcttgagttaatttttgtataaggtgtaaggaagggctccagtttcagttttctgcttacggctagccagttttcccaacaccatttattaagtagggaatcctttctccattgcttgtttttgtcaggttagtcaaagttcagctgggtgtagatgtgtggcattatttctgagggctctgtcctgttccattggtctatatatctgttttggtaccagtaccgtgctggatttataaagcaagttcttggagacctacaaagagacttagactcttacacagtaatagtgtgagactttaacaccccactgtcaatattagacagatcaatgagacagaaaattaacaaggatatttaggacttgaactcagctctgaaccatgtggatctaatagacatccacagaactctccaccccaaatccacagaatatacatttttctcagcaccacatcgcacttaattattggaagtaaactctaataattggaagtaaaactctactcagcaaatgcaaaagaacagaaatatgacaaacagtctctcagaccacagtgcaatcaaattagaactcaggattaagaaactcactcaaaaccgcacaactacatggaaactgaacaacctgctgctgaatgactactgggtaaataacgaaattaaggcagaaataaataagttctttgaaaccaaggggaacaaagacacttatgtaccagaatttctgggacgcatttaaagcaatgtttagagggaaatctatagcactaagtgcctgcaagagaaaacaggaaagatctaaaattgacagtctaacatcacagttaaaagaaccagagaagcaaaagcaaacaaattcaaaagctagcagaatacaagaaacaactaagatcagagcagaactgaaggagatagagacatgaaaaacccttaaaaaaaatcaatgaatccaggagctggttttttgaaaagattagcaaaatagatagactgctagccagactaataaagaagaaaagagagaagaatcaactagacagaataaaaaatgataaaggggatatcaccactgatcccatagaaatgcatactaccatcagagaatcctataaacacctctatgcaaataaacgagaaaatctggaagaaatgtataaattcctggacacatacaccctcccaagactaaaccaggaagaagtcaaatctctgaatagaccaataacaagttctgaaattgaggcactaattaatagtctaccaaccaaaaaaagtccaggaccagatggatttacagccgaattctaccagaggtacaaagaggaactggtatcattccttctgaaactattccaaacaatagaaaaagagggaatcctccctaactcattttgtgaggtcagcatcatcctgataccaaaacctggcagagacacaacaaaaaaagaaaatttcaggtcagtatccctgatgagcatcgttgcaaaaatcatcagtaaaatactggcaaaccgaatccagcagcacatcaaaaatcttatccaccatgatcaagtcatcttcatcactgggatgcaaggctggttcaacatacacaaaccaataggcagagagccaaatcatgagtgaactcccattcacaattgctatgaagagaataaaatacctaggaatacaacttaaaagggatgtgaaggacctcttcaaggagaactacaaaccactgctcaaggaaataacagaggacacaaacaaatggaaaagcattctatgctcatggataggaagaatcaatatcatgaaaatggccataaggtaaaagtaatttacagattcaatgctatccccatcaagccaccattgactttcttcacataaacagaaaaaactgctttaaattttgtatggaaccaaaaaagagcctgtatagccaagacaatcataagcaaaaagaacaaggctggaggcatcaggctacctgacttcaaactatacgacaaggctacagtaaccaaaaaagcatggtattggtaccagaacagatacatagaccaatggaatagaacagaggcctcagaaataatgcctcacatctacacccatctgatctttgactaacctgagaaagacaagcaatggggaaaaaattccttgtttaataaatggtgttgggaaaactggctagccataggcagaaaactgaaactggaacccttccttacaccttatacaaaaattaactcaagctggattaaacacttaaacctaagacctaaaaccataaaaaccacagaagaaaacctaggcaataccatctaggacataggcatgggcaaagacttcatgactaagacaccaaaagcaaaggcaacaaaagccaagactgacaaatgggatctaattaacctaaagagcttcctcacagcaaaagaaactatcatcagagtgaacaggcaacacagtataagagaaaatttttgcaatctatccatctgaaaaagggctaatacccagaatctacaaagaacttaaagaaatttacaagaaaaaagcaaccccatcaaaaagtgggcaaatgatatgaacagacacttctcaaaagaagacatttatgcagccaagaaacatgaaaaaacacttatcatcactggtcattagagaaacgcaaatcaaaaccacaatgagataccatctctcatcagttagaatggtgatcattaaaaagttaggaaataggccgtgcatggtggctcatgcctgtaatcttagcaccttgggaggccgaggtgggccgatcacgaggtcaggagttggatatcacctggggcctacatggtcaaaccctgtctctactaaaaatacaaaaattagccaggcgtggtggtgcacgtctgtaatcccagctacacaagaggctgaggcaggagaatcacttcaacccgggaggtggaagttgcagtgagctgagatcgcaccattgcactccagcctgggcaatagaatgagactccatctcaaaatcaatcaatcaatcaatcaggaaacaacagatgctggagaggatgtggagaaataggaacgcttttacactgttggtgggagtgtaaattagttcaactattgcggaagacagtgtggcaattcctcaaggatctagaaccagaaacaccatttaacccagcaatcccattactggctatatacccaaagcattataaatcattctactgtaaagacacatgcacatgtatgtttattgcagcactgtttgcaatagcaaaaacttggaaccaacccaaatgcccatcagtgatagactgggctttctgatcttttgattttgaggtttcattgaatattagcacagattttcttatttttttttctgtctcaatatacatttaggaaattacttcctaataagtaagaagtacatctagatagttgttggatgaaatatattaacattagctattgcttaagaaaacaactggataatgttttcctacctttttaatcatctcatcctgctagtgtactgtgtttgctcatgtttatgaacctaccacacataatataattggctctgaacttcctgaattgcaaatcctgtattcaataatttcatgcatgcagcctatttctcaatttatttctgggaactctaatcttttgcttcacagatactttgaactggcatctcatgtcttagtctgagttcctaacctttttatatttttttattatttgtattatttatatattgatttcttatttctctcccattgaaatgtaagatttatgagggcagaaaacttttccatcttgtccaccagtgtttctcaggcacttagagaactgtgtggcctaagagggattgattgtgtactcttacattattctttttcatttattatttcatttgtttcttataaccttataaggcataagtgctattctgtaggtgaggagacgaagacatacagaggttaaataatgtacccaaagctatattgctctagtagttggttatttagtgatttttttttttggctctgtaaatttgaggccatttttcttcagaacattcccttttccccagcatctttatggtacctggctatgcacttgcttttgctcataagcctaggttttgtctggtcagtcagtgaacataaataaggaatctgctaaccaatcaacaaggaggaagggagaaatcagtgaaaatcgtcactaatgttgaagataataaacattttggacaatgactgatgttttatgaagagcttttcataggaattcttatttagttattctcatgttacatgatggggaaactaatctcagagttgcaaatgttaagtgccaaaggcaacacagccaaaagtctatagctggtgcattagtccgttttcacgctgctgataaagacatacccgagactgggtaatttataaagaaaaagcggtttaatggactcacagttccacgtgtctggagaggcctcataatcatggcagaaggcaaaaggcacatcttacatggctgcaggcaagagagaatgagcgccaagcaaaaagggaatcccttataaaaccatcagatctcatgagatgtattcacaaccacgagaacagtatggggcaaaccacccgtatgattcagttttctcccaccaagtccctcccacaacatgtgggaattatgggagctacaattcaagatgagatttgggcgggggacgcagccaaatgatatcagctcgtgagtgagcatcagacctggggttcacatcctcgtatctttgcattctttcccatccattgtattgtgggaagagcagatagttctccccattcccactcttctttgttgtgtgtgtgtccactgttgatgagaatgtcactctttgttattttcaagtttttttagtcactgagctttcccatgattttcataggtcattggaattttgtattgttttatgaaatatacactgaaataagatccttggctacaattacagttttgtataatttagagagcacgtaggcaccattttcttgcccaagaatggggatagcaattcttttactttctaccacataatgtagctgtaggatgaaatcctgtagctgaagtttctcaactccagcccattgatattttgggccaggtgattgtttgttgcaggagggtgtcctgcgcattataggaagttcagcagctaccatggcctctaccctgtagcaccacccgagttgtgataatcaaaaatgttttcaggcattatcattttttttttggcttccaggggatgtaaaattgcccatggttgagaacctccggattaaattaagataataaatgtgaaaatgtacattttaagacaattttccaattcaaggtgttattaggatgagatttaagaacaatagaaaaaatcattgtggcagatgaggtaagcagcagaagggaaaacagggtatagacattaaggactagagttggctgtctcctattatagtcttgtgaaagctcactcatacagattcctgctataaatttcttgcttttgtatttttccaagcaaatatttaatacaatgttgcctgctaatagaacttcccattacagatttaagttttcttttcttttcttttctttttattttatttatttattttttttttgagacaagagtctcgctctctgtcatccaggctggagtgcagtggtgtgatctcggctcactgtaacctctgcctcccagttcccagtgattctcctgcatcagcctcctgagtagctgggattacaggtgcccaccgccacgcttggctaaatttttgcattttttaagtagagacgaggtttcaccatgttggccaggctggtctcaaagtccttgcctcaagtgatctgcctgcctcggcctcccaaagtgctgtgattacaggtgtgagacactgcagccggcctaagttttcatttctttatgaaatactgtgtagcatattcactaccatatgatgaataattaaaactaaattgcaattgtcaaaataaatgaacacatcacatttggaggtagaaaaattcctaatttttttttcccacgtagtttattgcatactattcttatttgtggtatttggtgttatgtagttactcaaagttgttacagcatttatactatatttgttttgttgaattgaaatcatagaacctgccaattaaatttaaaacaatgtcatacacgttggtttctctattacttacagagtaaaattctcaaagccccatgaggcatccttgtcttaatggcatggatatgttactgcatgtgctcttattgtccagccagctggtattcatatataagattttattaaataacatcttacacattatttatgtgataggctttggtgatggggctttgagaaagctgtccagaagagagatgtgagcattctctatgttaataactttctactattttattttaatgtaacttgctacatttgccatctgggatagaagcttctgcatcaaccattaactatcaacaccaactattccaggctgcagaatttcagtttgaaacggttctaaaattctatggaatagtgaaggcccgcttgcttcattgtgctttcctttaagtggagtattgcccagatgtggaagttagatgtggaattttcagacagaactgtttaccttgagaatggctgggcaccttccatttgtactactttttattattgtcagaactgatcaaataaatctgcccgagtatctgtgtgtgggatgcatgttgaaagcgattttattgttgcccaataagtccccaaatgctgtcgtcttttgctttccctctcccatcttaagtgcctttttgcaacttgcctcacaaatcacattgtctctacttattacccaggcttttctccagctggtaaaatggatttttttttcctcagccagattcagagtttgccctgttcttattccctgtatgtttcccttcacttttaatgtgaaaattgcaaatatatttctaaacccttctgcacaacactttccatttatggaaaactcacactatataaagtaacgagaggagatatctaaaatgtgtcttccattttctgctctgtatctccaactggaccaatttttccagataatttctcctttctttccaactttatctgcatcgtagaattcagagaactgaaagcatttcttcctttctttattttttttcatattctttctctactgcagacttcgctaactgatgaaacactgccagagcccacttggactgtttcgcaactttacttaagggaataaaagctctcatgctgaggtaaggcaaacagtccatgtaggttctcactaaaaagaagagtggattttataagctcgggcctgtcttataatctctctgtgtcttgttcttgtatgtaccttgataatttactatctgtcctttttctgcccagtggatttttgaggttcacaaatgtgagatacacaaagatgtgatatacacttgctgttccgtgtttttttttttttgcaaatatgcattttccctccagaactgttactggtaactatcctgagactcaagatgactttaaataacacttttttaaatactatacttagttagggttagacttggctgcaagaaacagaaaattcataagatcaggagcttaaatgagatacaactatatttttctctttgaattaaaacttgagataggcattccaaagctactgtagtgttccatgatgtcagggatccaggatttgtcagacatagcttttgtcctcatgattgcagatggagcataaggacaatgtgttatagtcacattccaagcagaatgtgaaaaggtacaattatttccttgtaaggaaagttcccagtagttgtggtacaactgtgctggttaattctatggatcggtgcttagtcagagggccatgtgtggctgcaaaaaaggctggaagatacgatacagtcctttttcttgtggccatgtgtccagctaaaatttatgtcctctaagaagagaaaaattagcagtattttgctctcaaacattaattttaatatatcctatattttaaaacactgttgctgggtagattgtgaactacatgtgggcaaggactgtgtataataaaaaatattatgttgtcagctcttaacggtgtcagcaaaataatgaataaatattcattgaaaatgtacatggagagatggtatttttatcatgtgaaatatgactcaaaatgagactgattttttacattttaaaacaaatgcacccaaccattgtttattcattcagtaatcactgagcgtatataccgattcattaaagtatcatttttctttctttaattaaaaatcttaaattgatatataatagttttacatattcttggagtgcatatgatattttgatatctgtatttaatgtagtaatgatcaaattagagtaactgggatacctattacctcaaacatttattttttctttgtgttgggaatactgcaaatcttctcttctagcgattttcaaatagacaataaattattgttaattataatttccctattgtagagtcaaatattagaacttatttcttctatctgactatatttttgtgccctttaaccaacttctcttcatctgcctctcccttcctttccaagcctctggtaaccatcatcctactctctatctccctgaaatctacttttttagtttttgtatataagtgaaaatatgtgttgtctttttgtgcctggcttattttacttaacataatgacctccagttgagcaaatgacagaatttcattctgttttatggccaaataatattccattgtgtgtagctataccacattttatctatccattcatttcttgatggacacaaagagtaattccatatcttggctattatgaatagtgctgcagtaagcacggcagtgcagatatctcttccatatactgattttctttcttttggatatacacctagcagtgacattgctggatcatatggtaattctatttgtagttttttgaggaaactccttacttttttccatactggctgtgctacttttacattttcacaaacagtgtataagctttcccctttctctgcattcttgccagcatgtgttattttttgtctttttgataatagctgttctaagtggggtgaggttatttctcactgtgttttttacttgtacttttcttgatggttagtgatattgaaaattttgtaatatacccattggccatttgtttgtcttcttttaaaaaatgtctatttgggtcctttgcctattttttaatgacattattggtttttgctattgagttgtttgggtttctcatgtattctggtgattaatctcttttcatatggaaagtttgcaaatattttctcccattttgtaagttatctcttcactttgttaattgtttgcagtgcagaagcttaaaaagcttaatgtagcttcatgcaatccaatttgtctattgttattttttttgtttttgttgcctgtgcttttgaggccttaccccaaaaatcttttttgagaccaatgttctgtatcatttcctctggtagtttcatagtttcaggtcttacatttaagtgtttaatccattttgagttaattttttatatggtgaaagatgagaatctagtttcattctcctgtatatagttttcccaacactattttttaaatttatttttcatttcaataggttttgggggaacaggtggtattttgttacatgaataagttctttagtgttgatttctgagattttggtgcccccatcacccaggcagtgtacaatatgtccaatgtgtaatctttcatccctcacgccactcgtactctttcccctgagtccccaaagtccattgtatcattcttatgcctttgcgcccccatagcttagctctcacttatgagtgagaacataccatgtttggttttccatttctgagttacttcacatagaataatagtctccatttccatccagattgctgtgaatgcaattatttcgttcctttttatggttaagtagtatcccatggtgtatgtaacatattttctttatccacttattgattgataagcatttgggctggttccatatttttgcaattggacattgtatcagcaccatttttaaatgagactacatgcttttggagctttttctaaaaatgagttggctgtaagtacatggatttatttctcagttctctgttttgttccattggtccatttatctgtttttatgccagtatcatgtggtttgtgttactatgactttgtaatataatttgaaatcacatagtatgatgcctctgcctccagctttattctttttgctcagaattgctttaattattcaaggtcttttgcgattctatagaaattttaggattgtatttttcatttttgtaaaggatgtcattggtattttgatgaggattgcaatcagtctatagattgctttggatagtataaatattttagcaatattaattcttctaattcatgaacatgggatatttcttcatttttaatgttcttttccatttccttcatcagtgttttatatatatatatttttttttgtggagatcttccatgtctttggttaaatggattcctagaattttttttgtagctattgtaaataggattgctttcttgatttctttttcaggttgatctctgctagtgtactgaaacactactgatttttgtatgttgattttgtattctgcaactttattgaatttgtgtatcagatttaagagtttttcgtggagtctttagatttcctaaaataaaaaatcgtatcatctgaaaacaagaataatttcacttgcttttcaatttgtatgccttttctttctttttctttcctaacagctctgactaggattgccagtactatggtgaatggaagtggtgaatatgggcatctttgtcttgttctagatcttactgggaaggctttcaattttaccccattcagtatgatgttagctgtgagtttgtcatatatgaccttaatcacgttgaggaatgttccttctatacccattttgttgacagttttcatcatgagggctgttgaattttatttcatgcacaagtgttgtttttcttatagtgacttctttaaccatttatcaagtcatgttttggatttctccttaaaaatgagtctcagacttaaggttcaaaacacctatggaaataattctctttacgactaatttttctctttaagcctacttttcttcatttctcagagaagttatcttgctctgataactttttaactcttcctaaaaatcaaatctccccccaacaagatggagatttggtcctgctgggggatttttaagtaagggctgttagctgtgattgaggtgcctgtatatatgagacaaggagccttaagggactaggatcaaattaattaaaagtcacatttattgagccctgccattgaagaatttataatgtcttctatgcaaaccaattcattggtaaggaacagcattgctattctcagcattttggaaataccacaatgttggagtcgtctcagaaggatctctgaagagttctgggaaggtgacagtcaacagcagaatagcagctgccaccacagtcaagcagttggtttgcttggcttggaagttttagacatcaaaggagtatggcttcttcaatactaaaaccagtgacaaaattgcaaaagttatttttattcctcttcaaatatgagcaaacattactgtgattcagcttatttttatataatgttacagggaatcaaattaagaattaaatgcattttttggcatagttatgtcttgtaaagaaagaaagatggtgccaggggaattttcctttcaaatatgtaaagaacttctaatgagtgaacctttcctgtgtcggaaagatagcattcacctcctttcctggcttctgtgccaacttacgattgtggtgtgtagaaatttagtgtcagccactgaaagaactatttcctaagatgatactgctttttactcaaggaataagtaggttccctttgaattgacctgtgtgtgtttggaaaacaagcttaaatatctcctcttctcataggaagaacactatttcaaagagccattttctttcctaacaaagaaattcatactgcagaaaaatcagcaatttcacagctggtttttgaaatcctgaaatgatgtatacaaatcaaagcaggagagattcatttggaatgaaaggaatatttgaattgcatcccagtttcgaataggatattgtttcacggttctacagtattataaacatgtcatgtctgttatacatgacaatcatatctcatctgtgactcatgaactttataagaaagtgacaatttgaaagcatagaattgcaggattggatggaacgatatcttctaagttatttccactccttttcccatttttggttgaccatgctaattcccctctaaaacattcttctgtagctacttgaaaacacccattgcttcttaaagtaacctattgtcaaagaatattggattttcttatgtacattgaaaaaatgacactttattggttttgattctaccaccaagagtcacagggaactttctatcttttcatcatatatataacaggcttttcatcttatatgtaacagtccttaaatattttcatattgtaataatttcctatggaacctgttgacttttacgctagagttatagtgatggaggtaatgagaagtgatcatattctggatatatggcagcagtagacagaaggtgtggttcataggaattgatcatggaatggatgtgggctgtgagaaagagcagtcaatgtttttgacctgaagatgttttactaacatatgttaagcatttactatctgctcaatatactttgctaggcattgtagcacaattaaatgtgcatttgcatagctgttcgatgatacaggtaggactattctctaagactaagagaacattagtcaggcctcttatggtgagggaggggttccctttctttccattctcatgctttgacttgagagagcaagcctatatgttattatggatcagaattgagatttcatgctcagttttaagtctaaaaatatgcttttcaatatctagtatttacatgcgtgtgacttctcaggaattataacgagagcctgaaaaattaccaggggcaacattttcagtccggagatgttataccccagttactgccactaaattttaagctccttgggagcaggaatttgattcttttattatattaatagtatctgttacataatattaactcagtaaatgcagggtatgctattgtaaaactatagtctcagtctctgtaagtggattttttaggatagactaggtcctagttaatgtgatatatctctatttctgtctatctatctgtctacctacctacctatgtatcatctatttatctgtcaatcaagagaagaaaataaagaagcactcttggagaatcaaaattttttataacatggtatgcaactcccttacgttctttatcagccacctgcatgcaaacagcattatgtctgaagttaaaacatgtaagatatatgagagtggaatccttggtgcatttcactcttgaactcttgtctatggagtaagtagcctgggggtagtttctcctcctttttatatatgtggggagaaggaattaggtggctgattatcttgtgctaaataggtttctctgccgatccacaaggtggcagggagtccttagtgccactatgacagattaaccaaataggcatctgtcgaaatgtctgatgcattagttgcactgcctgtaaaagagatgggcctccttgagaaataaatccacactgaatttcaaatgtggttgtgtccccaaaattagcaacgttttcaaaggtgtacccttcaaaggagagcagaaataaactgtaccttaaaagaactagtgctcagaggcctttgtttaatcaatggttagtttggtggtgattgcacaaattcactacattaaatttaatcagggatgtttctggtatgtgggtggcatgcttactgattaattcatttatattcttgaaataacatatgttctcctggatgaatttccacagtttggtaattccacagcatgcatttcagcatctctaaatggctgttttgttcactgtcccagagcctaagacatgctgggtgctgggtactgattagtttaccagactaagaatgacagacaggaaatggcaccattttaatctctcagaagaacatcagaggaatcatttcggtggctgtaaatacttcaggattttgatgtcaccttttcaagttgctttaagaaatcacttaggaatggtttgggagaccatgatacaatgaggtcccgcaaagaattacacctttctttgtcagggttctgaaattgattaagtataactatgtccgtgatgtaatcgattacattaaaactatcattttggagaaaagagacctgatggattacagagtctctacccttatttataaaaaacgatgaaatgaaactcagtagttcattgacttttgtagatggaaagatagtttgtagtagagctttgcattcaggactagtagttgccaccaccccccgcccatcccctattatagccagtttgtttgtttgtttgtttatttatttatttatttatttatttatttatttatttattttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatttatttatttactttaacttttattttaggttcaacgacatatatacaggtttgttatataggtaaattagtgtcatgggggtttggtgtacagattattttgtcacccaggtactaagcctagtacctgatagccagtttaaagtgtgtacattggggaagggggggaatgaggttgttcttagacagttagaggcacagagggtatatatatatatgggattgccttatgttaatacatcacttggctttaagtgtgggaatggacaggagtacttgttatgacctgtggggccctactttccttcattctcagagagattttgcaaattgcctaaaatatctgttaatatgctctgtggctacatgcttacagacatgatgacaaggaggggggaaaatattgttcattgttgtcattttctagctggaaccatgagatttgcttaaggaagactgaaggctagtgtgacagaaaatggagctcaggaggacccagaataaattacattcctttggagggtcctgagaggggcaggccatggcttagttccttctattccactcatttcttacagttcagctgcctcccgatgtgcagttgtttagtatgcaaatcaataatcattacctatgtgaagtgttagttcacaggcgtgcaggctgtggtcagttggtacctgttccctcctaaagaactatctctgaagttgaacatctctgtttttctttgtataaatctgaatattaattagaccactgcttattaacttagggacctctctgcttttggtgacagtagcaggcagaatatagatggtagaaaacgaaatatcatgctgtttctgtaaacggtttggtgtctccatataataaaactctttagaattaactgcctccagaaacagggacaaatgtgatgtcctttctctgccccttgaattaaataacaaaatgaacagcagatcattttgatgttgctactccataaagatcattttgttattgttactaggagagagtggagtgtaatggaaagaatacatgtttacagctgggctgtaatcttggatcttctgaaaagtaagaatatgttcttgaaggaacctcaaattttgtgaatgtgcttattattttaaagataattacatggattcaatttctgtctccgtagtaacctgctgtattatctttctctagctatataatctctctttgcctccatttcttcatttgttaaatagggataataatagcacctatatcataggtttattataaaaaatgaaatggattcacatttttaatgttctatgtaattacttatcattgttgttttaatagggaaagtattggttatataaatagccaagaaaacagccaactgagacttttcttcctagattaccttggttatatcagtgcttctgggtgtggtcactgatattctacagcagaaacagctagtggggtccccaactaaagaatgtatcttattggaggctaagaattatgaggcaactatctctgacttgagaaccctaaccttatattgacatctgagatttattcatcaataaacacctttttgtaatccagaatcatgttatgtcattactttctatatcagaatttaaatgttaagggaccaagacattatgcaatgaatactaaaatgttactaaaatcatgtgttgtgaagaatatttggaaatatggaaacatgttcacaagatgttaagtaaaaaaacaggttagcaggttgtaaaacagtatttcagtatgattctaaattgcaatcattaaataattttataatcatgaaaaatgttattaaaatattataatcctgtgataaattctaatgagtactttcttgatttggctttaacattttccaaaattaaaattacaagttttttttctgattataacagtaatacagcttactactgtagctattacaagcaaaatagaaaattaggtaaagatgattaaaatcatccacaatcccagtttcttaaaatggccttactaagatttttaacaaaaatttactccacatatttatttatgaatttttatatgcaccatttctctaattttcctaaatggagtttataatatctacctgttttcactcaataatatattgaactatatgttgaccctcatcattgtcccaaagtttaaagtcattgaatagagatacagcaatcacttactgatggagatgtgtagtttggttgtcttacaatttgtacattaaagttatactatgataaagatctttgtgcataccaatttaccctaccaaaagatatgagaatatttccagttgaattttaaaatgaaaacctcattattcttttaacttactctcatttgattattgaggtggagtatttttccataggcgtctttgagcccctcaacttgacaattgtattgacaattattcactgtatgattatcgtgattattgcaattaagtgattacttatggtttctcatttattggaaggagcattgtaagggtagcagaaacactacagagcctttttttttttatttaaccactctcttgccctggacatgaggtggtgattggactctcagatgctgcttttgtaatatcgcatggtcaaatcaagccctatcaaagtgccctgtcatgtcctttcatatctccttagggttaagtatgtccccaaagccctgcgtcttgaggtaggcatgggaattatcttcaaaaatatcaacataggatataactttctctcttagattagctaagcttagaagaaaaatttctttgtggtcaaatgtttctgccatattaaaatctacaagtcaggtggtgaccagattttgtgatgccatccaaaaggttttagtacaaatttttcttaaaaatgcagtaagtaattgtaaactgtgatacttttaaattatctgcaagattattccatgaccatttttaaaatagatggtttttctgttgtggtcttagttgtcattttatagttgaccccacgtgtaacttttcgaagactctcaggattcccttcagtcctattctgtgtatctatctagtcattgtcccagtgaaatgataaaaggcccaactcagcttgttttgcaatgtgggcaacaaacatctcaataggatgtgtctcttccagttgtttttcttgtactattgatgtcttatggggagatatttaacttcacttcttggtcttattcgtagcaacttccatgactgatgagccagttgaattagtctttgggatagtcactaagtagatgggaacaggattttcttggttggaagtccatttcttgaatattcaagtttgtttgtcctagaaatttaattgactgagcctgcctagtaaaggaaatctttgtcatgccagtgtgaagttctgcttcccactttactattttcctcttaatgcagtactaatatatgttgaaccaaaaacaaaaacctgggcttatagcataacacacctggtattaaattgtggtaccaccatttgttatcctggttagttaacaactttctgaaaataaaataaggataataatatctatcttaatgtatctttttttcttatgaggtatctaagatagaagaatttctttttctttgccttcgcttaatagaggttagcattattttattttatataaacatagaaataaacatctgctggaaactcatttgagagaaaacaacccatgttggatcttagggaggtagatacacttttccattctttcttcaatctacagaggttcatgtcatacccacatcttcatctaaaaatcaaggaatgaggctggataccgtggctcacgcttgtaatcccagcactttgcgaggccgaggcagacaaatcacttgagctcaggagctcaaaaccagcctgtccaacatggtgaaaacctgtctctactaaaaataaaaaaattagccaggtgtggtggtgggtgcgtgtaatctcagctactcgggagactgaggcaggagaatcacttgaacccaggaggcggaggttgcagggagccaagattgcaccactgcactccagcctggacgacagagagagactccatcaaaaacaaacaaacaaacaaacaaacaaacaacccaggaatcattctagacattatttgtttctcaaatctgtaattgttttaggatctatgtttgttttcttttcaccaaaactaaagaaacactgttccttatttgctttttttttcctcagtctggctacttacttttctccctcatagacaaatgctaacaaccaatgaatcaccatatttctcctttattaaagctgtctccaatggcattctcagcaagttaaaatgtcaagtatatgggcctttaagaaaggtttcaaaagatatccctggggagggagggaagagaaatttgaggagggaggagggaagccatgtgacctgagaagcaggaattctgtacataaatactgaagtttactgtcaagcttccgagtaaaaatgttaaatatttgcagtgtccacaacccatgtccctgtgataaggctggttaattcctagaacataatgctaggaattcaagaatggggatcatatcctgagtactgatgatccatcttgatactgtgtcaaagggcacaggatgaggaatggaagggtttggagagtgagaataaattactgcaaatccaaacatctgactggataaactactccaagtggatatcatttattattcactccatagaaagattagaatgtacaccctagggagattaaggtaagagtaagagagatgtctaaacattttatgtgtccatcatctacgttgcctgtttatcagagtctgtcactataatgtttactgctgtaagtggttaattatgaatatatcagctgaatgctttcatgtcagttgagctgtgcagttgccacagtgagcactcttttcatgtggacttttggataaaccagcgtttagagattgtgttttataaattatatgaccaaattccaataccacatggagaatacgtgatttatgtgctaattggatcatgtccattagacatcctcataactatcttttatcggcactacagtttttatttactaaaacatagtcacatgaaagtttcctataatagtattctacactttctattctctgactcttaggaatcactactccttctgaactcctttagcaatgaatttcacaattatatattattaatgtgaaattcacaattatatattatatacatttaagtatatgcagtgagtttcacaattacatgttctttcatgtgtttatttttctcatcaaaaaattaaatcttggccaggcgcggtgggtaacacctgtaatcccagcactttggcaggctgaggcgggcggatcatgaggtcaggcatttgagaccagcctggccaacatgatgaaaccccgtttctactgaaaatacaaaaattagccgggcgtggtggtgtgtgcctgtaatcccagctactcaggaagctgagtcaggagaatcacgtgaacctgggaggtataggttgcagtgagccgagattgtgccactgcactccagtctaggtgacagagccagactctgtctcaaaaaaaaaaaaaaaaaacaaaaaaaaatattaaatcttgatttgaaagatttgaaatatcaggtgagtataaaatcattggtaattctaacaactgaaattaataatttcaaaaatattgctttttgtatgtctataaacttttatatattgaaaaaacgtatatatgcaaatatgttgaattcatgtcatatctttttaacattatctgcattataattttgaatatctttttgcttaattaattaatttatttttattatttttttttgagacagagtctcactctgctgcccaggctggagtacagtggcaccatcttggctcactgcaacctctgcctctcaggttcaagtgattctcctgcctcagcctcccgagtaggtaggattacaggtgcaagccactgtgctcagctatttttttgtatttttagcagagagagggtttcaccacgttggccaggctggtcttgaactcctggcctcaagtgatccacctgcctctgcctcccaaagtgctgggattacaggcgtgagccactgcggcaggcttctttgcttgatttatgatcttttaaaaaatttgtcatgctgggtcaattaagtggtaggtatttagaaagtaagactcttctattttttaggatctctgtggcatagtgcattgcaagtagttctcaataaatagcttttgttgtaaactaacacactggttactttctaaagtcatttgctcttttaaaatccctttggtatactaatctatactatatcactatacttgtagaccaagggatttgtctggccaacatggtgaaaccccgtctctactaaaaatacaaaaattagatgggcgtggtggcgcgtgcttgtgatcccagctactcaggaggctgaggcaagataatcgcttgaacctgggaggcaaaggttgcagtgagccgagatcgctccactgcactccagcctgggcgagctactgcactccagccaagggtttggtctacaaatatagtgatatagtatagattaattcagttgctttaaaaaaatccatatgccacaggatggctcaggatatcaatctatatcttagaaaaattattatacaaataaataggcaacaagattgagaaaaactggtatatttggtaaaaatacaccaaaaaagcaagagaggaggagggagatatgtgttttagaacccacacattttcaccaggtgaattttaaaggctataagagttcataaaatcttagcatcctgagtcatttgagagtctgataaacatcatttaaatacgtaatttaattgtttctcttttcttgttagagaaaggtggtgcaaacttattcctggaagacggtcagccatattaataatgagcaaaatgcctattgagttggttttttaaatactaagaaaatgacttttgaagttaaaacacatgctaactgttgcttagttttaaatatatatatatggagtggaacaaaagttcccactcaacagcttactgaaaaatacaaaaaggaatgcagttttcagcaggttctatttgccataaaacattttcttttcttaccattgttttatttttttctttctggtctccccctcttgccaacgttcacagctggacatctttgtccatctttcaggtactttgtgttgcatatccgtacgtgaaacacatatatgcataactattcaggtttccctcctgtctccattgttggcagaattctcattcaagttaacattaatatacttttttgctcttctcttcctcctggtttgtccttttgtcacttggaaaatattgatttccctccattgtaggtgagatgcacctacatggctcatttgtgcttacttccttcttgtttggagactcagcaagttcagcacaatgctatttattgaatttatctgtcaatttcttcttccttgcatggctgactaattcagtggaatcagcacaataccagaagcacagaggataatggcttaaattttttttttcgcagaaaattgtaaatcaaaagtagagactaaatttgaggaccaatcccttcagaaggttgcaacttgtaaagtgtgtgcaggactgtctaggtgaacatggcaacagatatgattttctaatggggcacttctcagcttttcattaaatgtctaagaaatacacagaaagacatgaattggcagcaggattgtgaaataaaaatgagaggagcctctaacataggcaaaaactttcctccaaacagacaaacaaaagcgtataatcaatgaagaaataaaaatcagaataacctcattttcttcacagtacaaaatactaaaaaatcaacagagttattttcatgaatggcttagtctttggaattggctttggacatgcattcctacttcacacatcccagtgaacctcagcacattagctggttactgagaaggtaggaaagtaaactgacctttaccttttgtgaactgggtgctacttactaggatcttactggtctctttctgccaaggtcagctcctcttgtgttacaacagagaaacgactaatctcagaatgtaacatgttttagataagtggtatggagaagcagtcatgcttagttgttgaaagagaagtatacagtatgcacaagtgtatacttttgtaagtttttatgctgttcaaagaagaactttaagatactattacagcatagtcattaagagaaaagatgttaaatagacaagatgcttttgaattgcaagacccctgtgcctaatcctgaaaaagttttctaacttctttgtgccttagtttcctcatttgtaaaatggccattaaacacttcataatattactgtgaggattaaaaaagtaagaactaagtccagtgtttggtaactgtagtaagccctagatggatgattgtcactactgttatttaccctaaataaattcaatatttatctttagttattattataccacactgttactaagttaggcttagaaggaaatgactccctgttagctttgaaggttgagctacaagatcatgcccatcaagttaaaattaaggttttgacctgacaattgaaggtgcaagcctagagagattaccttccacataagcttaatacctggcctaagtggcttgctcacgttatctaagtagaaacaaactgaaacaaacaaaactaataatcaaaactaataaaaacatccaaataaataaaattattgattcaggcaaggaataaggattaataaatttgataatgaggggctggataattgtataatgtcaaggtggaatcacacgtgtaactttctaatcaaagaaaaaaaacacacactggagagatcctactatttccatcctattccagtagtcagtcagttgttatatgccctgggatataatgcaagatataatgagcaactttcacaatgtagtctagtcaaaaaagttttaccaacatcagatcattaggagatacaggagatagaagaacaagggagacatcatcacatggatgcaatcagacaaatgacacgtgcgagacattctgtgaaacagcagacctggtctcttcaacaagtcactgtctggaaaaaggactgaactatattaagaatgactgaagaaacagaatcagatgcaatgattggtcttgaattagatacttattttgtcaaaccagatgaaaaggcatttttgacaggattgcctgtttttgtaacccaaaatatgcattgaaaaaaataagcaagacttttgttaaaatatctttagacagaattttggtatatatatatgatatatatgtgattatatctacatatatctatatatatattctgtctaaaaattctcacaattctgtgtaaagatattttagacagaattaggagatatctgtatctagctctagatatagctaaatatatattcctttatatatctataaatctatatatctagctatatatatttagatatatcttgctctagatatatatctagctcttatatatagagagagagatagatatagagctaggtatagatatataaaggaatatatatctatatagtatgtttatgacctacaagtattcttttttgatcaggttttcttgaacatcagatatatgtatataccagaccattcaacatgcatttatttttttatttttatctttaaatagagacagggttttctcatgttgcccaggctggtctcaaactcgtgggctcaagtgattcacctgcctcagcctcccaaagtgctgggattacaggcgtgagccactgcacccagtatcaacaggcatttataagcataggtataatctagtgctcttgattgattaaaagtatattttgagaattgtttattgtgattgcttgaaaggtgattattataaaaatgagtaaaataatgaatcactactcccttttttgtttcttattttgtttgtttcttccttttgtactcaagtaacaaaaatcttaatttagctctgaggatacaaatgaagagtaatgtttcttgcccctggtcccacagttagtgacagacagtcactaaaaattgaaatgcagacagtccaatttcagaaaccatgctcttgaccaatacattgaagggtctttagctattagctgcctataaaatatgtggtcataaccgtagagaacacagcaaaataccacaataaaaaaggataaatgaaacttcactatttttcatggaaaaacccaacttgtattgcctgcttcctttgtcagctttgagaacttcagtatgaagttttgtacctatagctccagctcctgaaaaaattgttccaaaagcctcaacaccagttaaattaagttcctgacagaagttggaaacattatgagaatgacacacatggtttttgttcagatcatctggggaatgcacgtcacactggcatcaacctccaacagagccttgggatgacagaagcagccgttcggaggaggcctctccttgctctgttagtgaaaagttgagatttggatggtatttttcacactcttgacagtttatgacacgctgatgggatgaaacagagagactgcatactaaaagttggctgtgacctaacaagcaaagttacacaagtcatccctggtcacataagaggtttcacctcctcatttctaaaagctaattattactagctttttgtgattaccagatatacctcttccattttttatacctcctactctcttaacatggacagcattgttgaactcaggatctgaagtcagacagcattgtcttctttgagcctcaatctgcttgtcaatgaagtagggatgatgacaattctttccatatagtgtagttgtgagcatgataaaatgcctagtacagggactgtctagtaactcctaaccacaactattatgcttgttagtccccatggcctatttattttaagcccaaagcatcttctggagctaagcactgtaatgcccttgaagtgttttttaatctcttcagttctgtctactgcacgttgtggtcttacactgctcctggccactgttgagttattcctaaaggaatacagcaatttcagaggccttctgaagctccctgtcatgcctggcaatgtcattatataccaactgatacgtttttacttttcccaattcttgacaaccttctatagtagtatttcacatatctgcttggaaaaaatatttgggtaacagcttttggtattgctaggtgttttcggttttcttcttacctttttgtttatcgtagtataattataggaattaattaatttgtcgaattgtgttatttctctgctcgtctagcatcatcttgctgtatggagataaagagcagttaattttgagtaatatactagaagtttggtattcgtgactctcatttttggtgaaccactctactgactcaaaaacaaagatttttatgtgctttgaaattttaataatcaggtaatgtctaacatttcacattttctccaatagccactcttttttgcttttatttttgcatataatcctgctccatttctaaaattgccctttgaaattttcttattttcctacacattccagtttattactatgtggaagctgataatatttatactttgttttctaggaggtcattgatataaaattttattttatggttgattttcttgtgaatgggtgttttacacaattttcaagtaattggcgtggattttatgaggccagtcaaatgtagcaaacattataaaattactgaaaatgtatcagtgatgacaaatatttaatgattggtttattttgattggtcgtagttccatttttctctaaggcatcttccttaaaataagcatatataaatgacctttaatgtatacagcatgcattttttcattctctagcaatgagagcaagcacataatgttgtgatcactgttagcccatctgtgttttaacatgctctccttagttttattctcctgtgttgttcatttagtatatggcctcattcttccacttttttttctgttttgatgaatagtttggataataatgactgacccaaggtgtgcaaatgatttaagcaaacaaagcaaaactattccactgtcttttgaaatgtaggcttcagggtatcttgaattgcattcaaaaagataaaactcttcatcagaattaaaaacatacgtttacacaaaatcatgtacacaagttcatagcagcattatttgtaatagccccaaagtagaaacaactcaaatgttcatcaactgataattcgattaaacaaaatctggcataaccataaatggaatattattcaggcataaaaaggaatgaagttctaatacgtgttacaagttggatgaactttgaaaatatgctaagtgaaagaagtcatatacaaaagacttgcaaggttctatgccttcatgtatatgaaatacccagaataggcaaatccatagaaacggaaagtagattagaggttcctaggagccaggtacagaggggaatggagagttattgcttaatgggtatggagtttctttagaggaaaaaattctggagtggtggtggctacacaattttgtgaaatatactaaaaaccattgaagtgtatgctttaaaaaggttaaatggtaaatgttacattacgtgaattttatctctaaaagcattttaagagaagacattataataaacagagagtacaaagatcagaagacaaaagaaattggtggaaattatttgacattatgaagagcattgtaagtctcaatttcagggagaattgaccataattgacaaaatattgcataaataatatcagggatgcatttggataagaaacacatattacaatcctttataatgttaacttagtatgtattccagtttccacaaatgcactccatctcccccaaagtataggcaagtagtccttgaaagttggaatggaaagattaagcaacattttcataaatatgtcactgaaacaggctcacaaagcagtacatgccatataatgggaactggggtatagaagagaggttaatcaatgctgtatagctaaactggaagtaaagagggatttcataagagaggttccctttaaacttgttttggaaggatacataggagttctccatagtgtggataatgagggaacaatatgagcagtaagaactttcatctaacctttaacttctttcttctatccagaaagggttagtcaattttgcattgagcaccatcacccattccctaaatacaattcaaacggcttacaatccttgtttttttggtttggtatgtaaggtttagttttcctccaacttctgcatttctcttcaagggaggccattaaaccctgtttttatttctaatctacaaaagctaaaaaagcatatttccctttatgaatttttcatatgctcatctgatgcttgtgtgctctctgcccctttgcctggcctgaaatctgcttcttacttatctagttcatctcttgctatttgccaatgcaaatgtgggctaaaaccagctgaaacagtaagggcatgttagcagagggaaaaaggaaaggaaaaagaggcaaatagagtaagtacccaaagaaggaaaaagagcagagatcatagatggctatatgaggttcaggcagaggaattaaagaaagtgaagaaatggttgggaagaaattagaatgatgcctgtagactggaagcagtgaaggaaacaacatcagaaattggggcaaaagttaagaataggaaataagcttttactttttaactgtgctgcaaggatgcaaaaccaattaaattatttgaaaatgtgctttattttaggccaatctatagtatacatatcaaaacttagcttgctctggtgttcaaggtggctttatactgtttggctatcctgtgtttattatgccattaatccttttaactggtctggaaggcaatttagttttaagtcagttacttttttgaaatgaatcttatttataccaaacttctcatgtttgcttgaatttaatcaaatttttatataaagtgtaatttcaaggaatttataatggagcatcaagggaggagttggttatgtaatcatacttttgtaattttctattgtggagaaatttatctgcttagttattgaaatcaaattcctgcaatagagctattaaaatgggctagcatcatctttgagaatgttccttcttaaaggtaatataaattatatccaacaggagagaaaaagttaacttatgaggtgagtagactaagagtcattaaaaaaatcttgaggaagatttttaataatatgtaaaatatttctgatgtggtagcataaatatatattataggacattattaatagtaaagtgatccaaaacatataccacagggagatgacttgaaaaaaatgcattaatgcttcatcagttgttatcttagggtagtgggtaataggatagtttttattctctctatatatatttttgccagattatctaataagatacgtttttattaataataaaaagagagacaaatgatacaaattttagaatgaggactgctcagtctgcataaaaattattttcttgcaacaaagatgcactatggaattcaaaaatggtggtaactattgtcaaacatgtagagattggagttcctaactgttgcaggaagatctaagataaagtactacaagatgagtaacaaatacatccttaaaagcccatttaaggagttcttaatcgcaaaaaatttgaataggatttaatttgatgaatggtctagttaaccaaaatagtttatctggttcagttactgttgataaatatatttaacgacattgcaattgcatattattcagccacaacataatttcattaatgactcattaaaattattgtgaaaaggaaacacttaagattgcattggagcattgggatacctcacagtttgattttttcttcttcctctccctgcacattttttacttcttatatttaagtattctgctatgattttaaaaactagctacaaaggggagataacaaaatgagagccttctcatattaaaaaatatcgtttcttctcctaccccttatttttcagtgtatgttcacattaagaaactagaaaaatctagataagcagagccaaggtaattagttttctgtaattcttacacgaagagatcatcactaatgtcattttggtattatttactgagatttgttttttctacacttaaataggcacataaatacatgattatgtatttctcacactgttttatggcctgtatttcacacttggttttataatatgaacatcttccatgtcagaaaatattattcttcattatactaatggccaaatattattccatttgtagatgtatgtacttatttaactaattttctgtctcttgaagatgaattcctgcagtggaattgctgaatcaaatatgtatatattttgatgctttacggcattaatacattttcccttaagaaagttgtatcaatttatacatctatcatcctcagttaggtacatccttgctgactttgggtggcttttttattctgtttcccatttttataagcaaaaatggtattatatcttctttaattctactggtaggttgaacttttaaacatttaactatactgtatttctcggatctcctgccgtgtgtgtgtgtgtgcatacaccccctgccccccccacaacatacacatacaaatacatatttggactttaaaaaacactatgaacttgaattttttggttgtgtatacaccagtttctaattgattagaaaaatgagaaattctcttttttttaagtatataggaactaaatcaaaatattgtgaaacctgaaaagaaaataccacaaccccaagcagaaagggcttagttagctttaaaaaaactacatggttgttaaacaaggcttgtcaagctattaaaaacaagagtaacataaaacttacaatttctaaataggaccactgtttctaaatatgttaagtggtgtttaagtcagttaaatcttacagccaaaatgttgtattaatgcatgagtgagatgcattatagatgacttgataataaagttatgtatgtttacaacagagcattttgttcttagaacatagtgggagcctgaagtcttgggattatccatgatcataattgaacatatgtttagtttactctgggcaccatattttcaaagggacataaatgaactagagaatgcttaaaatgttgggacatggttaatcatagtgtcacatgagaaacgtttgaagaaaccagggataaaaaaagccggaatgagttaagattcaagcatggcatcattatatacaaatgctagatgagctatcaatgcagatttcaggttttgattgtacccctgagatggattaagcgtttgtaggtagaagtatgaagaatctaaacagttttgtggagatattcgtagttagatcaaacattcccctaaaaatgttcagggcacattgtctcactggaactctttgttcagaaactgaacatttacttagcaaggcttgttgtagagatgattttatcatttgatggtagttgaactagctaagttttacactcattttcagccctgaaattaaaacaaacttgaacaactggaggaatttatgccattatacacattgtaactctagcatacaatgcgtgaaaaatatgctagtttttttcatagcacattttaaaactgaacatttgaaatgggctgtgtataaagataaatgaggctgggcacagtggtgcacgcctgttatcctaacactttgggaggccgaggtgggcagaatgcttgagctcagaagttccagaccagcctaggcaacttagtgagacctcatctctacaaaaatcaccaaaattagcagggcatggtggtgcacacctgtagtcccagctacttgagtgggctgaggtaggaaggtcactggtgcccgggagatcaaggctgcagtgagctgtgattgtgccactgcactttagcctggatgacagagtgagaccctgtctaaagaaaagaaggagaaggagaaggagaaggagaagaagaagaagaagaagaagaagaagaagaagaagaagaagaagaagaagaagaagaggaagaagaagaagaagaggaagaagaagaagaagaagaagaagaagaagaagaagaagaagaagaagaagaagaagaagaagaaggagaagaagaggaggaaggggaaggtgaggaggaagaggaagaagaagaaggctgatctgattgactttgtgaactatttatattcatctattgttgcttgtattacattgcaagaatacaaaactaataaaaatgtatgaacttattgtaaacttggtaaattgagaataaagatctcattttttttgtgttaactttataagaatctgtgagagccagaatgatttcagacactgatgacaattttaacagaaacataggcgtttcacaatgcagtgggaaaattaatagcagaattagaaaataaattagaatagatattagttgaaataatctgaaatgcatttgaaaggaaaataaggaacagagatttcttagtccatttgtgttgctataaaggaatgcctgagactaggtaatttacaagaaaagaagtttatttggtttacagttctgcaggttgtacaagaattatggtgctggcacctgcttctggtgagggcctcaggctgcttccactcattgtggaaggtgaaggggagccagtgtgtacagagatcacagggccagaaggaaggaagagagatagaggggaggtggcaggctctttttaacaaccatctcttgcaggaactaaaagaggtagaactcactcactaccatgaaaatggcactaagccatttttgaggtatctatctccctgacccaaatacttcccattaggcccctccttgcaacattgaggatcggattcaacatgagattttgaggagacagacatccaaactatagcaagaggaagttgctataaaaacagatcaaagaaattgggaaagattgcaacacactgagatccttaaacagtttccatttcaaatggaatagataaagccatactaagtataaaacaaaatataatgaaaatgtatgttatcaaataagtggaaggattgtaagaagaatatgaatctggaaatcagaatgaaagaaaacaatacaagttttgttttgttggtaggaaaatgttggctggaaaatgttaaataaagatataaattagagaaaagagggatgtttgtcttgaatgttcattcagtgacatagggaaggtggtgaaaagcaagaaattccaaggaatagagttaaatgaaggcattttatatgagtattaaagataggtagcgaaattcaaggtacacagaaccatcttaaggtctgaaaggccttaaaaataatccaatcccatacccagtgaatggagcttggccctatattcttgagaagtgcttgcttagtatagactcaaaagtacatttcttataaggctatacatttatagttttaaacagcttcccaatgcctatcatacattcgctttagaaatattttagaaatattattttaaaaagaaatattttagatgatttctaacatgaatgatggagtgataggtacagggaaggatgagagaccaggtcccctaaaacccagagagactaaatgtcatttgggacttttgcacagaaagaggagcatggatttgacctatgtttctcattgcatagagatatcctaggaagatttcaaaacttttgtatgtttagttttctcatctgtgaaatggcgataataatagtatctataagacagagtttctataaggattaaatggatagtatatgtgaagaccatatcatggtgcatggcacatttatgatgttcattaaacgttgctgttaatatatgagaagggctgaagacatctgctttaagtcagcatttattgaacacagttcaggggaggaagattggattacataagatggtcttcctgtcccttcaaatcaacttgggatttttttttactttgggcagctacctttcaaccttcagtgcttcccgcttccccgtataaatataagagaaaataagataatgaagaatgaactataaaacaatttagaggcttcttgcaactatatctggttttgatctctttctaattttattccacttactgcatttctaagaatagtcattgatgtgtaagttattacgatagtggctgaataacattaaaaatattttatcatgaagtagttctttctagacatttgatgattgaaaatttcatactacctctcggaaacttggaggcatagttttcagggttacagaatgttcattattagtatttagtattttttagattaaaattcccatcttagggtgtaccttctctgagccagtcattttcttagattttgaaacttttctacacctaacacgatggagtaacagggactggatttatctttctgcccaaaataacaacaaaaatgtgggaaaaaatgaaacaacagtttctagacagtaaacaataacaagcagcacagagcattgatcccagaaacaggggcaatgaaagagacaagcgttagaattgtcctggcttacatttcaaagagagcttccgggccataatgcaggaagggggaagccaggtggatcctggaaatatccagagtgattatgagaaactgatcaggcttgtcttggtatgttatgacttgaataacactgcactaattgtgttttatggaattgacattggaacattcatatctttacatttatacgtacaacacctgttaatgaagtacttagtaaggtctgtggttgcagttacaggggaaaatcattaacgatgatggtgaagcaagaaaggctggataaaaagagagaaagacgatacgtgagacctaaataagtgaaaaaatgaggggtccattcaagagaatgaaaaagttcagtttgaatgaaatcacaattgtcaaatcagagacatgatgaaagaactacaggtaagccaggctacacagggtcttagagcatcttaaagatttgtgtattgttgcgagggaacaggaagccattgaagagtttaagcagagtgtgagatcattgagtatatactgctggggtctttggatgctaactagagataaccattaaaattttctgacttaaatctgatgagaggaaaaaacttatttccctttcaacagaaacttcgggtctgaactttgtagagtttattgtggctaaaatgaccacgtttttcaaagaaaaatcgacactataggattttttaaaatgacatgtgaaagccttacattataaattaaatcaccatctcatattcagctgcattttttaaaagaatccaactatatatattgagtgtcttggtcactttggtcctgacttatactgtagctgtacttttgaataactgcatctgtccatggccactgagaatctagaccccatcactgcagatgtgatgatatttttgttattcttatttctttgcttggatttatgtaaatttttttacccttccagcctacctaactacattataatttttttggtatcagggagtatataaaggctgtgttcgtccccagtgctaagtacagaccctaggcattcaatacattcttgttcaaatgaatcttatggagaattccaacccatataggagaattctcactattcaagaatttatctccaaattttcagcatcatttaaaaatgacaaataaattttgacatgcaattagactagcagagtcaccctagttacaactggttcctatcctctccccctttagatatttgaagaaaataaagtatgttaaaagaactcaaaataaatttttaattatgatattatgattgatgattattgaatgcatgctagcttttttccctactgtttattctatatttcaccataggataatgctaatataaaattattaaaggattaattcactgaagtccttatgataaagtatttggggatccctaaaattcttctgagttttaagtggcttatttgtgttgatttgttttgaactataatattttattttattttattttatttattaactttttttgagatagagtctcgctctgttgtgcaggctagagggcgatggcaggatcttggctcactgcaacctccgcctcccaggttgaagagattttcctgcctctgcctcccgagtagctgggattacaggcattcgctaccatgcatgactaatttttttgtgttattagtggagatggggtttcaccatattggtcaggctggtctcgaactcctgacctcaggtgatccacccgcctcagcctcccaaagtgctgggattacaggcgtgagccaccgcgcctggcgaactataatattttaatgccattttttacagtaagtaaaatattaatccatcacataattaaccgttaaaatgtctcatgcccattccctgtctcatttgtaaaaagtggtacttgtattgtcacttctacggcacttatctgtcccacacattttggcaacagattatttttcttctggattcttctctaatagtgttatatttataagcttgtctcttgcacaacagaatgaacttcacaagggcattggcttttcttctatctcttagtgaataattgtcacttaggatttattgaaacacagtaccaaacatgtattaggtaccccactgatatttgttaacttgaataagttgaatatgacaactttgttttgctttgttttattgaatttttcaggattatttgtatgcaataaaatgctcatatctgaagtgtacaatgtgttaactttttgacagccattaactactactcagataaagatatagtatatcttcataattttccaaagttcttttatgtcccttttaggtagtagtctccactgtaccccaggttaccacttttctgactttttatcccttagagtatttttacttggtctagaatttcttataaatagaagcatatagtatatactcttctttgccttcttttgctcaacattttaatattcatacatattattctatctatcagtagtgtgatctttttcaattccagatagtattctacagatgaatatatcacaatttattccattcttttgttgatggacattttggatgttcccagtttgggactactataaataaaacagttatgaatatctgctgcaagtcttgttgtggacatatgcactcatttctataggagtaaaactgctgaatgataggttaagtatatgcacatattcattagaaactgccaagctcttcttcaaagtgattgtcacatttacactgttaccaacaatgcatggaggtttcatttgtgtccacattcccactaacatgcgtattgttattcttttgaccttcacgattcttgtgggtgtatagtgctattgcactgtggtttaacaagagttcttgaggactgttgattgcagatacctaattttaagagaagtatgtgtaaattgtgcatttttcaaacatatttttgtacaaaaagcagcaattactttgtctccctgtgcctttgctattcatggaaaaacgggaatattagtagtactatcttatactgtgaccctgaagagtaaatgagataaatttagcacagtgccagacacatagtaatcactttatataaaatgttaactattattgtgagtaaaggcaatatattgttttttcatcattgttagtattattgagaggcagaatggcatagtatttattgcctgtgttcaaatcctggctttaccacttactaactaatgactttaggcaagttacttaatttccctgtgtctcagtttcctcatctatacaatgggaataatgcagcacctgtttcataagattttgtgatactaaatgagtcaataggtttcttggcacataataaacaagataaatgtgttggctgttattattactaacagggtgctgttattactttatatctttcttacgagtatatctctttaaagtagcaatttatttaaatgttttcattttagcatattgatagaatattaattttaatccagcaatccagtttacctaaatattctccaaaataaaagttgaaactttttttttaagtgtaggcagttctcttggtattgggtttgtgtcaattatctcttgctgtgtcacaaaccccaaaactcagtggcctaaatcattggccactaatttagtgtacaattctggaggtcagcagttttgactgggctctgctgatgtttaccctggtcttgaatgcatggatggtcagctctgtttctagcagttgagttgcttcagttagtggaagcatttgaaccatacatcttatcagccagccagctttccctagcttgttcccatggtggtgaggcaggccaaactgtaaagagcaaagagcagaagcaaggtctctggaggcccagccttagctcttgtgcagtgttgcttccaccatgttttattcctagtgtaaatcataagatttagggacctgagaaacagacaaaacctattgatgtcaggagctgccaagttacattgcaaaggaaaggcagaagagttgtgactttttttttttttttactgaatacctcactcaagagcttgttaagaataggctgtctctggggtaggtgcggtggctcacgcctgtaatcccagcactctgggaggccaaagctggtggatcactcgagctgtgaagtttgagtccagcctggacaacatggcgaaacccagtctctgcaaaagcatacaaaaattgctgggcatggtggcagacacctgtaatccaagctactcgacaggctgagatgggaggatcgcttgagcctgggaggcagatgttgcagtgagccgagatcgtgccactgcaccacagcctgggtgacagtgagacctgtttcaaaaacaacaacaacaacaaaaaagaataggctgtctctaattctttctttttttaattattaatatactttaagttttagggtacatgtgcacaacgtgcaggtttgttacctatgtatacatgtgccatgttggtgtgctgcacccattaactcgtcatttagcattaggtatatctcctaatgctatccctcccctctcccccaaccccacaacagtccccggtgtgtgatgttccccttcctgtgtccacgtgttctcattgttcaattcccacctgtgagtgagaacatgcggtgttcagttttttgtccttgtgatagtttgctgagaatgatggtttccaatttcatccatgtccctacaaaggacatgaactcatcattttttatggctgcatagtattccatggtgtatatgtgccacattttcttaatccagtctatcattgatggacatttggtttggttccaagtctttgctattgtgaatagtgctgcaataaacatacatgggcttgtgtctttatagcagcatgatttgtaatcctttgggtatatacccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattgtaactggtgtgagatggtatctcattgtggttttgatttgcatttctctgatatccagtggtgatgagcattttttcatgtgttttttggctgcatgaatgtcttcttttgagaaatgtctgttcatatccttcgcccactttttgatggggttgtttgtttttttcttgtaaatttgttttagtttattctagattctggatattagtcctttgtcagatgagtaggttgcgaaaattttctcccattctataggttgcctgttcactctgatggtggtttcttttactgtgcagaggtctttagtttaattagatcccatttgtcagttttgtcttttgttgccattgcttttggtgttttagacatgaagtccttgcccatgcctatgtcctgaatcgtattgcctaggtttttttctagggtttttatgtttttaggtctaacatgtgagtctttaatccatcttgaattaatttttgaataaggtgtaaggaagggatccagtttcagctttctacatatgactagccagttttcccagcaccatttattaaatagggaatcctttccgcatttcttgtttttatcaggtttgtcaaagatcagatagttgtagatatgcagcattatttctgagggctctgttctgttccattgatctatatctctgttttggtaccagtaccatgctgttctggttactgtagccttgtagtatagtttgaagtcaggtagcgtgatgcctccaactttgttcttttggcttaggattgacttggcgatgcgggctcttttttggttccatatgaactttaaagtagttttttccagttctgtgaagaaagtcattggtagcttgatggggatggcgttgaatctataaattaccttgggcagtatggccattttcatgatattgattcttcctacccatgagcatggaatgttcttccatttgtttgtatctcttttatttcattgagcagtggtttgtagttctccttgaagaggtcctttacatcccttgtaagttggattcctaggtattttattctctttgaagcaatttaattatttcagtggaagttactaaagaacattgaagtttgttagaaaaaaagaggatgtcactgtaatataccataattgacaagtaataactatttgagtactaactggaggagaccaagcttaaatggttattcctgggaagaatgatttgtctcagggtgcgtagatacaaatgttaccaacccaccatgacaaagtttaggcaaatacaaagagcaacactaactttgatattgtatagaacaaaagggcacaagaagaataaaatggtccacagatattgcaggtgacatgtactatatgcaacaggtgtttgtttaggttatgttatcaccctttgctctgaaaaaaaaaaacaacaaaaaactataattccaatgaggtagaaaattggattgtaacagaaaactcacctttcagatgttcttgaaagatcttcaatgtagtattctaaaagttctattgaattattttaaaccatgttatttctattttcttctgaaaagaactaggtgacattaaagaagtctggatagaggaatggaaacaatttcaaaaagtctttcttcaggcctttgatcataggcattattttcaatttggatgaactggggtattctgactacctaagaagtctattgtcaaaatctgaatttattctgcaatataaattcagtttgggtactttaaatgtcaaccgtaatgtctttcaatcagtttattactgagatttttccagatttgatgtgtggtatcaaataacttacattatttgcaactatgagaatgcacagaaagcttcgtaatttacatctaaaaggaatgcaggacagatttggttttagttttattttaaaattttcatcagaaggaaatcatctgtatacatcatactgttgaatatttccaaatgatgttaaacattctgatgctttaacaattacattaaaaattacagaattgatttaagattgtgttaagaggttatgttgttgcttttgaaaacagtgagataagataaatcagattccatctcctcagtgctgcctatgctgacctgcctatataaaatagcaaatcccatacatcgtctgtctgatttcaccctgcccatttaatccccacgcattttagacttataaaatactgtatatttttcttacttgttatttttattttccgtctacctacaaataaatttgagcttcatgcgaccagaggtttttgattgttatgtgttttggtttgcttgtttttgtgtgttttgtttgtttgttttgttttgttttcttttgttttgtctgagacagagtctcactctgtcacccaagctggagtgcagtggcacaatcacagctcactgcagcctccacctccttgggctcaagcagtcctcccatctcagcctcctgagtagctgggaccagaggcacatgccaccacacctggctaattcttataggttttgctagagacagggtttcactatgttgcccaggctagtgtcgaactcctgagctctagcatcctgcctgccttggcctcccaaagggttgggttttcaggtgtgagccagcgtgcctggtcatctgttatgttaagtgaagaatacttagcagctggaagagtgcttggcacaaagtgaacactaggtagatgttggttgaatgaacaattaggttgataaatgaaggcatttaattaagaatgtaattagtagcaaatcacctttaaaaatatatctcattttatgtttaaaaataattacaaatgtataattttaacctcctcctttaaggttcttgtcgtcttgtcagtcgaattaaaatctagccttaacttttttcttgaaatttaacaggcttattttcacacctggcttttgttcttgtagttgtaattagtcagaattagtatattaatttttaaacacacactacctcatcttttgctctacttatcaaattatctaattaaaccttgaattttcagaaaatagtttcccaattgcattctgtgtatatcaaaatgcccttgaaaaaaatggaatttgaaaatttctttcttctgtcccccgactcttgcctctttcttagtctctccgtccatatatctctccttttctctcatacaatttaatagagaatgaatttccatctttggtacattcatattaaaaatctaatgccacatatgtggaggaaaaatcatatagctacatttcaaccaaaaaagtattgtgtatgaaatatatattctatagtttacttagtgaatgttattcctgaagactacaagtggcagcaaagaaattacgtggcatatatgtgtagattaagcatggaatgagtattgttttaaaattaacctattacctgtatggccatgatagtttttgtgaggagtaaattaatgcatatatgggagaaggctttgtaacatgtgaaacacttggtatatgagaatttgtattgaaatgattagacattaaagcatcttgttcataaaattttgataatcttcttttagccatttcttcaaagtcacttctatttttgtcaaatttcacctgtcggggggtttttagcttctgacctcagtattgtttcagtggctgagattaaacagcattctgacttgtacacagacaagtaactgtgctaatatccagtgaaattgaaaatggacaggaaatctttatacagctaaggaacaaataaatgataagagaattaatccagcattattgttcagaaaattaaacacttgagcagattaacaaaacacattataaaatttggattatttgtgaagagttgcaacatttggggaatgtttttattaaatgaatcttttattttactggatgctaatgaaaacaaactcattattttttatttggggtacgagtgttttttggtgacatggatgaattatatagttgtgaattttgagattgtagtggacccgtcacccgagtagtgtacgttgtacctaatatgtaattttctatcccatacccccaccctctttcttctgaatcttcaaagtccattatatcacactgtctgcctctcaagctcatattattgaagacttttccctataattttatattatttttatgccataatctgatgcttaatttctattttatttattaagtatgtttattttagggttaacattcataatgatcataaaaatcaggtaagctacagtagatgtagaaatttaacgtgtgtacacaacagaatatttcatgaaatttgtgtttaaaaacttgatttacatgattaaatcatttatgtagttttgaaatcagtgttatattctcctcaaaataaattgcatggaagttttaataggaatctcccacatacagtataattatttatctaaaacataatagtaaatatgtttataaattttactcaagtttaaatataaatagcgtttaccgcattaaaatatgaatttatcttattttattacatcaaattgtttgtcagggtcatattttatttagcgttccactaatgactacttgaaataaatcagagaaggtaagtcccataacagcttatgatctaggtcagtctcttcagatgaagataatgaagtgatttgaaaaactgactctattactgaatagtggtatgcttacttgagatagattatttatagcccctgcaaacaagagcagagttattttatattactgagacattttgaacaagaatgttagacagagtgaattgaataacttttcttaggatttagctcattttctatcatttcacatgtgttgacttttaaaaatctatttttaattatttcaactggcaatttaataaatacatttgcataatgtcctgaaagttcagggtagatttgtatgtgtaacgttctcaaaatagaggggagaattgttgggaaagctttgcatgttttatcttaagcaatactttttccttaaaaccaaagacattgaaaattacagccacaggtggatgtttgttttgagctaaaatagttaacagtctcatttatgagtccttgctctttccatttagccccatcaaaagggatgagtttatttacacagtgaccgtcttttttttttttttttttttttttttttttgagatggagtcttgctctgtctccaggctggagtgcagtggcacagtctcggctcactgcaacctctgcctcccgggttcaagcgatttccctgcctcagcctctcgagtagctgggatcacaggcgcgcgccaccatgccatctaattttttgtattttcgtagagatggggtttcaccatgttggccaggatggtctccatcaacagaccttgtgatccacccacctcggcctcccaaagtgctgggattacaggtgtgagccaccgtgcctggccgatccttctttatttttaataaaatctttaatcagagaaacctggaaaatagcatgaaggcgtgtccatttggtggcttccagataggaacttgatttacctgcaggaagtgacagcttagtaaatgatccttttgaaaatattgctgttattactctttaaatccggatttgtattaagccatccttgctatgtccttgatccttctttgaatccattgcagactgaaatatctcaatccgccagatgttctggtactgaacaatagctgtacaataataatgatacaatctcaaacacatcacagatgcactgttagtatccattactgtagaagaaaaaactttgttagcacacgctaattacttctgtgatggggaggaaaacaaaaatccatattaatttatatctttatggtctgcattatatttcttcatgaataatctatcttaaccatttattaaactatgaatacatttttataaatctggttgacatttaggtattttattaaacacaataaatgccagaggaaattgaattaagaaagcttgtaatacgctttactactagttaaaaaaaatttgtagctgtaaatggttctgctctatatcaagaataaatctgttcccagaccacagaattcttgttctttttcataccagaggccctgatcttttttgttgatagctggtttttaacagcttcaccatatgttttattccttttgatttgtaagaaatttgattatcagccttgaacagaaatcataatcacagcaaaaggaggcaagtaacttggggaataatacagagtcatttgaacagcagtgtgaagtctgagtttaactgactcagatgcccactctagtagagcactcatcagacttcagaccgaatccacttcggacagagaagtctccataaggtattcagactggcttcccctgtctttaaaacaaataaataaactctacttaatataataataactgaatttaagtatttccacagattagcaatttacgtgagagaaatcagcaataacatcaagcatatagcctgaaagtctgaaattgatgagagggatacaattggagccactagttattaatcatacgtgtgtatgtgcatgtgcacgtgtgtgtgtgtttgtgtacaattctgtctaaattggaactgatcttaaacccatttatatttttttgtggcagaaattttatgaggtaggcagggtgaaggaaggcactattaactttgactttataaaacttagaattgggctgggcacagtggctcatgcctgtaatcccagcactaagggaggctgaggcgggtggttcatgaggtcaggaatttgagaccagcctggccaacatggggaaaccatgtctccactaaaaatacaaaacttagccggcatggtggtgcacacctgtaatctcagctactgaggaggctgaggcaggagaatcacttgaacccaggaggtggagtttacagtgagctgagatcgtgccactgcactccagcctgggtgacagagcgagactccatctcaaaaaacaaacaaacagacatcttagaattgtttggctctacgttggttatgtaatttgaaacaaatatatgttgtgggataatcttaacgtgagctaactggtatatattaactaaagtcgttgaaatatttaattttgaaatgcaataatattttctcaaattaatgctcccgcctgaaaatctgtgagccagatagtaataattaacttctacctctacctaggattcctccacctccaactattttatcattggaaatgcatgaaggacaaacaactcaccatttctgcccactttagatgctaaggtgatattgatcactttgtcccatgtggaagaacatctaatgatatgttgggatgtctcatccataagtttattagtcaatcttatgttttatttgtacctagcaatgccaagcacactgtatgtgcttcattaatacttgtgaataaatatgtgaatgaaatttcaaaaaccatgaggtgcccttttgtggattcaatatgttttgtataatggtggagccaccctggaagaagctgctttgtttacccataacagcttatatttattgtgtgagacattgtccttcacagtttacatatataatgatgatatagtcttcaagagtatgaagtatagatactgttaacatctgttttcagataaggtgctggcacttagaaaagttaggtaacttttcaatcattccagatttcctaagacatagagccatggcgtaaatctgtgcacttgttttaaaataatacagctttattgagatgaaatttatataccatatagtttacttttttaaagtgtacaatttagtatattcagagtgaataataattataatactaattcatcattacaatcaattttagaatgtttttatcacccctgccccccaaaattgcttccactcgtttcccctattcactccccaacccagctctggacaaccactaatccactttctgtcccgacatttcattaaatggaagcaggcgatatgtggttctttatgactgacttatttcacttagtctattggtttttaaggttcaccaggttatagcatgtatcaatttctttttattgcagaaaaatattacattgtatggatataccacattttatttatttattcattagatgatggatattaatcaatgctcatttgaccacagctgtctgttatctgtctttctcatgactttggattaaattactactatagcaggtctctcataccttgcaatttcagcagctccgttgttcagcgctgctagttctctttcagcactaccgcagaggacagctccaagtttatggtttctgagtcccacaggcgcctctgattctgcctagctgagatcctcagagaggtataataaagcaagcaaatctgggtaggagcacagcgactttccctctgtctgcaggtatttagagctgattgtatcctcagaatactgtgtaaacggtatattttgtgtcacaatagattatcacctttggatttttcattttcaataggaattagattatggcatctttggttgagtgttatttagatttcctgtaaatctaggttacatataagtaggtaagatgcacagtgaaattcagtccatctatcttttgatgggttattcgaagtagtagtattaaggatcatttggtgaaattacttgttcattacattgtaatgggaagttagaagccaatatgtaagtagataatttcttttacaatatattttcttttcaagtttagatttatatgcttattaactttatccttcatatcaaattaaatttgttattgaatgccttatgtaataatcatgtagcttagttacaatgctcaatcttctgtcataaggtatatttgtatacttaagaatgaaattaattacacgttataaacatcacagtggaaaatattagttggattattaatctacaccatttacattctatgaaacatatttagggccagattctattagtacttttaaaaattttacatgatccttgacattgattatgattaaagacagaccaaagggaggaaaggggtgttatatcacttatgaggaagacacttaacatcttttcgcttgagttcacaacataatttagatgaaacactgttggccttggtaattaggaaaataataaaggcgaggagttggctttatcacattgtgtgaactgacccaacaataatgtgtcagaaatacagcatattcccagtttgtttgctcaacagaagcagataaacagaaggagctttctctaagccacatacattacaatggagacataaattacaatggagctttttccattgtaatttatgtctccattgtaatgtatgtggcttgggaccattgtctttgtaataatctggtaagattgtatcttttgaaaacatcaaatgtgttattttttcaaagtgatttggccaacggggaaattatgcagttatttatttatttattcataagccactaataagggcaaaactgagattctaaaatgattagaataataataagggtgttaaaaagtgatttttcacttcctatggcaagcagaattcacttataggtccatttccctggtgctgctatgacctttatattcattttatgctcagagctatcaattgttttcaaatgttgacacttgaaaaatcgctgtatgaatgatcatgtagttcccacagttattggtgctagaaatttctgattctactctggcctgggcagctgtcagcctagcatggcagtaagtagctttcttacctattagagaatgccctcagttcaaagaaaggagacatatgtgacaactgagagggttaattgttcctataaatgaattcattgaaaagtatttcacagcacacttgtttcaggcaagtctctgagaattattttatttattgtttttttggttgatcatgaccttttattgtgtttatttgcttaatattctgaatcaacctattgctgaatttctaagtaatgtactttattagttgctaaatttaacttatcctttcttatataccaatgatatagtttccaaatcttagattcttcttgaatagtactttctctttatgttgaccaattcatatactatactttgatgaaattatttttgtgaatcttctttttttctaaatgagatattcatgtatgataaacataacctttttaaagtacgcaagtcagtggtttgtagtatattctcagattgtgcagccattatcattattaaattccataatattttcaaaaccaaaggaaacccaggacccattagcagccactccatatttacctgtccatcaactcctaacaaccaccaatgtacaatctgcctgtatagatttgcctgttcaagaagtgtaacacaaatagagtaacattatatgtagagttttgtgtctgacttctttcagttagcatgacgttttaaaattaatccatgttatagcatgtatcagtacttcacttatttttatggctgagttatatttgattctatggatatacaacattttgtttattcattcatcatttgatggactttggggttgtttttattttttgtaattataaataatgttgctttgaatattgtgtacaaggttttgtgtggaatatgcttttattttgcttagatgtcctaggagtggaattgctgggtcatatggtaaagctatgatgaactttttgaagagtgataaatgaaactgtttaccaaagtgtttgcatcattttacattctcagcaacaatgcatgagggtttttatttcttcccattcttgtcagctctatatgttgctagatttgtggttgcttgttttttaactatagtcatctaagtgaatggaaagtgtttctcattgtggatttgatttgcatgtctctaattgctaatgatttgagcatctttcatgtacttgttggacagttgtgtatcatctttggataaatgtctgttcaaatttttgtctattttttaactgggtcttttttcaatatttaattataagagttcttgatatattctggatatattttggctatgtagtctaagtcgtcagacattgttttttttcaggatgtttcagttacttggagcgtcttgaatttccatatgaatataaggaccatctttataatttctgcaatacaacaaccttaaacttttacaaggattacatagaatctgtaaatcaatttggaggtattgcaatcttaacactagtaaatattccattccatgaacacgggatgtcttcccatttatttaggtctttttaaaatttctttcaatgatgttgtctagttttcagtgtacacatctttaatatactgattttattaaatttgttcctaagtattttattatttttgatattttaaatgaaatttttttatttcatgtttgaattgctcattgctagtgtatagaaataaaacttatatttatatattgaacttgtatcctagaattttgcttgaacttgtttattaaatctaaaattttctgtggattccataggattttctatgtagaagaaattgagatagttttgttcattccttccaatctaggcacattttattttattttatttttcctaattgtcctagttaggacctccactacaattgaattgaaatagcaaggccgggcgcagtggctcacgcctgtaatcccagcactttgggaggctgaggcgggcagaccacaaggtcaggagatgaagaccatcctggctaacacggtgaaaccccgtctctactaaaaatacaaaaatgtagccgggcgtggtggcgggcgcctgtagtcccagctactggggaggctggggcaggagaatggcgtgaacccgggaggcggagcttgcagtgggccgagattgtgccactgcactctagcctgggcgacagagcaagactccatctcaaaaaaaaaaaaaaaaatagcaagacaaccattcttgtcttctttttgatctcacgggaaaagctttcatcttttactgataagtatgatgttagctgtgagatgcccatttctgcaggtgcccttttttaggtttaggatcttccttccaaggattttcctttctagttccttgagtgtttttttatcatggaagagtgttgcattttttaaatactttttatgcatgtatcaaatgatcatgtggcttttgttctttattgtattaatatggtgtgctacattgattgatttttatatgttgaattaatcttgctttacttgaataatctggtctatatcattgctttacttgaataatctgttgtggtcataattctttttatctgttgctagatttggtttcttgaaaatttttgtgtctatcttcataaggagtattaatttgtagctttcttatgatgttcttgtctggtttgggtatcatggtaataatgggcttatgtaatgagcctggaagtgtttctttgtcttctagtttttgaagaatttcaataaacattttgtggaatgtaccggtgaagccttctgctcatggacttttttatgagaagtttcttgattactaatttatttactttccttgacacagggttattcagattttctgtttcttcttgaataaatttcagtagtttttgtctttctaggaatttttctatttttgtctaaattatctaatttgttgataacgtagtggtttatagtaattgccttataatcctttttattaaaatatctgtaaattctgttgttatccccccttttattctcaattttaggattttgaattttctcaattgttttgtcagtctagctaaagttgtgtcaattttatttacattttctaagacccaatttttgttccattgatttttttctgttgttttttgtttgcaattccctttatattttactccagtctttattattttctcccttctgttgctcttcttttccagggtttcaaggtggaaagttaagttattgattttaaatttttattctttttaaatatacgcattcaaagctttacattttctttgaagcacagctttagcttcatcttttaagttttggcatattctgttatcattttcatgcatctcaaagtctgaaagtaatttcccttttgatttttttcttgaccccttggttatttatggataagttatttattttccacatatttacaaatttcccaaatttgcttttagttttgattgctaatttaattttattgtggtcagagaacgttttatgattttattccttttaaactcattgaagtttgttgtatcattttttatattatttataaaaccgttaatatttcaatatctctaaaatgtaggaaaaatgtatataaaatatagtctgtagatcttttacagtctaagttgaaaaatgttttcaatgcacttaagaagaatgtgtattctactgtttggagtggagtgttctatacctgtttgctggtctagtttgtttatggtgttaaatcttctggatcctttttgatcttctgtctgattttctttccactatttaaagaaggattttgaagcttttcaactattattgttgaattttctatttcttctttcatttctatcagtttcccttcctctattttgagtctttgttttttaggtgcgtgtaagtttataggtattattttttactggcagattgacccttttctcattataaaatctgttcatctgtactaaaatttttggcttaaagtattgaagtgtgatattagtaatgctgttccagctctttttttggttactgtttgcatatgtccttttctgtcttttaactttcagcctgtttttgtctttgaacctaaaatatttcagttgtagacaatatatagttagatcatgtgttttttaaaagccagtgtataaatatctaccttttaattacagcgcttaatatatttatatttgctataattacaaagtaatattgatgcctgtgtttcctacttgttttttatatgacttatttctttttgtttgcgactcttgtttcttccccatttccatcaacatccctgcagtccaggccttcacatggcagggaaatgacagatgtattataccctgtttaggtaattgttgccatttcagaatggagtcccagtgatgcttggtcttttaatatatgagtggaaatcagaatttttaagtttttggaacacttcaatattttaatgttgacaactaatagagtttttaaaaaatacattagacatagtttgtggaacaagcaagttatgtctaatgagcacatggaatcaaagagaaaccatttgccacctctgttttccacatgtggaaagtctcaggaccagctcaattctggcatgcttgctttcatatatgttgtttactgatacttacataaatatttcctatctgtaaaatagtgggaaatagaaatagtaaaagcttacttgtattaaatactttatggtatgctggtgatgtttatgtccctacctctttttatatcaacttattttagttttcaggtggaatatgttcaaattttatcagactccaatcaaatactgcagtagtttctaagtcttagagctgttggtaccagatggatggatggatgaatttgtgttctcatgattgagacattacgataaggggaaagagtattacagcaacagacaaatgacttggctttagccctcaactaatttattgggtgcttttcaagtttcctactcttataaacttcagttttctcttctataaaatgaaaagattagccttgatcatttttaaagtcccccaggctaacattggctatgactgacactgtggagctatgggatctgcatgagaaatttttctcagtcagtacagcatgcacaagggagaatggctttattttatgtcacaatgcagaatgtctgttgtttgctatccctaaaagtgatgtcctctatgatttacaaagcctatggagacatttgcagcataagggaccgccttcccactttttcacctcagcacatgctacctcatcacactttctccttatttttagttttatgccatcatctgcaggtaatgtttgacctaaaacctacaccattacttgttcccttttaaaaatggcttcacttgtaccccaatggcatatcgagcacctgtgagacttcaggtgttgtttgatagtttaactaaaattaccatgattatctgtgtatatgaaaggcttttaaccctccactacctaaaactcactcgttctgtgctctcacttgttttctattataatacagaaataaaaggattgcatttgaatactgaaaaattgtcttactgccagtgcttgagtgcacaaatccggttaactctcaaatgatagctattcaacctgtctttcaaagcagtagatgtgttttgaaaatttcacatttgatttataaacaaaaagactcccttgactttatcctcctgttttccagacttttttattttttaagaatgaaaaataacagctaaggaatgtggcctggaatgaaaatatccgaatcagaagcaaacagaataaaaacacacctacctttccccctgaaataacattaatgtcttattggatctgacaaaattcaatgaatttctaattaaagactgtttccccactcctgattcaacctgtcctgcctagcagtagtagcaagaatgagtcatagtctcttcagaaagtaaagcattgcagattgagttaatgatgaatttttcccccttgatttgaaatactcttgcctctgtctttccgtcaaccctagaatagtaccttgatttgtaattttatattgattttaatttgcttcattatttttcttgtagccattaaaaatatatcaaacagaatcatacttgacaagaagcataaagaaaccttccactgatactggaactgttgggttttctttctactgaagcttttaatgattctttgccaatctactttttaatcatctgaagtaaaagtagtataaagcgtgttacttgaagcattcttgacagagaatgcagctgtgcacctgtgagaacaaataactgatgttccttttggtcactcagcaggaatagcattttaataggtttcttcactgatccggcatgctaagagtagtttgtagtgtgcatttaatctactgtctgtataggtagctcattatgtcaaggaaaggcttatgcacatttataatactttgtaaactgtatgattagatcattatttagaaaattgcttgtatgggaaatggttgaatagaaacatgttttccaagcaattacgtttccttcttaaaactctttgtccttcatttaaagataaacagaacttcttaggtaacccttagatattttcctgagttatagagttttggaggattcttaaggatgtgtatctgacatattgtaagcacgtaataaatatttattaaatggatgaatgaaactaattaagaaaaaagtgagagtttttttttgatacgataaaacttttttttaagataaaaatggcactttgggaggttaaggcggcaggatcactgagcccaggagttcaagatcagcctgagtaacatagtgggaccttgtctctacaaaaaataaattagccaggtatagtggtgcacacctcgtgaggccaaacatattgctatgaccagtggaataccagtggaaagaacatgaatcacaacaggatggcaggttttaaaaccagttgctaggtctccttttattaatgttgtggagatttcagaaatgtttattaatattaaatagttttcatcctcctgaataattagggcaatcaaacactgccaaccaacatttgacatacagcataaaagtcaagtaaattgcatttatttttgctgttaatattggactatcactaagcaaatcttgctggtgtaaacttcttagtcattggccagtttgttacaaagatctatgaaaaattcttatcccagtgagccaggagaaacttctcccaggagatcctgaaatctaaagtaggaacacatgcctctctatgtgacatccattgtgacacagatggtttggtcctttccaataataaaaaaaatggtgcgttttggaatacttgtgctttttgaaactataaatcacattatgagtataaagaacacagcttttgaaaaaaataaacttttttttccaaatgttggagaaaccagtgtttccagttgattgacctaagatgggtgttttaggcccttttggatttttaaactgtttttacgtgtatgtttctgtgtgtttgtgtggtggcttgtatttatggatgtgtgctgttcgttgctatgataggaaataacattgaaaactggagttatatgttattaagaacataacaaaaataaaaacactgtgtgaaaatctgtgagttaggatcaaaaattttatcttcaggcaaatatatatagccttaaaaaagttatcacatgacatattgtaaataaaatgaagtaatgttcaacttgaaaagttagaaaagacaataaaactattggagtaagtaaaataattaaaagatgattaaataatgatcaagaaatagaaacaaaaaatagaaaacaacagaaaatagattagatagatccaagaactattacttaaaagcaagacgtacataaactgtttaaacgtcttgtacagaaaaacaaaaatatagtcattataagaaggggttatatcaatactgaagggattaaaaatattaaggaaaatggataatatttttatcaatgcaaattatataaattaactcatgtttaaaaacattaataaacaagataacctaggaaaagaaaccctgaaaagttgtcatttttacctccaaaaaaatgcagtgtgctgtcatcttaatggataaaccactttaaattattaacagataagcaattttatggtaaaaaaattgattcagaaatagaggaaaaactgaaaagtgtcctttaccaagcagcataattttaaacacctgaaacagaatctgacgctcagaataaatatcagggccggaggtggggtggtgattctgaaacccctgttagccattagccatgctcatacagtcactcccaactatatgtttgatatactttcttaaccattcctgactgaaaaacactatagagtaacaaaaataattagtagtgtagtaatagattgatactttatatgacgcaaacctaagacaatatagtacttaaggagaaagcatttcaggcatacccaccaaataccccccaaaataaaggatgcttcccttatactttgtttaacttagtgattcttaaagtttttctgtctagtaagagatgaaaaaggaataactgtaaaattggaaaagcatataaagttatttctgcctataagaaatatgattatgcccttatttatacctatgaatctgaaaactttaaactaaaaatacatgttttataacaccttttaaaatgtactgtttttatttaatttcagttttcttgtcaaaaacaaacaagagtgtacaattaaaattgataacaacaaagtataaaattcatatgaattgacttaacaagagatgtccaattcttatgtgacagaagccataataatttgccaaagaacatgaagtttcaataaaatgggaaggttaaatatgatacagaatttagtttcatgcacacacatacatatgtatatatattagaattctaaaattatcctgaagtacaactggaggaataatattcaagggtagccaagggagtttcgaaaataactaaaaaaattttttaatgaaatgtttatataatattagatggattagacaaatgaaaaggtcaagaaactgacctacatacatattagaagtgaatttctgttgaggttggcatttcggtgaagctgtataaatgtggattatatgagcatgatgtgataataggtgaaagggtagggcaaatcattatctccctgtatatcagatgaaactcagatttattaaggaataaatgttaaatatataattacaacagaatccaaacaaacaaggtaactatatgatttggggataaggtgagcctttctttaaaaaaaaggataaaatgagatatctatcgatttaatactgtagtaatttgatacaaatgtaaaagaaatacaattacaattattaacaaaatgagaaaaaatttgcaaatcttaaacggaaaaaaattgcgatatctctaaatctaataagcaaatgacatatcaattaagcagcaaaatatgaacaatcaattttgaagaataagaaatacagagagcttcttaacagcttcagtgttaatcaatgaactgttcatttaagttattatatcatgtttcaggtatcaaattggtaaacaggaaaaagaaaaattaatgcccactgtttcagaggttttcaataaacatgttattttatatttcctaagagtttttaatttaaataataaaatccactgaaatgtacatcaaaaagaaacatgcatacaaaaacaaaaggagctttattggaaatgtataggacagttcacagaattaaaagaattagctatgaacagctatgtagaaggaatttgaaagttagtcaatatcattgagcataaatcagctccattttttttttgcacgctataataagtaacttctcttgaaatgagaatttctagtagagaaagtgaccaattgatttaacttaggtaatttttgccacttgtatgaattaaggtgaaaactttagacgggctgtcttgttgacactcatccaacatgtattcatcagtttcccaaacgagaagtgggatgctgttatctgaagtaaagagaggcacttggtaggcgaaaacagtggatatccagcttggttattaataaggatgttaacagtattattttttttaatggtgggcttacgagatttctatttttctatttatgctttttgcttttttctatttttttcctcagaaataagactgttataatcagaagtaaaaaggttactgaaatatgtaactggagaatatgttgagacaccctgaactggcccatttttagccaattcatttttttaatgtgctagataaatttatgcgtcctagaatcagaaggctttgaatcaatcaagttctggttttaccagtaatgaacattagtaagacatttaactagtgttgagtcttggagctattaactagaaattatgaattatgttactatctatataaaacttttaaaaatttggcttaaaaaattacatccacatgtttaatatatttataaggcagaattccttgaacatatatatgacctttgatgaatgtttgttgaatattttcagagtttcttaatgccaatcccaaatatcacttagtcaaaaacttatttatcttgagacttctaacttctggtattatttggttatattgttaccgtttcttcactgaaaaaaatgtcacctcccaaatgtctcatccttgtgttttatttgattttgaagatgtgggtcatcttttatgatgaacacaggttctatttttatatcataatctcatgatgattatggtgaaatgaacaaattaataaatggaaataacagtagaatatttggtggattgttaatagatattaagtactctagcagatagagtcttttattttatttgatctctatatattaattcatctgtctgacaataaaatgtgtttttaaagacatgctttatcaagatgtatttgaggcatttccccccactgatctattgtacttaaaaatttttgaaagctcaaattacactaaatgactgcagaaaaagtcccaaatagtaagttgccaatttgaaacttttattagtctcaattagttaatttattgaactaatttaaatagatcaataaattaaggtttataaagaatattcgggcagtctttttcttaagagaatcctgcaagactgaggcataagatacagtctgttgatgtttttatccctttcatttatccaaacagtgtaaaacattgcttatcacattggtatgacttacaggattcaacagaacacttagtcttttgtcttcattttccccattgctttgtatttctttagatttaagttataattaacttgaatattaatcttagatggcatgatttgatatgttaaaacgaagagtttaagacgccgagctctgtggttctcgccttagtaatgtacacattacagttgccagttgacaggtttcatttatccatggttttctttaaaatgcctattgatgcaaacctttttaataagtaactcaaaaggaaaaacacacaccaattaagttgacagtgatcccatatatttcttcctctaatttcccttttgtgacttcattttccttcccccatgccttcctttctttctacatacatgcacactatcaccattctagtggcccctgcctttaggcaccatgtttaagctctcagacctctcttaaatacttgtaacactatcaatactacctattttgttagcataattgtatggactacatggcaaatatttctgaagcacactgtaaatgtctgtataaatgcaaggattagcgttgcccgctgaatctagacctgatggattatcataaagaagacaagtttgcatatctgaattcaattaacagtggtacttgtttgtgatggagttggggtttcatttaactcaatctcattaatttatgcaaggaccaaatttgtttagtgtagtttatttgttagaagaagctagcgggcagaggattcatcaaaataataaccaaaacactcagaaaaatcaatagctacttttcaactcctgatctttgtcctcacccagagtgagttctaagcaaaattgtgcaggttatcattcctggatttcgcgctccctctcacacacaaatcctgaagagcattatcatacccattggttcgttgtgcagtggatcaccgaggcatttctttatgtgtactctttggcctaccattccgttctaatggacagtcatagttcatagtgagtttgaagtctttcttctagttaatctgtcaatttttctcacacagtgcagctgctgtgaaagaaattggagctgttacactttgtgctttggtacagtttgtaaaatgctaggtaggagacaggaaaccaaacacagcatgctactaatttctttaaaacgactgatgtgctagaactcagagtctgtgtcccagagagctggcatccctttttttctgagaagactaacgtcgtttgaaagtgttatcttacttttgcatcaacgatatagatgcctttggtatgacttacaggattcaacagaacacttagtcttttgtctgcattttccccattgctttgtatttctttagatttaagttataattaacttgaatattaatcttagatggcatgatttgatatgttaaaacgaagagtttaagacgccgagctctgtggttctcgcctgtagttccagctacttggaaggctgaggcagcaggactgcttgggcccatgatattgaggccacagtgtgtgatgattgcaactgtgaataacttctctagcctgggcagggtaacgagaacttgtccctaaaaaaaaaaaaaaaaagagtatgtgtatattgatatgtaatcatgtgactagacccttcactgtatactatataggaaaagatatataatatgctagaaaaacacactataagaactgttcttaccagaaagtaagcttattccagaagaggttggccctgtctccatcaggaattgtcagaattacagggatatagcaaagtgttctttttgacacatcaggattcctttctcttgaatgaaatgactatattcttcttcattgaagcatttgtataattaatcaagatgtttgtatattactctcctcctaacatgtgagagctgcaggtattttaaatgagaatgcttcaggatgtgtagtactgtctctgtgtgcagatttactttttattttatacgtctggtttttttgtgtgtatgcatgtgtgttgtgttgtgtgttttcagacagggtctcccactgtcacccaggccagagtgcagtggagctcactccaccctccacctcctgggctcaagggatcctcctgcctcctcctcccaagtatctgggactgcatgtgcatgccactatgcctggctattattattattttttaatgtagagataaagtcttgctatgttgccaaggtttgtcttgaatgtctaagctcaagcagtcctccccacttggccgcccaagttggggataaccccacttgggataatccccaaaacgcccaaggttttgggattatagatgtgagtcactgcacctagctgtttattttacggaggggccagttaactaattccctcttctaataaaattgttttgtaaatccaaatttgttcttgcctgttactactatttagaattttgcaattttattatacctagtcaaaagaaggaaggacgattcaaaaggaagaggaaagaaaattaatattaatcaatatatatcaaatgcatactaggcttttagcatcatctcaaatattttatatatattatttaacattcacaagtaccacataagataaatattacagttatgattttacacatctgtaatatccagagatattcaagaatcatagccagtaagttggatgaacattgcctaaaaaacacatttttaaaatctgaaagccagaacacttaacccttgaacaacgttagctgcatgaatccactaatacccacattttttaaaataaaagttacaccaagggtgcctgcctttcctgcctcgccttccatctctttcacctctgtcaccccagagacagcagaactaatccctcctcttcctcatcctcttcagcctactcaacttgaagatgatgagggtgaagacctttgtgatgatccacttccacctaatgaaaagtaaatgtttcctctttcttatgattttcttaataacatttctttagcttactttactgtaagaataatgcatataagatacaaaatatgtgttgactgtttatgttatcggtaagacttttggtgaatagttggctattaaagttttggaacagtcaaaattaaacaccgatttttgacttcatgggggttggtacccctaccctcctcgttgttcaaggggcaactgtatattctttttggtgtatatagagaccctgtaaaagagaattaaactttttcaagtccctcatttgtaatagtaatacatgtatagcctttaacaattttaaagcgtgctcttaaagaacattttctttgcccatcataataaatgcttatattaggcattattacctccgttttacttgttaaaaatcctggacttctacaatctgtcagagttggagaatcaaaggagaaagtgccttagcaaagagaatatagctgaaacaagaatcaatcaggctgttggggatataattctggaatgaaaattagactgaatttgttcttaagcatctttgttgtttgagctctttgttttctcatgtttagaatgagaagtggggggatttaattacgtttagtgacctttcaagctctaaaatgttttgctacttgaaagtgtacttagatgtgttaatgttatatacagaaagaaactgactgaagctacttaataaaaagtaatcaagatgaattataacagaaatagtaatataagataggaaatcctgaactaatattaggttatgtgcctaaatttgtgatttttatttaaacctggccttaatatttggcttcatttacctttcccttttaacctcagcgtcccaccttaacatagaatcaatctatgctatttgctatgtatcccaggtggataactgttcttgtagttgaccttcataatgtaactttattggtatagttaaggttaatggcacattaattttctataagacatcagtcagtatcccattttaatttaccattttcatgatgactgctgttctaagttgtttgtgtcatttttggctgccataaattatcccgaagcaaatatcaatgtgaactcagaaccatgcatgctgatgacttctgaaattattaatgccagtacataggaaaaagaaatacatgagtgcacatttggttgataatttctttatagattaccattaacctctttctttaagggaacagcataagtacatctgtgtttatttgctctaagggaaacaacagttataattaggaataattataacagcagcagtgaaactctaaaaaatatcctggaattactatcattcctaaaatatttttatttcagtggaaacagccaccattaggatctcatgggagagttcaaagagaaatgatagattatttcagatagacccttgttgggtggctgaattctcagagtggaaatagcagataatttgggctctgttcaaagcagtctgaagaagctctgtcctatagctctgaagggacccattttaattcacagagcacattaattgttatcccccttataaacatgtctttgtttgaagcattatctcaattgtgaaatgtggcttagaacaattctagatagtatagtggtaaaaaacttcaactcaggagtcacatagatatgggttcaaatctcatctccaccatttattagccatgtacccccatgaaaattattttaaacttttagtttccttagctttaaatggaaataataaggctgtccccacagaactgtcctgagggttaaagaatctttccagagtgacctgtacttagtaaatagctcccaaaattgtggaattctgtagctgtttaaatgagaagagatttttattaagaggtttccaaatttgtcctctttagcatgccattattgtcactttcaatcacttgggttttcagtactattattttattattttttcttcatatcagctttaaatttattctcttttcatacttagtcttgtcaaagccagattgtctcggaggtcttgatgttagacgacctagtatctcaggtttctctttgtaaaacaattgaattaatacatggatgtggttaggaaagtcatttgtggtcacataaacttcagaatcctttatgtccagttcttctctgtcacttgggtattcctgttataagagagaaaggagtcatatttagtgacatgatttgaccttcatttttacttaacctttggtaagtaacagtgagctgcttcaaaatatagtagtatttgtgtattaaaaacccacattcatgatccttaatataaaccaggcactgtgggaaaccacaaacagaggaaagaacattaccaacacctgtagttatttattttatgtgctttggaaaataagttaaatgccctcaggagcagtgttcatacatgaaaaaattctctacttatgccacaaggtcacataggattgtctgtatgataaagtatacattagattactctatctattttgtaacactttatagctgtaaggttgtatttttaaacgagcaaaaatgaatcaaaatttaatttgaaagcagggactcaaacagatacttctgtatcaatgttcacagcagcattacttaaaatagccaaaaggtagaaacaacccacatgtccatcaatgtgtgaatggataaacaaaacatggtgtaaacataggacggaattttattcagccttaaagaggaatgaaattctgatacttgctacaacatggacgcaccttgaaaacactaactgactgaaataagcaagacacaaaaggatgaataactatatcaaatatcacatgtaaggcacccagagtagttaaattcagcaagacagaaggcataatagtggttagcaggggctggggagttatttttttaatgggtacagattttctattggggatcatgtaaaagtgttggaaatggataatggcaatggtgacacaatcttgtgaatgtacttaatgccactgaattgtacacttaaaagtggctaaaatgcagactttacattatgttagctctccacaataaaatgtatactgaattttaaaaagtgaacagaaacttagaaactaaaatactaagcatctaattatctgaaatatgctgttaagtgtctttttcttttattgagcaactagctgtgtgtatttaatattctaagatctttaaaatagaggaaaagttgctcttttcctatttaacattctaagatctttaaaatagaggaaaagttgctgtctcagattggtggatttcacattgatggaatactggaggattaccgaagttcactttcctgggggctctagttcatgtctgactcctgtcatataggcccaaaattgccatctcagctacacagagcctcagcttgataagcaaaggtatttttcttgcaagagctctcttgcctctggagagactgatctggaatgactgtcaataacaacaaccatatacctgaagaatcggtctcttccattttaatttcatagacatgcaccgctggaactatgattattacaggatgaagtctcctataggaaagccggctgagctaacaaaatcaagccccattagtctgtccctggagcacaaactctaaatggccaggggagggaaagtcacacaggagagggcaagtgattggaaattgtagaaaatgggagaacgttgttgcgtgccatggtctcatggagattcatggaacctggtaaattaaagtgcacatccgtcccttaaattgtcatgctgcttcaagtttacttaacttttgtacagacttttacagacttttagaagtatttgtacagacttttagaagtctctccttcttccattgcttgtagctcttagatttaaatgatcacctgttcttttttgtagtcaagttgggatgtgcccccaaacacgtaacatgttttgaaactaaacaaatatccaccattaaattaagtttctttgatgctttcttttttcctggcagaatttggtcaaagcaactatttcattgcaaccctgacttgaataaacaagtacatgcatgctcatatagctgtgtatactcatgtgggctgctttagtgccttgactcaaatttacattactttcaagtataaacaatacaatactaatacaaacaattttgggagacagtaaagtttagtactgggctctataatatgcttgtgtgtttttggaaatctgtaccgtgcattggcaatccagagagtgctggtggagacaggactaacacaatggttcccaactaaggttattcctagagaagggcttctcaacttcaacactgttcacattttgggctagataaatcttggttatggggagctctcctgttcattataggatatttatcagcactcctggcctctactattagatgccagtaacatctgttctcctctagccatggcaattaaaaatgtctccagatattgtctagtgtcctctggcggggagggggcaagaagagcagtttagagcatggcatgaaatcccaggggcagggtgttgggctaattcaaagaggcttagggttttgaagcagtgagtggtgagaggagaagaatgatagaagaaataactggatgtgtctgcagcattttcttcccatggcattgcttcttgtaagatacacacgcacactcacactcatacttttgttctacataacatatatattgtgtagtatgaagtttatgagttataacactgtcgtcagagttatacctttatcctatatccagaagcataagacggtaacttaaaatctgactgttttatctaaaaatgtgctttcttttgggtattgtcaggactcttggtttcagttttaatttctataaatccagagatttgaacaattcccctgctagcttctgtttctctttgtgtcccagatctgtttccctccatctatagccaggacaggagtaacttgattctgagaaccctgagcctaccccaaaaggtaaaggaatcacctttccctatgtccacagattaaaatgagaaaaacatttttgggtttgcttgagtcttaagtgttcttctgacctaggcacttctccagggggctggacaagcctggctcatctaatttctaccctcccctagcccccaactttccaacctcgcaaacaatcataaggagtgctccccccacctcaaaagcagagatgctttatttagtactctgaagacaaaatgaagctgcaatttctttttgaaaatcttccccccagtttttcattcccttattttcagtgagatattcatcctctactttaaatgtacattctcttatagtagttctcaaagtctggtcgaggaaacctgaaggggtagtgaaaactttcaaatggatgtcagatcaaagctatttttgtaataatactaagaaggtatttgcctttgtcactctcagtctctcacaagcatacagtggagttttccagaggctgcgtgacatttgatgtcacataagagcgaatgcagaagcaaataggaggatccatttgtctatgattaagccagacattaaagagagatttacaaaaatgtagaacatgctatcctcctcattattttttgctttatataatattttcccattgaacatgctatttatgttaatatgtaatagacttactgttattttatgaattgaaaagtattttagaagtttccattttaatttctaatgtagtaaatatcaataaacctaatccattaattaaaactctttagcattctccctaattttaagaacgccttttgtttttatggtcttacttgaatacctgagtcttcatcaagttcttgccacgatggcttttagaactccaacatttccagcccggtgaaagccacagaatcttttcagctcaagccctccagtggatgttcacaattaaaaatttcccattttttcctgtatttagatgtctctttgctgtacaacaaggaacttaccagcggtcactacacatactggattataggcaagatagccatttaagggtagcgaaaaatgtaagaatttttatttatatattttatgtgatttgaaacgattgtgatttatatttcattatgtatataacatcagtaatagagtacatatgtgtactttagaaataaaaatacctaattagaggtgtatgctttattttctaatagaaatatgctatcaacaaaagtgatacttatcctataatatttgagcctgttttggggaaaattataacttgatacagagtgaaaagaataaatatttcttttagaggatgtgatggttaattttatggttcagtttgactgggccacagagtgcccaaatatttgatcacattattagtctgggtatttctgtgaggatgtttctggatgaaattaacatttgaattagtagatggaataaagcaggttgctttcccaaatgtgggtgggccttatgcaatcagctgaaggcctgaatagaacaaaatagtgaccttcccctaggaagagagaatttccctgtccctactacctttgaactgggacattggcttttttcctgcattcagattgaaactgaaacattggctcatcctaggtctcacacctgtcagccttcagactggaaatacagcatctcacgtctactgggcctcaggcctttgaacttggactggaaatagactgtcagctctcctgggcctctaacttgctgactcaccctgcagattttgggacttgtcagcctccttaattgtgtgagccaattccttctaataaatttacacacacacacacacacacacacacacacacacacacacacaatcttactgattctgtttctctggagaactctgctacaggagattacacaaactgtaaaggaaatatactatcgcataaattaagcaatgatctctataacttcttcagtctgagaactcattccttctggtcactggatgccttacaaggacagaatagggaaataggttttacttgaagcaagaataggaatggctgtaactgtttttgaattagtactgtctgtgagcccctgggcaatgaaggtattattgtctccattttacaaacgcagaaatcaaagctaagaaagaatactttgcccagggtcctacagaagtaaataaagtagctagaatttgagccagcctttttctaactccgaggcctatcctcttactagttgactatccataaatcaattttctacctataaagcttccttggacttgagtatccataaaacaacttcccacctacaaagatgtaggtaggaaagataattttcaaagtgttttaaatgtagcattgcctaccctggagttcagttaagccacaactgatctgtggtaatttggggaaatttcatcaagttggtctagaattacagactcctgggaatagatgtgtgtgtgtgtgtgtgtttgtgtgtgtgtgtgtctataaagtgccaagcttattttccaaaaggataaaggtatttcccagtgagtaggaaatgtttgcattcttcatgtatttgtgcatggatttccaaattgatggattttgcttcaaaattagtcaagaaatcaatcctggaagttattgtgtgtgtagctcaattcagtaaagtggcaaaatattatttatttcatcctccttatgctatttagtttccatctcattcctcatggtaatggagaaatagtctatgatattgtaaacacatatggatctttaagatttattttatatttgttttagcgttcaggaggcacttggcttttgcatctctccctctttaggaaagaaaaccaggtcatgccttatattttatatatgttttacatgtatttcctttcaaaaatgtgtcatggtatacttagtccttccctttaaagaaaaccataatgcagatctcattaaggaacataaatagtgatacatatatatggaaaaggacacacattctttagtgcagtggtgggaactagtgatcttcctccaaatgccagaataaatagatgttcctagcaaaaagcagggactatatttggaacctcccctattctggagttccagatctgattactcatgtagaatctcctgtttcatatataggtgacagtgttcaggactcattaccccaaaacatggcatcttagcatttgaggaaacagccaaagcagaccatacaaactagaaagaattcccctcaccccttccccactgaagtaggtcataagaccctcatctggaggagtcctgacttatacccagaggaaagcaatatcacacatggttgccaagaagaatttgaacaaacagaatttgctaagttcttcctggtttattactgttatattatacccttttgtcttccaatcatacttctgcacggctgtccattaaaaatacacagttttggccgggcgtggtaatcccagcactttgggaggccgaggcgggcggatcacggggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgggaacccgggaggcggagcttgcggtgagccaagatggcgccaccgccctccagcctgggcgacagagcgagactccgtctcaaaaaataaaaaaataaaaaacacagttttccccaggtctttaattatgcatttctgaataatctcgcatcatgtaaaacttacgttaaattaattgtatgcatttctcttattaatctatcttttgttgtaggggctttagccatgaacattgataggagttagaaatattttcttccttacacgtatacagttggccctccatatccttgggttccacatctgcggattcaaccaactgcggatcaataatgtttggaaaaaaaaaacaataaaaaataacaaaaatgttaaaatacagtataaaatctatttacatagcattttcattgtattaggtgttataagtaatctagagatgatttaaaatatactggagggtgtgcaggagtcacatgtaaatacgacatcactttatataagggaccccagcatctgcagggggttctggaaccaatcccatgtggataccaagggacgactgcattctccaaatcctgggcatgggcataccatatttcttaacatagctgcttaccatctctaatgttgtctatttaccattttctataaatctactgggttttaaactaatttttgatatgaagaaagtttatatcaatataaatagaagtaaaatttttcacaaatggaaaataataaaataaaaattttcacaaatggaaaattaacataaaaataaatttgcaaatatttacaagcgtaacataaatacacatcaacttaaactcaaatgtttacaaaataaaaataatactgtctaccagcagaagtgcaatgaccatattttttaaactatgatttctcctatatgtctatatttcatggctgaaattgtagttcagagctctcaccatcgtttctactacatacaaatcacttatgtcagtggaaatgttttctgccaagaagtgccaaattgtgagcctctcaggcctccagaccatgtttccttcacttctaaacgccattatgtcacccactgcatagttatctagtgcatataggataaacgctcaacgaagaaagccaggtcatgctttacaccttacattttgttttagacatattccttttcaaaaatatatccctgtgtaattaacccttctgtctttaaagcaaaggagttaagcactcaaatggcaatcaccaggaatgaggcccactacagtctaggagcaccagggcagtgcagtacaaaaaactcaagtagagaaaccagtgataactggggaaagttactttgactcacagaactttagttatcacatctataaaatgagataatacactctgccttattgaggcatttttttttattaaaaacagcctttgctttgtaccaggaaaaattaaaagcacttaataagcattaatttatgtagtcctcctaacagcccttatgaggctgtaaaggaacaaacaaacgtttctctctacttacactaaacatgccacactttttgaccagatgtgtgggttttgatttctgacacatccattttcaggtacatagttatgattccatttaattccgatgctgtctacctggagttacagtcagaacccacatgttaagagctcggtcccacgtgaatgccccctacttcagatgccagtcctaaatcgggctccccagaacttctggccaattgatataaattagagattcccatgaccgcctccttgggttcagccatttgctagagtggctcacagaacccaggaaagtgctttacttatatttactggtttataataaaggatattataaagaatacagatgaacagccagatggaagaaatgcataggaaaaggtatgtgcgaaggagcacagatcttccatccccaagcacctccacatgttgggcaacatggaagctctccagttgcagtcctttttggtttttatggcgacttcactatagaggcatgattgattaaaccattggccagtggtggttgagtcaaccttcagcccctcttccctcctgaggctatttaggagtcttgggccaccagtcattacccttctaaaagacttatcactttggagattccagggattttaggagttctgtgtcaagaaatgaagaagaaagaaatgaagaccaaatatatatttcttattctaaagcacaatatcacagaggaaaagagggtcagtatcttaattttataagggaggcatttataagacacagagaatctaagtaatttgtggaaggtcactcagctagaaagtgaagagctgggttttgaaaacccagattctggactcaatcattactctatgctgtatttcttcttagagtatatgaaattatccctgtgaaaatagttagactctggcattctatagctgttttctgtgacctgtgctctatattgtttttctttgcttcacagaaacgtaggtactgttttcccctaagttgttaattaatactcagataaggggcaagcacctctaggaaaaatcaaattataaatgtccagtacacttttatatcacatcacataatgtgacacattaaacagttgtggaatgtcaaaaattggcataatagatgacttgggaatgtagagtgacaagttttcatacaattgtgcctttttttgtgataatggtaaactctggaaaatttcattttctggttctgcagattgccagcacattgacatttcctgtatggtttcccaatgggaaggacagaattgtatttagccaaatctgataattttccttagttgaaattgaaggggctaaaatgcctacctacacttggatatgggcttcaattttttttgaagatacttattttccttctttgtttctaggatatagaggcagttcaggtagtttttcaggatactgcattgtagaagtaggcccttagtgaatcaagccattcatatacaagttgagtaagtgctcagagtaggtgtctatattaaggacagggtcctgtacattgtggggtgcttagcagttttgccatcatctgcccatgagatgacagtaacaaaccccatcttccctatgattatgacaaccaaaaatgtcttcagactttgccaacaaattacctttagatgtaatcactgatttagagcaatagaatttttggctctgtagggtaaatgaagtgcacctgatagcaataaatgacgcataccctgagaatgaccctgtatggcagatgcacctgaatgtgtgttccaagctaaggaactcgggaatggccaacagggagattcattccttgtctatgaggaacatctgaacctccagcctgtctattggaactcaggccacacaggggctcaagaccccgagttttgggttgaatgaaggttgccaggtggagactgtttgggaaagggtgctgagtgaaaatgctatataaactgcatgccctttgcaaatgattgtagttttcctgcccagtcccctgccgctgggctgcggagttatcttgtctagcccactgctactgggctgtttgtaaggcgattctcctgtccagcccaacaccactggcctttctccgtggtaagtaaagctccagtaaaatcccatgtcttgtttgctggccctgggtctctttttcagtctcttgaacctggtgccatcccctttagagtcgataggggttcagcgtgacaggctctttgttgtaaatatttgagattgatgatatctttgcacatattggaaaactttagatttcaggatagtaacttatgggccacaatgccaactacagctccggtaatgttacagtatgatggtttttaatgtgttccctggactagcattatcttttacaaataaaatcaaatcacatcactggctgaatgtttgagatgtattctcttctcattttaaggtttacgtaagtaatctctccaaataagtataatattaatagctgacagataaagagtcttttatatttacaggatgctttcaacttagtcttttctttaatttccccagtaactctgagaagagtttttattcacccatttgattagaaacagagacttaagaagagtaacttctgtctattctgagttagggagatcagaaaataccactgttctgagtagtattaggtgagaagagttttcttgctgattaaaatcctcaagtaaagctcttacatataagacttttatatataagaacaaaaaaccaaacaccgcatattgtcactcataggtgggaattgaacaatgagaacacatggacacaggaagggtaacatcacactctggggactgttgtggggtggggggagtggggaggggggagggatagctttaggagatatacctaatgctaaatgaggacttgatgggtgcagcacaccagcatggcacatgtatacatatgtaactaacctgcacattgtgcacatgtaccctaaaacttaaagtataataataaaataaaattaaaaaaaaataagactttttcctatcctcgagagcagtgtcaaaggctcatgactgtttttctcctgatctccaaattctaaaccatgtgctgcagtttcctatgttgatgtcactggttgttcaccctgggatgtcctatagactggagcatctgtctctatcctctccaatgagctgtcctaattatgttacatcaagacaacttgtgaagctcagaatctcaagtttctggccttacaactgatgagcagcataagccattcccactgctgttctcaatcccctccctgtcttagattcatagatccctaggctcttaagtgtcttccagaactgtttatcttgtagtcaagacccagaaattagacttccagaaacatagctcttcaaggcaggttcttcaaggtgatgatgcctgtgtcaccttgataggaaacctcctacactgtgtaatactgtcatctcagggagagccactgttcattagcttaaattgtcagctttatggttcagtgaaataaatacacattttccctaaggtaatgacttttttctcacttcgtgagagctgtagggacccttgttatcaagagataatcatattctagtggtgctacttattgtacccaatgaaagtcccaaggatgtgattatctcttaataactctaaagcctgttatgtatcatcttgtattttgtttactttgagtgtgtggtggggaacccattagtgatctctgtggttgatagtattcgttgtgaaatgataaaagaatcaaatgaccatttgtttgcttggagctagacagcacgattagaaatgcatcccaattctgactgaaaaatgcatttaaatgtaatctgttgcttagtattagtttaataaccctgatgttaatactaaattatatcaagcaaagctaatggaaattctgaaaataaacatggataatttagtatctacatgacctttacctcccacagaaaattcaggttgggttttaactacctgtgaaggaagtagatacccatgagaaataacctgctgattctgtgatggaaaatgccatcaataagttaagcaaaacaggagaaatataaggaaaagcctgttaaatacaatggcctttaagaatacggacagttgttaaatggtaactcttacctctcactttaggctatcctttgatattcaaataatgttaataataacaagtatcattaattgaatacctgctatagactggtttggcttgtctcattttatctattattgttattgagatggagtctcgctctgtcacccagggtggagtacagtggcaggatcttggctcattgcaacctctgcctcccaggttcaagcgattctcctgcctcagcctcccaagtagctgggattgcaggtgtgcgctaccacatctagctaattttttgtatttttagtagagatggggtttcatcatgttggccaggctggtcttgaacttcttacctcaagtgatctgcccccttcggccttccaaattgctgggattacagataggagccacggcacctggcccattttatcttttgaagaacctttcaaggtagataattttggccctgtcttacagatgataacaacaaactacaagaggttatataacttggttgagttcatgcagcaaataacgtggtaaagcttagactcaaatatgactttagaacctatattttgtccactgattatttaaaggcataatgtacagagtgactaagcgcaattataggagacttgtaatcaatggtgatcacatacacatttgttgttagacaaatccaggtctgactctaacaggcaaagtaaagagaccactctttggtccctcctaatgttatatgctatgtctgtgagaattgaaagctttagagatgccgcatctgggtttttgaacatgttcgttagaattattttcatgctcttacctgtcacttgggaagggttgtttttgttcttaataaataaccgacacaccttttggttttgaggtatttggaaagggtctagatcaggactgtttgttccctagggtaaaatcatcctttttgacctagaccttgccagctgctgcatctaactatttgctattagctgagaagctctgcagtcattcatggatttctggttcctttgttgtaaaattgcgagtacatttatgttgacagcagctgatttgttcaaagattggacccaatctttctgggcagagggagagtcgtctatttattcacctggttgtgtattaatttcctgcctattttcacatgtgattttatttagtttataataaaaactttaacttaggatagcgggtacaagttatggattgaacatggaaagtttagtgaatttttcatgattaaaaaaatgattataatgatagcatttattttctgcatagtatgaactgggcagtgttctcatggattacctcagtctagcctcaaaacaacagctaaaggtaggagtacattaggctcattttattcgaaaggaagctgagcttaaagaaggtgggtaaaatgaaaggtcttgccttgtgttcgcctctagggagagactattagccaatcaagtgcaatagattcagtttctttccccctgtaaagcagcacaaaagcggcccagaaaaaaattctgtgggttttttttttttttttttaaccttctttcaaggtatgaaattgggtatctacctacttgaatcatctctgttcatgctggctaacctaagatgggaagttttaactatgtctactttttcccctaacaagaatacagcaactgaacattttcccagtgaggtgtgaataaataattcctgcttatataatcagcaacttctcaacatcaactgaggtatcattagatattttcttttaagatcagttatgaaaatccactgtggaagtggaacttattttggcgtaacccttagtttataataactaagactatacgttggatccattcaatcattgagcatacatttaaggagcacctgttttagaccaggttgtactagactgtacaccttcagactgaagaataagacaacacaggtacatactttcccacagtaaaaggtatgtgtgttttggggtaagccgaacagtgataaatattttgtgatgagtggtatgctaaagacatgtgctgagtgtaactggagcacaagatccattacggtcctgagaggttatggttttgttaaaaggattatttcaaaagtaatattctcttactgttttagatacattttgatgatgtttgttgtttatttgggggggggaggtggcagagtagagtagtaattttattttgacagcaaatcccaggaggtcaggaatcttggtctgtttcttttctcctagtaaatactttttgaataaaaaaaattaatgtcaatgtaaaagctattggtctatgatagtaaaggaacagttgattatgattcatattcatgagccaggaatttttatatatggaatttccttacaaatttgtaggttgttagcattgtgacttatttgtattcattgctcacttatttgtctgcctcatttctacaggcacaaagccaggactttgtattactcacagaaaacttagcttcagtgggcttatgatttcttaactagtaaccatttagttgtaatatacagaaacttaaactagctcacataataagggttgttgaaaccatatgccaggcaaaatgatagtcttctaagcataaaaaaattatagctaaaacctaacctcatggggacttgacttaggaagtcaggaaatgtggctgcccctcaccttttaccctattttcagttcttcatttctcatgtggatcaggagtaaggatgtatgtaatcctaactctggttttctctaaagtcttatttttctggttctctcaagactggcttctttaacaataattccaactttacatgcctcaaactctcaagtgttgcaattcaaaatctctgagagagaatcttgttgacttaatgtgggtcaagtattaattgatggttcaatagctgtagcctattaggttgaatcacgtagaacatagggctggtcttttcaggagcaacaggtgggatgcattctttacaaaggagatattgtttcagaggccttcttggggtcagtcccatatattccccctcactcttcttacctttccatcctgctttctattctctttggcattgctctttgctccgtggtagctaactgacctgataaatgcattcatgatatgttagttcacccaacagataagttcttttggccaggattccctctggatgcaattacaaaaatcaaaggagtgaatttaataatgttttctataatgggcaagtatttgggaacatatgttttcttgtggtgctgatactgctttttgtgtgtacagtcaccatgcatgaaactatccataatgtatgagaatctcttgccaatgttactgctactagtggatactataactagtggctaaactgaatagctagtctgcattatgtaatttaattattaatttgaggattgaaataatcctttgaggatgaatactgttattgtccccactttaaaaatagaattgaggattatatcaattaaagaattgttcaagatcacatgattagtaataaattgaaccaatatcccatcccaagaaatttatcccggagcttatgttctcaaacaagaacaacataattattttaatgaataaaattaagttttcatttcaagtattattccactggatagggtaaatgtaatctctaccttctttctgtgaagaagaaaaaatatatatgacaaatttttagtaatatttgaaaaaacaaaaaactttgaccgatgtctgtaggattattataattttaattgttattgataggtaggctggagttgcaaatggtgccaatagctgtaaatagagctttagttttacatcagttgctgtccttaatgtaagaaagataggtgtttagatacatactaaacttttgtagctgactaatgtatatacagctggtaactgaccatattaaaaccaaacagatggtgatgtatttgtgattcagaattaatgtgaatatataatttttcataatccataggaaacattttcttacacatgtcatcatttatgaaattgtatttgttttaggggtatatgagaaaggtcagggattattttacatttctgaatatattagcaatatgaagaatacctgtttagtctctaccttctggttgttatcgatattatcctgagagtaaaggtagttaggtatttaatatagagatgaattattttgcaattcagccagagaaggcatacacttaagaaaagatcatgtttttatggctaatcaagaaactataacatttttatccaatcaattatgttatatttaagaataagccagagtagaatagtatgattaaagatatttctgattagctaatctatattatatatatctacataaaattttattttcagttattaaaactataagacagttattttacaaagaagtgatctatagcagaaacttggttagaggatacacatatgaataaacatgaaaacataaatatatacctttattctacgtaaaattaagtgtgtgtgtatttatatatatatttatagggaaaataaatttagttcttcagggaaaaatattgtgaggcaaaaattatttcacaattaaagtttaagtcggtagctttaagagaatgtacaatttatgtgaagagtgtttgtttttgttaggtaccctcattttatgtattcatatacctaacaaaaacgatgacgtctccatttattgctcaatttttattattttaaaatccttttaatgtaccctcttaagaaattgtctcttttattgaatctgaatgccataaaatattgcaggctcctagagccatcatactaacaagggaaagatagagtggtgatgaccttctcaaaagtcactcagctcatgggaggcaaggcggagaatggatcctggatcctaatctacacaattctattaagctggaaatctataccaaatgtatttaatttttactttgtcctaatccaatctgatttaattttagaccgggaagattacaggtaagcatcacctacccataagcctatctatgcttgaaaaaatgtatttatttgtgtattttttctttttattctaggaatcattgacatagagtaactccacagcatgtgtcttcaagagcttccctaaaaggtaagcttcccacaagggaagattttccttatgtgtagttcaccttgattagcatccttagtttctatggaaacattgaaaaccttcccttacagagtgatagcatgagattgtttttgatgtttttatgaatgttgaaattaatgaaagtagtgaagttacataaattaaagcctgaaactaagaaatagggactatttacatttctctctggagaagatacttaaggtaggttttctgtagtttagattaatttgataatccaaaaattttagaatttgtaatcatagaaagtgtatattgggaataaagttgttgtacttttgccaaatggtttcataggagaggatgttttagcagtcaaaccaacacaaatattaagttaacgcagtcctataaatactcagatcttaaaagttgaagcttttgaagggataaaacatgagaaatgtaactcactgtctacaatgtatgcaaattttttccttaataaaatatatagatgtaaaacagtaaaatggttatgttttactttcctgatgctgatccaataaagtaactggtggcttaaaacaatggaaacttattctctcacatttgtggaatctacaagtttgaaatgaaactctcagcaggaacatgctctctctttgaaggctcttaaggaggaatctctttgcttcctctagcttctggtggttgctggcaatgtttggtgttccttggcttcagatgcatcagtcaaatctctgcctctatcttcagttcacgtggctgtctcccctatgtgtgtccaaatattcttcttcttaggaagatagcagtcattgaattagggcccatgctaatctaatatgatcacatcttaacttgatttttatctgtaaagatcctttttaaaaagtcacattcacagattttggagattaggatttcaacagatcttttagggacatctaattcactcataacagtatgcctaaaaagagagtctagtgaaattaaagttaattattgttaacaatgtatttatgggaaaataatcataacatggagtggaggaaggtctcattccattggtatacataaaatgctgtttattttaatgatataataattatctcttgatggccagcttttctcccaagcaagataaaaattattcggtacagggtttgataacattgggtaaaatattagtatataattctgattctcagatttttaacaccctcagttaaaaaaaataataatcctggacatcagtgagaccctgtctctatgaaaaacaggaaaatttagccggatatggtggtgcatgcctgtagtcccactactgggaaagctgaagcgaaaggatcacttgggcctgggaggtcaaggctgcaacgagttgttattgcaccactgcactgtagcctgggtgacagagcaagaccttgtcataaattttatatatatatatatatatatatatagagagagagagagagagagagagagagagtcagaaatttatttcacttgattcttcaggtatttttcatgagctaaggttgagtaaggtgttttttaaccaactggctattgttctgtaacaaaccaccccaaaactcagtggctaaaaacagtaactttattatttcctatgagtctttgggatcagctgcttgggtcttctgatctggaacagactctgcagtattgactgggtatgctccttggtctgagcgcagctcacaggtcagtgcaagctgctccacaaggtccctctcctccagcaggaaccatctttcttaaggcagcaacattattccaagatactctgagtgtcctcaagcttgtttagatgtgctgtgttttcccttgcttttacttactctgttccttctccttggaatattctttctttccatctttttattccacttgaaaatgtatttcctttatgaatactgctctggtttctttgatcctattcattcatatatctttgtgtagctgaagatactgaactcatatccctgttagggtgaggcttccctcttgtgccaacatcagtgtaaacaatatgatattcacattgtcttgtaattgctagcttaattatcttaccctcccactgtgaacttctgaagccagtgattgcatcttcttgttcttcatggtattccaagaacctagcagtgcatgcacagatgatgtcttccataactatccatggacagaatgaaagatttaatgacatcttccctattctaattcctctcttaaaatttaagttgttgaaactttccagaatttggactgaaaggcaggaggtaggtttcctctcattttgatgatgccccttggactctactcaaagagggcccaggcaccctgtggtgccaccctggcctttcttcctctaccacagattgtaaaagttgtagtctgtgggacagaatatccccaaaacagttaatttgatttacataatagctctttttaacatagtaatttcaaaaataaaaataaagtttaacttgttgccagcacttaaaaatttggagattttacataaaatgattttttaaattctcctaaaagaaatcataataactttctatcctggacaatgcatttccagatgacaaagagggcttagctgaacaatagcagccttccagtgccctctccagttcgtcacaccatgccatttgctatcttctagccccagtagacacttgagtttaatatccttagctacccaaagatacatggattgatacagtgtggaggcttagctttgcttctaaatgtctgaacaaagaagtgtcagtggttgaatgggccatttagatgttcttattatatatccatcaactaagtaaaaataattttggctttgttttcaaagctctgtacttgaattcctgcatgtaatatttgaacagataatctctctgacctcttttttttacacatctgtaaaatggagactgtgatattcttcataggcttgggtcatgttaggttactttattaatgctagacaatttagtctaaactgcactcatagggaaaatagaagaagacagttacattcttctttttctggattggtacaaaaattttcatcttttgttagggtacattagcaatatgaagtactgatacatgcaacaactgggataaaccttgaaaatattataaataaaacaagcctgacaccaaaggtcatatattatatgattccatgttgatatggtttggctgtgtccccacccaaatctcatcttgtagttcccataatccccacctgtcgtgggagggagccggtgggaggtaaatgaatcaagggggcagtgatcctcatgctgttcgtgtaacagtgagtgagttctcatgagatctgatagtattagaagggtctttcccctcacttcactctcactattcttcctgctgccatgtgaagaaggactttgttggcttctccttccaccatgattttaagtttcctgaggcctccccagtcatgctgaagtgtgagtcaattaaacctctttcctttataaattactcagtctcaggtatgtctattttagcagcatgagaatggactaatatacatgtataagaaatacctagaataggcaaaactatagagacagaaagtagattaatagtttccagaaactaaggagagatgcaagcgggcagtgactgactgctacgatttctttttggaggtgatgaaaatgttttggaattagagagtagtgatggctgtaaagccttgtgaatacactaaaaaccactaaattgtgcagtgagtggtgaattttatggtatgtgaattacatctcaataaagtaataaggaaatatatgttttaggaagacaaaatttcatcttcagctgaggcaggagaatagggtctggaggcagggtaaacctaagggcaatttgcactgacttcctacaactgaatcaaaaggaaaaccccacctccccacaaccaattaacaaagggattagaggctactccctttgtactgcattgccgatgaaaaatggaaagtacctctgattggttctctcctgcaaccagtcacactggtcacgggccaagtcttcatgtgtaactttgtaacttcacttcagcctctaatttgccccctcctgcaaccaatcagacgtttgcatagggtgtaactttgtaacttcacttcagtctcttattggtcactctctgcaaccagtgagactggtcgcgggtcactccttcatttacatagtgtaactaagtaaccagtgggaaacctctagagggtaaaccccagaaaattctgtaaccagtgctcttgagccacttgctcaagattgctctcactatgtggagtacactttcatttcaataaacctgtgctttcattacttcattcttttgttgctttgtgtgttttgtcctattctttgttcaaaatgccaagaacctggacaactcatagtcaagaccctccactggcaacatagctatggtgacattctcagtcttttttgcattgctgaaaaggaatacttgaggctgggttatttacaaggaaagaggtttacttggctcatggttcttccagctgtacaagaagcatggcaccagcatctgtgtgtggtgacagcctcaggaaacttacaattatgacagagggcaaaggggcagcaggcatgccacaaggtcagagagggagcaagagagaggcgaatctcttttaaaaacaaacagctcttgcatgaactaatacagcaggaatttactcattacccaaggaatggcaccaagtcattcatgaacagtcttccccccatggcccaaacacctcgcactaggccccacctcccatctaggggtcagatttcgacacgacatttggagtggacaaacatccaaactatatcagtgatataacaaaataagcagattgtcattcaaatccacacacactgccttcctgagagtcctgtctgacctgactgccaaggccaaaggccaggtcaaattttttttttttttttagatggcatctagctctgttgcccaggctggagtgcagtggtgtgatctcggctcactgcaacctctacctccttcctgggttcaagcagttctcctgccccagcctcgtgaatagctgggattacaggcgtctgccaccgcacccagctaatttttgtatttttagtagagatggggtttcactatgttggccaggctactctcaaactcctgacctcatgatccacccgcttcagcctcccaaagtgctgggattacaagcgtgagccacggtgcctggcccaggaaaaaaatttaaacatcaggattcatggtttcatactgagattctgaatgatggggtcagacaggaatgaatttctattctaaatattttactgactacctctctcatatttctcaaaatgtaaaataagggtactgattagctcttttgttagcttaggaaaaataaatatcatgaacctactgtggttccagttaggaaatagaccctccataactgatacttttataattagtattatttggttgtaaatattaggctatcacattagatttttggcagttcaactgttccagggttggcttttctcttcctggcatcttagccagaaagaaaagaatgcctagaatttctgttagcacttaatgaatttaatcagcccccgagggacttttgatgtcagggaaatagttgacagagaaacatgatttttattctttctgtgtttctcttggtagttgacagagctttccctggcagaggtaacattacctgtgctgagagaggagtattaacatgctgtaagtgagatgttagaactaagagaacacatccctgtggccttacattaaaatgttccatgcatatgcttctgaatacaatttaagctgctgccaataagaaaataagccattgcctgaaaatgtgtgattcaattgtctatcatttttatgatttttttttaccctttcagacacattttagagattcttttttaaaaagtttgtttttggaaattgaaatgaaaattatcatctggaaatataagggataattgtgttattctgtgaagtattttataagctgtaatgttaagcagaaatttttaatcttaagtatggaaaaatatgtatatgaattgctccatttgatccaagtgatgttttatgcttttccttatggttaatggaaaggattatgctatgttgaatggccggaatatcaggagcatgggtgtcatttgttctcccaacaactatttttgggaagctaagtacatgccagaacatgtattaggaccaggtgatatggtgccaaataatatatgtatatcttctggaattttgagtttgctgtctaatagggggactgataacatacaagtagaaaaaatacatattgtgctaagtactgtaaaggaaaggaagagaatattatgatcgagaagcagagcttatagttccgcaccacaactaatttattgtgtgaccctctgataggctactgatgatgagtgggcaccgagcttctataaatttgacgaattaatcctttgaccattatggcgtgatcctctttttattcctgatgatgcttgttgacaaaatattacttcatttaaattaaatttgcctgagatttcctttctaatttgttttcaacctttatgtttagtttaggtgtatctcctttcagcagcgtgtagttggattttttcagtgtgaattttccccccttcttttttactaagggaattgaatttttttgcacttattttgattcctgaaatatttttaacattctttccatcaccttactttgtgtcaggatttttgtttctaaatgcttttccaccttcttctaaattaactggttttcttaattccattaatttcttattatttcggacgtttcactgttttcatttttagtgtgctctgccaaattttaaccttagcaaagtcaaatttaatgttcccaaataaaacctaaaattctttaactcaaattgtatcactcaaagttccaagttattttctatgcatattattttagctcaactttttcttcctcttagtaattattattatatttaatacattcaggttttaacttacatagattttcttatatactgaccagtttatttcttatcattgcttccagcatcccacttccttttgctcaaaagttcctattaaatttttagtagcttcttttaatggtaaactctctaatttttttgtatcactaaatatttttcttttgctgttatttttgaataatgttaagctaggattggaattcttagttaatggtattttcccctcaataccatgaagatattgttgtattgttttctatcctttattactacagataatgaaatctgctgttagtcaaattgatatgcttatgtatgtgatctgtctttttctttcctgctcacttttaagatatttcttacatttggagttctgcagtttcacaatgataagtccaagtatgcatttttgttgagtttttctcttacgctattctgttttccaacctcaggacacacttttttccagttgtagaaaattctcatttattatttatgtgaatattggtatttctaaaattacttttgttgtctcttttctgcattcttaaacatatttggaccatttatttctcctatccataactcctagctagcctttcacttttttctttatgtcttcattttgcattataagaaaattcctctggagtccttcagtttttaaatttgttgttcatcagtgtctattctgctacttaacttttgtatcatcaggatggctagttcatgctgcattattagcaaacagccccaagtgtcatggattaaaacaagaaaagtttatttctctctcatgcaacattctcaatgaaagttaacaggggagctctgtcttggtggaggcaccatctgggaatgtgaaggcaaaataaagaaaacctgtggaatcataaactggctcagaaagcttcctcccggaattgacacacgtcatttttcctcatattccactagcaaaagaagccaatggatgactccaaaggctataaggaaatacaatcttttttttttttttttttggagacataatctcgctgtcgcccagtctggagtgcagtggcaccatctcggctgactgcaacctccacctcccgagttcaagtgattctcctgcctcagcctccctagtaactgggattacaggtgcccatcatcacacccagctaatttttgtatttctagtagagacagggtttcaccatgttggccaggctggtctcaaactcctgacttcaggtgatccacccacctcggcctcccaaagtgctggaattacaagcgtgagccaccatgcctggccaggaaatacaatcttaatatgcacctggaaacaaaggagaactgtagtatttatgaaaagcactgcacggctactccaaatgttcatttttttttttaatttcaatttcttgttttaatttttagaagctctttttggtttatcttttttttaagtcatgttttcttgctttatcatggattcagttcctttttatttgtaattcctttacatactcttaatttctcctcatgttcattaatcttttattatttttattgtttatactgtatgtttcttttactgtgccaactgaattttttcatggtagtttttatttccacatatagttcgtaattttatagtttgagcccaccttagtgaactacttcctttctttgggaatgttgtgaactctgtgttgtgacagcattccccaagagtggttctgcttttgcttttattgagtctttaggatataaaaggtcacatatcagtttttgttaacttcttgcattttataagtagagtaaattagatcatatacttaacgcttggcccagccgtgaggtttttatttcttataggggtcatattgagtccaaagacaacagaattcctcacttcttgttcaggccatttgcatcatttttctaccttcttttcatggatttagggaatctgtgttttatatagggactttagatatatctccctgtgcttggaagactatgtctcctgtccctccttagacatcaaaaccctggctcaccagccctcaggcctatagcgagaaccaccctgtccctgaaccaccaccacattaactgaaacttattgcagagtcttcagttcctctgttcctttatcagaccttcagcattccatttcctttccttaaacttgatagatttttttaaattgttttacttatattttattcattatttttctgtgcctttaggtggtcattgatctatattagctgggttcattatgttttcaaaactggaagtttctaacatcagcttcctagcctataaaaaattattcaagttgcattatccacaatgctcttttaaccctatgactcatatcttaatatgaactaatacgaagaaaaacaagaattaataccaggtctcttgtcttctttccattttgatattaatcaattgtgtcatgttagacaagtcattaaactttcttgggctcaagcttccccatctataaaatcagcagttgaaactatatgccttagataaatgcattctcttctccaagctaagcaagtttaaatctgatgagcttttaggaaagatacaactttgtcctcagtactataatatttgattctttaattatttccagctgaagtcttttaaaatttacattattgcaataaatgttttacccgaactggtttggtaaatattttatatgcatctgtatataaagaaccatcatatcttattatacctagaaatgaatgcaattatgtttgccattttaagggtctcaagagttaatattaacaaagtgcttgttgacgtattttttttttcacatgaccttctgaagccagcctgcactactgccttttacataagtaaattagggtacatttttaaccttttcatgtttaaactaagacacatagtagctcttcaaaattgcaaaacagtctttagaacatttagtacacaataacccttctaattgcacgtgaaatgaaggactgtaaacttcataagtcacccagaagaacacaatgtaattccctttagagtatcctctttaaaagtggtctcagaatcagactccatgatttcagcaacacagtcaaagatgtactaacagatattacctaggttgccaatgaattgctgtcagttcatgttttatccatgaaaattttaaggaaaatgtaaaaatgatacatttgtttgaacttgtagagaaaattatgaaaaatccaagcttgtagggaatgatggactatctgcagaatattagcatagctctgattttgcaaacacgtggactcagataatcttacccagtggagacataccaatgcaaagtgaactaagatcttggagtactaatggacctatataacacattgagaatgttgaaacaacccgaaacaagctagagaaattggagaagcttaaacctgaggattggtgccctgaaatggaagagaaacaacagtcaactttatatgaacaggatgaaatagcatacaacaggatgatattaacatatctctgagcctgtgagggacagggaacagacttagagcaatccacccttgccgttaagatctattttgaagtgagacaggcgcttgtctcaaaggtcagggactaaatgtgtcttagagaagtcatcgtggttgttttaccttttcatccacctttgaaataaaagattagagataagatgaaatctaactagatccttgctaggagaatgaagttttaaaaggagagccatagtcacagctgtcttcagagtaggtagatgccaagtcttagggaagtacaggattaaccatgttggtaatgacagaacctaaggtatccccagcagtgttctttaagagtgtaaaaaacaaggattaggagagcaggtgattggacgcagctgctgaataatcttcttaacctcatctttactccacagggagaaaaataacaggaaaataaaagcttccaccaagtggttggtggcagtgaaacaaaaggagcatcaaaaagtacacaaggacagatttgtcctgatgctaataattctgaacaaaagggccaggaaattgctgtaaagtgctctgtactagtgtaagataaatacataattagtatacttaaataaagaaaaaaatagagtagaattctaggagtggttcttttttctaggcacttctaaagctgttattcactgagggcctaaataccttgtaatgtctcttcattaagtttttgttcatgaagtagcgagaaatgaatagctctcagtcaatatttaattgatgcttatacattgaatttaatcaggaactatctaaatgactcactaaccaacgaaaatttaagcaaggcaaatgtaacaaaggaaaatggggagcaaagcaggcaaatggtaccagattatgcatgagtaagaaatatgcatgagagaaaactttcatgtttgaagccatttgctacattcctggattactctagcacagcctaaataattctgattaatgcagcctcccaacgcatgatatagtctgcaatgaaaatggcccaaaatatataccttaatttctgtacaatgtactggttccttgttttagtgattctgtatttgtaaaagttcctatattgagtttgcttcaaccgtattgactgctgaagctcaagttctgtttatagcaaaggtcagggtctaaatatgtcttagagaagtcatagttatagttctccataattggagaactatatcgtacaacttctgccatgaatgtgagaccatctaatagtcaaactagaaagagtgaactcatagaacaccataagtaaaatgtaccccagataacatccagaccaaatctcattttatagtgcaggaaacttaggcgcagaaatgtttggttaaaagtggcacagattcacacaaaaccaaagtcttgatgttcagcatgcagaaggagagaacgtagttttccacaatttttttttcttcctcaaagatgggacaagggtgaccttactcgcattaaagaagtggatgatacttagttgtatttgaaagaaaaagagaacagagttctcatgctttgaaaacagaaagtaaatatgtatgatctcacttatccccctttatctgaggtagatacattccccgtggagtaggacagagcgtgatttcttcacgctactcggaatggtgtagaatttaaaacttatgaattctttatttctggaatttcccatttaatatttttggaatgtggttgactgcatcaacaaactccagaaagcaaaccatagataagaggggactactgtttatgaaatctaaaaaaactgaactcacagaagtagtaaaatgatggttactgaggttgggggttgagagggggagggaatgggggattgttggtcaaaaggtacaaagtttcatgtatagacaagaggaataggttttgagatctactgcatagcaaggtgactataatcaataataatgtatatttacctaagagtaaatttcaaatgtctcaccacaaaatagaggtgaggtgatagatatgttaattagctcagtttaatcatttttgatttttacatatatcaaaacatcacattttactcataagtgtatacaattatgatttatcaattcatactaataaaaacaaacaggtctggtgcggttgctcatgcctgtaatcccagcactttgggaggcccaggtgggtggatcatgaggtcaggagattgagaccatcctggctaacaccgtgaaacgccgttgagaggtgacaatgtgctagcagccctcgctcactgtgggcacctcctcaggccaaggcgtccactctggccgcacttgaggaacacttcagcctgccgctgcactgtgggagcccctctctgggctggccgaggccggaaccggctccctctgcttgtggggaggtgtggagggaaaggctcgggtgggaaccagggctgcgcagcgctcgcaggccagctggagttccgggtaggtgcaggctccacgggccccacactcagagtggcaggccggcacagccagcccctggcagcgagaggcttagcacctgggccaacgggcggaggggatgccaggttccccagcagtgccagcccgccagtgctgtgctcaaattctcaccgggcctctgctgcctccccttggtgcagggctcaggacctgcagcccgccaagcccgagctcccccacggtgggctccggcatggctggagcctctccgacaggtgccaccccctgctctgtggcacccagtcccatcaaccgcccaagggctgaggagtgcaggtgcacggtgcgggactggtgggcagcaggggatctactaggcgaagccagctgggctgctgagtttttgatggggacttggagaacttttatgtctagctggaggattgtatatgcaccagtcagcactctgtgtctagctgaaggtttgtaaatgcaccaatcagtgctctgtgtctagctaatctagtggagacttggagaacttttgtgtctagctaaaggattgtgaatgcaccaatcagcactctgtctagctcaaggtttgtaaacgtgccaatcagtgctctgtgtctagctaatctatggggactgggagaacttttatgtctagccggaggattgtatatgtaccaatcagcactgtgtctagctcgggttttgtggatgcaccaatcagcactgtgtatctaggatatctggtggggactgggagaacttttatgtctagctagaggactgtaaatgcaccaatcagcactctgtgtctagctcagggattgtaaacacaccaatcagcaccctatcaaaacagaccaatcaactctctataaaatggaccaatcatcaggatgtgggtggggtcagataagggaataaaagcaggctgcccgatccctgcagtggcaaccgggtctggtccccttccacattgtggaagctttgttcttttgctctttgcaataaatcttgccgctgctcactctttgggtctgcactgcccttaagagctatgtccttaagagctgtaacagtcaccgggaaggtctgcagtttcactcctgaggccagcgagaccacgaacccaccgggaggaatgagcaactctggacgggaggaatgaacaactccggacacaccatcttttaagaactgtaacactcaccgtgagggtctgcagcttcattcttgaagtcagcgagaccaagaacccaccaattctggacacaccgtctctactaaaaacacaaaaacaaaattagccgggtgtggtggcgggcgcctgtggtcccagctactcgggaggctgaggcaggagaatggcgggaacccgggaggcggagcttgcagtgagccaagatggcgccaccgcactccagcctgggcgacagagcgagactccgtctcaaaaaaaacaaaaacaaaacaaacaaacaaaaaaaacataaaggagtcctcacttgatgacaatgatgacagcttatatatttagagcacatatgaaatactaggtactttcctaatccttataaacacattttcttatgacgtaacctaaagtaggttccaacatctcataacatctcttcatcttgttgattaaaaacacgtaagttcagagtggttacataagcttcccaatatctcagtgtaaatctgtagcagagatgggattcccattcagttctatcttgactccagggtcagaattcataatcacttccatattgctacagttgaataagaactgtattttgggctgggcatggtggctcatgcctgtaatcccagcactttgggaggccgaggcaggcggatcacctgaggtcaggagttcaataccaggctggccaatgtggcgaaaccccatctctactaaaagtggaaaaattagccaggtgtggtggcaggtgcctgtaatcccagctactcaggaggctgaggcaggagaatcacttgaacccgggaggcggaggttaccgtgagcccagatcgcaccactgcactgcagcctgggtggcaagagcgagactccatcagaaaagaaaaacctgaatattttgaaccttaagtgaaaggagttacataagtaggcttcaagaaatgcacccaccagagtgataccagagcaactatttgcagtgaagtactaatagggactttgtgtatgagagtctgatattagcagcaggcagttgtgctgtagtgctttcagctggtattgcagaaaaaaaaaatcacacttggctgtaagtaagctgttgattgcttacacgggtttctgtggcatgccagctctccctgccacctactcttccttatcaaacagccaggagttctaagtgaggtgagaatcccacttgacaagcaggcataaaccatttgaggaaaatacaaattaaaaggctccaagacagaaataggagcattagcagcaggaagtgtcttggggatacattgtgtcagattacatccaggagttgggagaataagtgagtcatagcctcccagtggataagccctgttgtgtcagtagctgggcagcctcagaagctgtattagctatttaaagttgccagaactgctgtgaatgcccccaagctagcatctgcttagtaacatccttgaattatgcgcagtatgcctatttctcaagtagcttcagcatttctcctaacttctgacctgtgtcaaagcatagtgatagaattttgttcgtgtttaaggacagtaatacagaatagtaaagaactagagatattttgctcaagatcacctagcgagtcaatcaatgagctaaaattacaatgttgatctcaaggaacttttggtctgtgtaaaaatatggagcataaatataatgtcattgcacacatttgatcaatgtcttggccaagaaatctcagttgtcagaaacagaaaccctcttaatttagtccaaacaagaatttagtttacctgaaggatacagggaatctcatagaacttacagctacgaagtacagctttgttcaggtcaggagcaaaggttacctttctgtatttctgggacctatttcagggaccctgtggcacttagcattctctcttcttccccaatcccctcctgcgccctcctccaacccctgaaggtattttctttcatctttgcagtttcttctttctaccttagtatgtattcagtcgatactggccatcctagctctagactaacatgacccactggattgggtctctgtatcctaaccagagattccacagtgagaaaaatctcctgctccaaacagtttttagtacaaggaaaaaccaggacctcctaagataaagagttgcattcttggcagagaacccaaagatttttaaaatacattcagaaaattgccatcaatgctcaattgtaatctaattcaaattgtagcaggggcagggtttatccctggttagtatataacaacaccgggaagccacttccttcctgccttccagacctcccctcagttgttgcctgggtgctttttaccttgattggctcagtgtttcctgactgctaatcttgtatcaaagagaatccaatacaggtattggtgtttccacttcctgttgcttacgtcatttctagctattggtggggagaacagttgttactggaaaggggtcccaatcaagaccctaagagagagttcttggatctcacataagaatgaattcgagaagagtccataaagtgaaagcaattttattaagaaagtaaaggaataagagaatggctactccataggcagagcagtggcatgtgtagctgggttcccatttttatggttatttcttgattatattttaaacaaggggtggattattcatgagttttccagtaaagggatgggcaattcctggaactgagagttcctcccctttttagaccgtatagggtaacttcctgatgccatggcatctgtaaactgtcatggcgctggtgggagtgtcttttagtatgttaatggtttataattagcgtataatgagcagtgaggacaaccagaggtcactctcttcactatcttggttttggtggatttcagccagcttctttacttcaacctgttttatcagcaaagtctttctgacctgtatcttatgccaacctcctatctcatcctgtgactaagaatgcccaacctcctgggaatgcagcccagtagatcttagccttattttacccagcccctattcaagatggagttgctcttgttcaaacacctctgacacagttgctgtcttttttcagctctggtcaggaacttattacaggcaaagtgctttacagcttaaaaaaggagggataagggaatagatgctgtctttggctttggccttctttggaatatctagcttcttaactaagaataaatttttataagagacatttagatactgttaaagactagcactagacatttttactagaaattccaggattgtcaacacaataagatttatgcagattagatggtatggtgttgtttattattacaacttgataactagaccagtacttctcaaacttaaaagcgcttacagaccacttaggaatcctgttacaaatgcagattctgccctaggaagcctgtatggtacctgagattttgcatttctaaccaagacctaggtgatcctgatgctggtgacccacaaaccgtacttaagtagcaatgacgttaagatactgttttcatatccagaatcactgtacttttcagaatagaaattaatagtctaccttcttatttcagacctgaacaaaatgaacttcagtttaggtgggttacttgcttaaggacaatatagtttgtaacagtgttggaattaaaagctagattctggtgattctgttataccaacttaagggactaatatttattatgtcgattccatgctgttttgttcactttactgaaaatcactgcatacgtagccttaattcactatcgctgtctagttttcagctctagtaggtattgtaaacataaacatacacagaaacagatttatctattttccagccaagcttttgcaaagcaaaatccaggctgcagagagattgttgattgatactaaaattttgacagctgagagtatattttcagcaacaagatgagtaacttgggctaaaggagactgatgagaataaaacttagatttattaaggacctttccagtgagcagtctgtgtcatttctcaatgcaaaaataagtagtgtccaattccaattatatgatcctgcaacacgtaatttagctttgattaattgctataaattgctatcatcttcttaatcctgtatgtatttggtatcaggctttaatgcctgtaaatttaaatactggggtactcaatgaatttccaaaataatactctacagaatacatcctatttcatttagaagtttttaaaataactccagctactgtcttttatgtaatatgtgaattctacacttatcgtttcgttttataaaccgtatgtagcagcatcagtggattgggaacacctgtgtaccccatgtgacattttacttagtgtggacgaggggaagtcaactgcagcaaaatcatttcttttgatttctaacaatttcttctagccttatctgtaggatacttgacaaaaaaaggatacaatatttctatctatttaagatgtatatcacagtccacttaacagtttgaggaatgttttggtagtttctgtgaccttgagtaagctttccatttcgagcctccgtttttgcaactacaacatgcagacagtaacacctacctcgcaggataatatggatgaaatgacagcatatttaaaagcacttaaccagtgcttggcataggaagcactcagcaaatattcttttcttatttcctgaagcatttaatatatttaggattaagcgatagcaaaatgataattctctttacttacctctggcatctagaatgctcttggtgactggaataagttttaattgtaatcaaaactgaacgattaatagtgtaaacttgctgagggagaaataaggaggacatgctttccagaaccaattaaaaatgattttagatgatctgctatttcatattccccacaccattgcttttcctattagcaggtataagtgagaattaatggcaaataatggcaacacaaatcagtactaaagtgcatagtcatttttcatcatgcagctaaaacggtattattaatgtcaatttattggttatatataatgaactactatgctggagttttgtagaaattattttttattccaatatagttacttgatcaaggagactaagttccttttataaaataccagaggatgtcatgaatgaagaaatatggctagtccggtgcaggctgtgtatgcaggagaatgaggttttctctctcacaattacgtgagcctctgcagagtgtactttttcctggcctccagttgtggttaggtgctactggtagatttataaatatgtcatagttatatcaaatattttaatcattctgagccttttcgcctcatccaagtaaaacaattgtcttctccaaatgaagtattgtaaatatttatttgcagattttaatcaacctgtgacagccctctcatatgataaaatggtaactttgtaagattcgatgccccaaagatacatctgcaccatttaattagctggatgtgagtctacagtagagtcaacttagtttttacagatgggcttattttctgattggagagaaccgcatacagctatgtaattattacaacgtataatgtacaacatacattatatatatagtgtataatactccagtgttcacttaggagttcctatctggaattggtcttgtatctgttataaacaattgtagtttctgatagaagttacataaacatggagggatttttattggtatgatttcaaacaaatcattttctaccttaagactgagtcaaatccaaactagcatgtgcttaactgaaatcatgtatatatgattttgttttgttttgtttttgagacagaatctcgctctgtcgcccaggctggagtgcagtggcaggatctaggctcactgcaagccccgcctcccgaattcacgccattctcctgactcagcctccagagtagttgggactacaggcgcccaccaccacgccctgctaattttttgtatttttagtagagacagggtttcatcgtcttagccaggaaggtctctatctcctgacctcgtgatccacccgcctcggcctcccaaagtgctgggattagggtcgagagccacggcacctggccgtatatatgattgtttattcactaattccttcacttgctgaacagatattttggagtttctaccaaattctaagtattgtgcagtatactgttaagcacaaccttgtttcaaaggaagtagtagtcaaagcagagtgaaaaccagatgaacagattattcgtcttaatctacagacttagaaggaaaaaactaccaggcattatctgccagatcttctcataagcactttcacatattttctgtcatatgaacagattatgactatttattgtgattagacctgtgttattttgaagcatgaagtaaatggaaaatgtcacaggagaggtgacattggaacaggatggtaaagagtaggagattgcaagagaaatctattctgtttgagaacttctaaacagaaggtcagtttgagcataaattaatgattaatttttattcccttatttttagcagtaaaaaaaaatattttactgttcagtttaaaaatgtttctggaatccttagggttttccttttgctccccccaccccttaaacaattctatttcatctttcagtgaactggaaatactgaaaaaatataattttgtccgtatttcagtcttctataatatgtttgcccaatgaaatatgaacacaatattgcataatactgaaaactggctgtattagtccattttcatgctgctataaagaacttcccgagactgggtaatttataaaggaaagaggcttaattaactcacagttcaacatggctggggaggcctcaggaaacttaaaatcatgcaggtaggctaaggggaagcaaggaaccttcttcacagggaagcaggaaggagaattcccaagtaaagggggaagagccccttataaaaccattagatctcgtgagaactctctcactatccggagaacagcatggggaaaaccacccccatgattcagctaccttcacctggtctctcccatgacacatggggattatggggattacaattcaagatgagatttaggtggggacacaaatccttaccatatcactgggatttaaaaaatttgtaaatgctcatcatttacctgtctgaaagagtggtgtggggttcaggatttcctctagcgtaatgagtcagaatactgattgttataaatgttcactgtggctcttttgtgggtattgcacaatgtattgttgcttttcttaagcagttcataaagtaagtaaggaagtgacttgtatcatggtcatgatataaattgtattagacaatacatgatgagatgctcaattcttaaaggaggagagattcttctttaatcttaatagcattttctctgtatctccttcctagaacataagttaacgtgtgtacctgtattaacctcacccaccttggtttgcaactcactgagcacaaggaatatttgtattaatacagttgttctaactcagtgcttttcaaccaggggcaattttgtccctcaggagatacttggtagtgtctggagacatttttagttgtcaacactggaggataggtgctattttgtaaccagtgggtagctgccaggtatcctgctaagcatcccacaatgcagaagatggcctgtacaagaaagaatcatctggccaaagatgtcaagtgtcaaggttgagaaaccctgctctgtactataccctggggtcattctgtgactttggcattgttagctcatacattcagcccacactaaaaaggagaaattgatcacctaatgtgtttatccaactgtattggaataagagctgagttattaggctggaaattacatgttctgctgctataaaaaaattttacttttataaaataaaaatattttctacctaaaaaagctgaagaaataacttctcttgtactattgtgtggccgtagcattagtgacttcattcagtgtgtagacattgagcagtgagcttattgataggccctgcgaatctgtgagggagcaggatagacacattgttctcattagctctctaattccacaggatctgagacagatgtgaaacaaataattacttaaatacatattaaaattttaatatagatacatgatttatggtcagcagaaacacagaaactatagaaagacctgagttggaggggtctaggaaaagttccatttaagtagaaaaaaggaggtgtaagagttgaccaggttgattaagcattccagggagtgggaccagcataggcatgaacttggtgcattcaaaaaactgtaaggaaccaagtatgactaagtgcagcagttaaggagagtggcttgagcatgaggcagggcccagatctatcaggggtccctatattccatgtaaaggatttctaactttattctaacaacaagagaaggagtttatcccagctctggcaagatggtggtggccgtggtgctggcagctgggttgtgccctctgcagagccatggcggccccagggctgcgcggcacacatctgaggagctgtaggtgtgactggtgggaatgaaatgaccaaggcccagcgggcaattcctgggggtgtagccccaaccatcttctgtgggatcctggaccatcgcctcccagcctacatcctatatgaggactagcagtgtcttgtgttccctgaggtggctccataggctcctgtgcactttctggtcattcctaagaagcccattcctcggattaaccaggctgaagaagaagacagcagcttcttggacacctactccttgtgtgtaagaagatagcaagggctgagggcctaggagatggataccaacttgagatcaatgatgagaagctgggtgaacaatccgtaaatgacctgcacattcacttacttgggagctgacagctccagtggcctccagctttaacctctgaactgaccaaggaccctagacctgggtgcttggatgggaaagagaaaaagggaagctgtgatgttaataaaactgctctctcccaaaaaacaatcaatcagtcaatacatacataaataatgaaaacaggggaagacttttagggagaacaactattataagattctcacataaagcctaaataaagcaattgaagaacattacagactgttttttttcctttttctttatattttcttatttttcatgtatctgctgagacaatgttccaggtttctacaggaggatcttatgatccattaattggattgaattattgtaggtatctatatctgaaccagtcaaagcctggctgattctcttatgtggtaaaatgtcaaagtatcttcatactgcacctctccattagtaagccatgtttttagcaccttgtggtaaaatatttttcagtgttactaaagaaaataaactagtatttttcaaatgtctcctatgtaatgggagggaagtaacattcattggttgtttaccaagtgctaggactaggctaagcctgtcacctctcttcttcctctaaagcaggtgttttgtttttcataaagattagaaaaccaggtctcagaagttctaaaatgccctagtaggttaagactacaattagtaattggtaaacatgctgttagaactaatctttctgactcccaagactgcaacttttctctctgcaacatggaggagctaggtcatttatatgtctcatttttaagctatataacaaccatgtgaggtagacattattattcacatattttatatgtgtagaatctctatctagggtgtctcagttagtaattcctgggagctgcagtttagatccagatttacctgactctggaaactcttttcttttcactgcactctgatactgtctacaaaaattaccaaagtctaacatctttcctccttttatagactttcacgaagatagagaataactggtcagcatcctcttcaaagtggctttctgtataatttaaagtaatcttcaaggtggtattgatagcaagcttcataaagcatggactgtagtaattctgccaaagactgaaacaataaatagtaaggtaacatataatctatagctttaatgtaggtgatttcctacaaatagaaaataaataatgcctattgcatatttccagttatatgatctcttcttaacaatcattggagaatagaatatttataacagactaggcaactttatgtttcacccatctgagagctagagctttgcctggatatagtgctataatatttcaatatgactccttaaccttgtctagttgggggcttggtttgggggtgggcaacgtggtatatttcaattaaattaactttggaaatcatacagtgctagatttgaactctactgctgaaaccagctggcagtacaactttaaccctctgattcgctgagacattttttattaaatggaaataatatttatctcagagttgttgtctcgatatttataaggtgcctagcagagtattagatagaaattcattaaattggaaagttccaacatagtcatcatcatagttgctgcccttgctgtttttattctattttgttgttaatctttctatttccaaggacccctaagggttggcacagcagggagaaaggggtcctactggaatctttggaagtgttgacaatagaatttcctttaaaaaacctctcaaatgttagctgaggttagatcatttcaaaagaaccttctggcatttgttgacaatagagccattctagatctcttttaatctagttgagtccccggagaacagttaaatagttatagtgcaggccttgcgcatgaagcaaataaagtcaatggatactttattgcactgagttgggaaattacaagtaaaaggaaaaaaattatatcaaatgtggcccaatgaatctagtttcctggtaattgaaagcacttgttagtgattccaacaaagttaagggaaaacattctattgttaaaaagagacacctctctatggtgaatctaggccattgccatgacaatatcaagtcttgtcatttctttattttactttttgttctctctgaaatatgctgttttcatagtccacaagataatattaataatagtgcgatttggctttgtattggagacatttttcaaagcatttatttatccgttggggataaggaagttacaatacaatacttgatatttcgtgtgtatttcacctggtaacttaagtacgtttctaaattttcaattttggaaactcctatggttgttctttggtttaattttttttttatgatgacagaaaagactgtaatgtgatttgaagcccttgtaacgagtacaggtaataatgtatccaggatctcttttcttctcctcaatgccaagttaccttacttggttcagcctgacagtttctttcatctgcactccctgcgtagttcctacgtttaacctgcctgaaacacagctcctcttggtccctcatgtgggcaaaagtcagccccattctctggagtaatgagtttgatcttgacattcagcatgcttcatgatttgtcctcaacttgactttctaatttctgaatgaacatgtttcccattactttccaggcccagtcaaattaatcttaatgatgttgaattacattgaacacaaatttatcttttcaaactctgttctacacagttaataataaaggaacaaggaattgggggaaatgcaaagagagaaaaagtgggagaaagagacaatagaatgtacatatatttctatcttacgttctgctggtgatgcttcttgccaaagtgaggctgagatgagatgtgagattcccttctccaagttgccatctgcctcttttgtgtgaatatcttgcaattctcagtgtgattcttgagtttaaataaaaaaatatatatataccatgttgtccctaaatacaggtcaaaagtcatccacatatagtgctgagtttaaaaacagtgacctatttcaatgctaggaaaaaacaaaacgtaaacacaaaacacagaagtctgtctatgttgggtttgatgaaaagagggtaaaatgttttatttttgttttcggttctgcctcaaatacggttttcctagtctacaaaattatattaacagtggagcaatttaactttgcattgtagacatttttcaaagcatttatttatcctttgggggtgaggaagttacaatacaatattttatccatacccaacatggcaactccataatgaatttgggtaattttattacatgatattttcagcttgttctttgaaccttagctctcaattatactactttctctactggcagcctatcaatgtttggaaagcctcttcatttcttggttatttcagtttccaaaaagtgaatttatacaggtagaaaaaagtacattttcacgttttaattaactgagaatccaggaaactaaattcatcaaataatgttgtcaatttcatataagtaaagtctttttataagtcatccacaaaattttaaacatcaggacctaaattctgggattctgattaaaaacttatgcccatttcattcatgataatacttttctaattacaattttcctctttgttaaaaaataaggctggacgcagtggctcacacctgtaatcccagcactttgggaggccgaggtgggcggatcatgaggtcaggagatcgagaccatcctggctaacatggtgaaaccctgtctccactaaaaatacaaaaaattagccaggcatggtggcgggcgcctgtagtcccagctactcgggaaactgaggcaggagaatcacttgaacccgggaggcggagcttgcagtgagccgagattgcaccactgcgctccagcctgggtgacaaagcgagactctgtctcaaaaaaaaaaaaataataatagtaataataataataaataaataaataaaagggagtggaaaaaaatctaccaaaccttggattcaaagtccatttctttcagagattttattgtaagcattatcttattgactatgttcacataacttttaagagctaaaagaataccacgtttaatatgttgcactctaacaattttaactaaaaatattcatgcttagttacagtgtgtagaaacccaaaatattaaggatatatgtactttgtgggatgatcctctgatttaatatatgtggtctcttgaatctccctatattgaaccttcattttctaatatttattgtgcagttctctctctgtggtgtgtgtatgtgtgtgtatgagtacagaaatggtatataataaaaagcagtttctagcataaacaacaaaatgaataaactacacaaaattacagaaaaaacactaatctacagaagaaaaaaatgctggacctctaaaagtgaactatttattattcttgagaaaagcttatcaaatgagacttgcaatatatataagttgcttttccagattttattttaaaaatacaaaggcaaattactagtgctgtatttgtaagattaaactgcccactccccaatcagatttttggattatttacatgaaacgaaaaacacaaaccacccttgaaaatacgaaaatcttaattatagttacggtgtacagtggataagtgaagttagaatatctttctactgatggaaaaatgtcacttggctttgagatgagtcttttttttatttttattttttgagacagagttttgctcttgttgcccaggctagagtgcaatggcacaatctcagctcactgcaacctcctcctcctggattcaaggtacataccaccacacccggctaatttttgtaattttagtagagacaggggtttcaccatgttgaccaggctggtctcgaactcctgacctcaggcaatccacctgcctgggcctcccaaagtgctgggattacaggcgtgagccattgcacctagcatctttttaacacagggagagaatccattgaaacttttttttctctgtaacccctaacaacgttcggactatttcagcctttaaccatttggccctactgagtgtcattagattggcctcaggatccgtaagtactattatttttctcttgagcttacctctacatttatttaagcatgaaccttctcagtggttcactatagctttacaattcagcactttatccaaatacagctagaaaacttctttttttttttttttttttttgaggtggagtgtcgctctgtcgcccaggctggagtgcagtggcgcgatctcggctcactgcaagctctgcctcctgggttcatgccattctcctgcctcagcctcccgagtagctgggactacagggcccgccaccacgcccagctaatttttttgtatttttaatagagacggggtttcaccatgttagccaggatggtctcgatctcctgacctcatgatccgcccgcctcggcctcccaaagtgctgggattacaggcgtgagccacagagcctggcctctttttttgttttaacctctcatttcgaggcttctgtttgatctgtgttttagttagtctgagtttatatgtggctgtgtctagccatttacgtaggtcaattggactcaaaacccatctttcacttgaacctgcctttctttacctatcctatgtgcaagttctcttgctatttattttgacaccccacaaatttatcgaggttaatagactactaattccaaagcatttctaaatcagattgagtctattctctcagatctgtgaatacctattagggatggtatttgagataaaaatatgaataaaccgtacccttcacattttcttaaataataaaaaaaaactgaacagaagtgcaagactataaaatctctgactgcattaggagatcattattgcagtgttcaagtgtatggttatgactacaaagcaagaaaataagttttcttctctggttaacttacagccacatctcaagcattataaagaagtgaagagggaaatgataacgtaaaattggatggtgaattaaactttcattgtgtgttgagctcatcctaagactaaagcacagaaacatgtccataaaaattgtgattgtttttttgagatggagtctcactctgttgcccaggttggagtgcagtggcaagatctcggctccctgcaacctccgcctcccaggttcaagtgattctcctgcctcagctcccgagtagctgggattacaggcacctgccaccatgcccggctatttttttctatttttagtagagacacagtttaaccatgttggccaggctggtctcgaactcctgacctcgtgatctgctcacctcaacctcccaaagtgctgggattacaggcgtgagccaccacacctggccccaaaattgtgatttttattggttataagacctaggcattgtccctgtttttgagttttggaaagctaacattttaaactcctgttcacaaaacaggtgagagtaggactttcccctctcactgtgctaatcatattactatcgttggtcttgtatcaatttttaaaacatcatagccattattattttgcagtctgtattatttcttctaagtattaaatgacagatattgatatgaagagcaagaggctctccaaggaagcctcatctgtacaaagattagcaagaggttgcagcaattatgaaagttgccagaaatcacaaatgttcctaattttagggagaataggatgccccccatcacacataatggctttatcatcaggatttgagcccatgcagcagaatatccaggttctcttagaaaccagatgcttccttcctcctgcttggaaattggaaatatatttacatcttcaagaatgcgcgaggttcttctctgaagcagagccctgcattgcatctaattgtagaaattacaaaacttgtcagaaagttaaaaaaaataaaagaaatagtaacagttgcattgatttagaaccagctgcctttcttttatccaccctgatagagtagtgctttaattatttctcctaactaaaatgatacttccctcttgagaatgtctgggcctgtttatactgtcaccatcgttttgatacacaattgtccatattgatactctgtttttaccattaattttccaaagagcctctgaactcattgatagtgccggaacacagccttgccaacacagtgcccagccctggtaaactgagtcccgacaccacttttagttccaaaatttggggaaaaaatattattttgctttcacattctctctgctctctttaatacacacaactgaattcacagcctgaggccagcagagagcttagttatccacatctaaaggccccatgtcacaaaatttatctctgatatttaatatctttgaaagcacttaatacaagcccagtgttagctattctgtagtatgcctgaatccattaaaatgaaaaaaacctcagtaatgatattatgttgaagagaaatgttttataactgtcatactttggttttcctgaaatcataaaatggtcatgaaaatgatttacaaaaaaactgggttagagtgtaccagagtaccatagtcaagtataatgacatccaaaagaatgaaatgagcatggatagaggagggagaggtgacagagtaatgaattgccccctactgattttgttcctgtttgatctgacaacattggaatgacagctgctgaatgagacaatttgattcaaatgatttgcatatttttcaccagaaaaagtggtttgtagtttatggaatgagtcccttattctaaatatggtgctaatttcaagtacaggtatcctctgatattttgtgtaagtgaatgtgttacttattgttaaccagtattgatgaatttttattatagatccaaaaaatgatataattttagagatttatcccaatttctatcaaccagaaggtgaatatataccagttttccaaattacatggtgcatccccccacctccctcttttggtggaagattaggcatgcagtttttaagacccaatcaatctattgatagtgttaagtttcactatcctccacctgaaaagcgtgatttaaaagcaccaaactaagtatagcaaagttcttgcattgcttggcaatttcataatttcaggtttatatcgagtgagaattacaatgtgaaggtctttacttgttttgggctataatttgagatggaagtgggagaatgtgtagaatggttgctgatcatatatcccagatgctgcatttgtgggagaatggattgatacccagaggttccttctaacatagttcatcaagccagccagaaatttaagttaaccttgatatcccctgaggttaggttcccactgcacttggagtaaagactagcattctttttgtggctcatacatgccactgtgccattcaactctttcttttgtagcacttattcaaggtacttactgcctttttaaagtttgctcatctgtcacctttcaatacaatttacctttaacaccctatttaaaattacaaaccccaaccccaatgctctggctaacttttgcccttcactttttccttttttcctctagcatttatccttgcatctgtctgtctcagcatcttggaatatgatctcaaagagcacccgattttgtccgtatcgttcaaagatgtaactcaaatgtttataatagtgctttgtacatagtaggttctcagtataacatttgttgaatgagtggttgtttttgtatttcttttattatttaatttttgttcctccgctagattcgtgttcaggattatatccccagtgcctttcacttatttttcatgtaacatatatttttgaatgaatgaatgaatcaagaaaaaggttctggaataattttaatatttacctgtctgttaaaatattctcactagacctgttagaaactcaaagctaaattgaagctgatgtgatttctattcactaatttcctctggcaggcagtgattgggaaacatggtaaataatcagcgcatgtagttgtgctgtttaaaatacagcagttggccaagttctgtaagtatacaaatatattttcagtagatgagttaaaaccagcatctgattactttgtgctgtttggcttaaatagaaacaatttcatctcatttaaataaacaatcatcatatttttcatataaatgatgatataagctctggtaataagggcttatgttattgcttagaataggaaagttgcataaatgtgatcactctcaaaataatcttttgttacatcctggggagggggtaatgacaagcacttgcagtagctctatttatttatttattcatttttattgaggacatatgcttcagaggcttaaaacttaaaagattgaagcagtattataaaggagacataaatggcttttaatgcttgctgaaagcagataaacttaaagacttatgaacatcgtggctaggaatatgtgatagaatgtagaatccaaagggcaataaaatataaatatgtttctaatttgtgtattcttccttgtttaccataggatgtgacacattcagtgctacaagctgactgtctatgtccatatgggaagtatacacattgttctaaaactataaatcagggacatagttgaaatttgacaccaggttccaatccctaatgtcctctgaaaaatgtgagtttataaaggaaagcaatgtttccaagtaaattcattgtcttttggggctggctagctggcttttagagcctgacaggaatgtttttatttcttcagctctagaaaaggaaaagaggaaggaggcagtagaaaaaccaattgagtgagagtcagaagatgtgggatctagtggtaggtgggctgtaataaattgtttgacttaggccaggtgtggtggctcacacctataatttcggcactttgggaggctgaggtgggcggatcactggaggccagtttgagaccagcctggccaacatggtgaaatcccatctctactaaaaatacaaaaattagccaggcatggtggcgtgcacctgtagtcccgttacttgggaggctgaggcacaagaatcacttgaacctgggaggctgaggttgcaatgagccaagatctcaccactgcaccccatcctgggcaacacagtaagactctgtctcaaaaatcataataaaataagataaatagattgacctgaaaagggctttgtttctaatccccctggggttcccaaaactttttaaggtagggaagaaaactggggttagaccaattaatctcaaagtttcatccagtaattacagattcagtgatgactgttgttctttagttaacctcagaaaatctgtgaggtaggccccacgtgggttaagcacagttgcactccttgggcaggaggaggtagtggctgtttaaagacctagagattaatgaaataattactctgcctgcacctcttttctcatccctaaaagggaggactgcttttctgtacttcccaggaatgccgtgaatcgagtacgtacaactgtgttgtttttgaacgctgaaagccaaggtaataattagaaagtgtggatgtcacacttattttataaacactctttaaatggatacatgagttagtgtttgcttgatgttgcgaagcaagctgcagtttttgtctactcttcaccccacctaagaatctagttttcagcattaggcaaatgcttctggtacaagcatgtattaaaatttaaaatctgttaatgggttttaagtaggatcttgatgtttggcagaagtatcaataacatcggcgcctaaaataaatattaagttgtaattttaaagcttctattgtcatatttggacagatagatactgtgcagatacagtatgtggaagcattttaaggaatttcagttctagaaaggctctttaaaggtcaacctaattaaagcaatgtttttgagccagtacaaagtagatgcaattattggaaattcattgcaacagcacggaatggcatttcacttacagtttaaactttttatggttaatttagaaagcaaaaatcatcttttttggggggttcctgatctctgacttaaatgacattttaatcaataataatgatttctttgttaggattaggagaacttttgttctccgggatacatggcaggaatatttagcagctctattttagaacccctaaagaagatggttcttttgtaatgcaagtgctgatctaactcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcattagattgcttgagtatgatctgtaactaccccgtatacttcacagactaggtcctcagaagtcctctgcattttcacataaactaaaaacctccagtggtggtgttcacttgtctatgtgtgaagtagggacatcatgcattcctgatggacctcactaatgtggcaaggcttgtttgaaaaaaagaagaaaaaaaggccatgcttctaatgagaaataattattggaagcaataaaatatttatattccattcattaaacacactgaccacgaggaaattaaaaagtattgaattccaaaactatcacaaatacagaaaatatacatgaatgtttaaattttcatttaatgatgaaatgaagatcacattcttcacccttagcaatgctaatcacgtgtcactggttgaaatagtgatcaaataaatgagaaaaagatgaatgactttcccaaaatgttagacctatatttagatataatttaccattttgtaccataacctattacttattttagcaaagtcccaatccactgattattgtcgcattgtgtcatactcttcaaaaaaatgaaaagtccatctgacaatatgatatcttagaaagtcattgtaaaaatctgcttcagtcaaaaaaggttttatgattgcatattaactttgaaattaatcaacaagttgacagtagacagtctctagtgtctctaaatatatggcatgtctttgccataaaatagaaattgctacctacagatattatctgaggcattattttgccttgcggagggtatctgttatgttagagaagtgatttctaaacaaactttggctttgccaaagtgtcatgctgtttgtattttctttggtatgtcacaagtcatcccaacatttccctctcatttctttctttttctttcttctttttctccctaaaactgaaggagatgggtcattttgaagatagaaaagatattacggtggccctattttctaagggactttcaatactccataatatgacagcctaagcttctctagcagaaaaggccgcctgggtgcatcagttaagttacagatcctactctgctttctctggcaatggaggaggcaggtgattgcctaaacacaaagctcctgccaatttctgaaaggcacagtggctggagcaaaaagcaactcatcttcccaggggcctgccctattctgaacatctctaaactaaaatgattcttcttttcttttttcttgatcagtcttcagtcactatttttatatcatgaagtgttaccgggtttatgtgcctgtccacatttcataaagttagaggacatatggtaaaaatctaagaataacatcataaatcatccatgcctctgaattgcttgaaaatgttaaatgccttggttttggtccagatgttcaacttgccccttttataccagcctgacatacatcagttgaaagaagaaaaaaaaaaagagaaaaccctctgctgttctctttcagcttaatggttgatatatttttctttcttctctgactttgccatttattgaagcatagacgggtgccctaccctacatgaaagctatttcctactgcttgtgaaagaaaaaaaatatgaaataaacacttactattctgttacaaggtaacaatagagtgctaattgctgagtaaagtcatgtagccccaggattatgttgagggactccactataaatttgaagacacccataatccatgtatcaggcagaaaatgatttgctgtgctgcacttctcctttaacagtttctatcgaactatttaattaaatggaataataattattattccctgatccaaattagaacactttcttgtttaacgttcctagtaagtgcacaataaatattaatgttaatggtgatgatgatggtgttgatgtgttttatggtaagaaccaagaattatgggagcacagaaggtggatgacttttcccttttgggcaggagcagtcaggaaagaattcacagaggcggtaatatttgaagtggtctttgaagtatcagtatttctatatcactaggtgattcttgagatgaagataagtgtttttgatgcattaagcacagtccacagttgcagttgtcactgtttttaggtctttctaccttgaggatttcccagttctcaattttcatgttctgtttgtttctgtataattttgtggagttgggcacttgtatgttaaaaaaaaaaaaaaaaaggtcaggttaacatataatatgctctgctatttccacttttgatatttgctttcttctctcatgttggttgtgtgctgaccatgcactgactcattatctgtcaatgctcagttcttatacagtgttaaggcaccagctgaattaacacaaaaagaaaatgacagagctcagcagggcgcggtggctcacgcctgtaatcccagcactttgggagactgaggcgggtggatcacgaagtcaaaagatcgagaccatcctggccaacatggtgaaactccgtctctactaaaaatacaaaaattagccaggcatagtggagcacacctgtagtcccagctacttgggaggctgaggcaggagaatcacttgaacccgggaggcagaggttgcagtgagccgagattgcgccactgcactgcagcctggcgatagagcgagattccatctcaaggaaaaaaaaaaaaaaaagaaaatgacagagctcttttcattccaagtttttagataccatatccagttgttgttgaacatgatggcattattagtgttttcagtagctcctctccctaataggaaggaagcaaatgggttgcattgaactctctttaatatgagtgctatcttcagcagtgcttcattatacaaagtattaatagaatgactggccatgcctgcaatcctcagtcattttctctagcttcctcacccacacacaggttgttaagtcaccaagagatgtgttacttctgtgctgtgccctgtgaaagctttcctctctagagatctggtatcttcacaggaaaggtcaaataggtttcattgtctttgcacagtatcacactaatttaagatttgagtttcttttaaaaaacacagctgtgagagagagagagctcctctgaagctgagacagtaaaactgaagatacccggaatatttataacatatgtttgcataaagcaagcttgtccaacctgtgacctgtggaccgcatgtggccaaggatagctttgaatgcagcccagtataaatttgtaaactttcttaaaacatgatttttttgtgattatttttttttaacctcatcagttattgttagtgttagtgtattttatgtgtggcgccagacaattcctcttcgtccagtgcgacccagggaagccaaaagattggacactcctggatgaggcatttttaaaaagcagataaaataccaatgtaaagatttatttttccaaaagagtggattaaaagaaagacaagtgctaacaactgttgttgtcacctcatggttttttcagttgtctgtatgagatggcatcgttactgactcttgcaatatttggaataatataaactaagtaccacagtgtagtttgaggcttgagttctataaatacccatttcattaatttggggaggagaaatagatgcgacaaatgggcccaacatacattggctcaacaaaatagaatttatttctcaagttcataaaaatcctgggtggtttcatgtgcgggggaaggagagagtcctctgatccacagttattcggggatgcaggcactgctgtttcagtatgggccttcccaaattctggacatcaccattccattcctcaggatgggggaaagaacccatagcagcttgtgagaggacagtcctggctgtgctataccttatttccactcacactggttagaagtcagtcccattgcgttttttggccatgcacaggggactggggaatatagtccagcttagtgccctggaaaacgggagaaagtggaccttaatggacaggtagcaatctctgctactctcattcatttattttttattcaacatgttttggaacaacctatttgttagagactgtgctaggtgcttggtttatcatttcattagcccactggcctccccgtagtacttcagggaaacagctaattaatttgtgtctctcatgagataaatgagactccagatctaactaaaacacataggaaacttgacatttcaagcttagctcctttttttttttgaagaaggattacaaataatctggtggtagcattatttttttttctcccttgtgaatcagccataggaagaggagaatttgtgttgtcattcttatttgtattctgtaagaatgcttccctttactactggtattagaggaatgtaataccaataccaatatcactatcaattagaggattataccatagtttcataatcttttcaatgtaaggtagtttaatcagtcaccatccacacttcaacaattttccttttcattgccatgtaggttaaatgaagtcaaatacaatgctcgtgtctcttgtattgcccattcattgcctagcatgtttacctatacaataggcatatgatagtcttttaaatatggaataacaacacaagcagcataaaagattgagacagttttctaataatcacaacatatatcccattttttcttttatttcacttttctttttttcttttcctttcctttttttgaatttctttttcctgcctacctttttccgtttcctttttttttcttctgtttttaagctttaccctgcagatggttaccaatatgattaaaattcttcaagaagcatgcagatctgcctattatagaagggaaaactataaggttacagattctgggtactgatcccactctggccactaacttctgatagtaccttggatagataactttattaattgaggtggttgacctcaatatcctaatgtaaaagatgaagatattgcatccggagtaccacaggcctcttttgtcttttttatataactgctatgttagtataaattgttatttatgagcattagatgagtatttataaaatatgtcagggataggagatatcatttgttgttaaaatcttatttttgaaattagactgcaagaatttgaatctgttgtcatgactttttcaggctatttgatcttgggaacattatataacctctcaaagtgacagtttcctcatttgcttaaactactgtgggttataagaatatcatcatggccgggcgcggtggctcacgcctgtaatcctagcacttttggaggccgaggtgggcggattatctgaggtggggagttcgagaccaacctgacaaacatggagaaaccccatctctaggaaaaatacaaaaaaattagctgggcatggtggcacatgcatgtaatcccagctactcgggaggctgagaccggagaatcgcttgaacccaggagatggaggttgcggtgagctgagatcgcaccattgcattccagcttggtcaacaagagtgaaactccatctcaaaaaaaaaaaaaaaaaatcatagggttttggtgataatttaattagatactgtgtctcttggtataagctctcaataactttgatcatctgaaataaaaatgtcattctctttcctctatccattgtgttttcacagaagttagggaaaatgggatgagaattttccaaagcagcccttcctttttatgtaaaatttagatattggcagcgtatctcagcctcaatggtaacattagggtttgcatctctgttgttagtccaggaatctgtttttctcttttgattctttaagtcatttggataaaatattaaagagcactaagatctgatgttgtagattggaaagaggaaatagttgaagaacatgaaatgtgtctattttacctttatatagctatgcagaacaggtgagatttggtatgaatttgaatagtaacgatgcttaccactcttgaaggatattttgcaaattttaattggtttatctgaacaccacttttaggggctaagtaaatattcccactttacactgagtagatctaacaaaatgatcagtttacccaggtcatttactacattgactattgccaaattcagtatatccagattggacttgctgatcatgcatgcttagtgggtttctttttttttttttccattcttatcctattttacataagaacgaataacttattctctctagagtttgtagcttcatttgcaaaaggggatgcctaagagaggaaagagcaaactaggtgtctttctagcttcaaagattgttattttgtgatttctgtattagttggtttataattgaccagatcaatttgaatcatatgtgtttttctattttctgaattcaacactgttattttctattgtcttgagtactgatgtttccaaatttttaaacctttcccttcttttgttttgttttgtttttttcttccttttttttttggagacagagtcttggtcagtcgcccaggctggagtgcagtggcacaatctcggctcactgcaacctctgccttctgggttcccgccattctcctgcctcagcctcctgagtagctgggactacaggcgcccgccaccacacccggctaatttttttgtatttttagtagagatggggtttcaccatgttagccaggatggtctcgatctcctgacctcgtgatccacccgcctcggcctcccaaagtgctgggattacaggcgtgagccactgcgcctggccttgttttgttttttctagagagaaatgggccccaatatttgccttataatactttgtaccttgtcctacatttcccccttagaacaatgtacagaacagtcaacatgacaatcagatcaagtttcaccttctgcacttaggtctcttacttagctatcactagtctggaggtgttgggaacataacttaaactctttgaactatagtgttctgtaatgtggcattaataaatctgaagtcaaaagatataaaatatgtaaaagcgcttaggagaatatctggcacataatgcatggtagtttttcccttctaagtctgtaggttaagatgaatatttgaagactttcaaactgattttcttccaattaaaatatttgtaaatgatgtataaaaagtctccattctttaacaaaggctgttaaaggctctggtactgttttgattatataaattaaaaaattatgtatttcttataaaatattgcatattttaaaaatgtttttagctcattgaaaatattcagaaaacatatattttaatatcttagcccagaatttgaaatttttctatgaaggtgcaaggttctaagaccaaattgtctctgtagagctgtgtaaaattaaaaaaataaaatttcgaactggccagaaaatgtattgttcttcccaaatcttgagacaaaggcacaaaccctgtttcattcacacacaaaaaataattttgatttgcttagggacataagatttatggctctgtgatgtctgctagagatatgtttaaagtggaccactctatacagctttatataaaaaacatggtatacaccttactgaacattcttttcttacattttcttcctatcgtgattttttttttttttttgagatggagtcttgctctgtcacccaggctggagtgcagtggcgcgatctcagctcactgcaacctctgccccccgggttcaagcgattctcctgcctcagcctcccgagtagctgggattacaggcgcgctgtaatttttgtacttttagtagagactgggtttcaccatcttggccaggctggtcttgaactcctgacctcatgatccacccgcctcggcctcccaaagtgctgggattgcaggcatgagccactgcgtccggccctattgtgatttgttagtctgagtttagattacttacaccaggaggcattttttagcctaaatctgtaatcagttaaacaggaacactttctaaaaaattctagttcctaaaaggcttgacttctacttttattctgctcatttatgtgactggctatttgagtttgaattactggtacattaggaacgaaaataaggaatgcttccttttgcttccagattagacaatataccctgttaggtatgccagtgctgtgagttaaactgagctgtaaagtacaggaagggtagcattgtctgacagaactggaaaatgatggattaaaagtaagataaaggccaggcctggtggctcatgcctgtaaccccagcacttcgggaggccgaggcgggcggatcacctgaggtcaggagttcgagaccagcctggccaacatggtgaaacccccatctctactaaaaatacaaaaattagctgggcatggtggcaggcgcctgtaattccagctactggggaggctgaggcaggagaattgcttgaactcgggaggcggaggttgcagtgagccgagattgtgccactgcactccagcctgggtgacaacagcgaaaatccatctcaaaaaaaaaaaaaagtaagataaatagcttcattgacaattgaggaccttaatatgtctgacattaattttaaaagtccaaggaggcaatatattatgtagtatttcccagacttatatgagcatataacttaactcacagaataatgataatcttatccaattacctatccagcatgtgaatcctttttataatacgcttgccttatatttatccaacctctgtttaaatatctacagtaatgagtaaccatttatagtgatgatgatgatgatgaaagtgagaatgataatggctaagtagtgctttcttcctttatactttctatgcacagttttaactgccttaatcttcccacaaccctttgaagtacgtactatttattttttccatttcacggttgagaaaattgaggcctggagggattaggtaaattgtcccaggtaacacagcacaaatgggtctgggtcctagggaatcttgtcaagaatccataaatgtaacgacagcactattttctctctctctccttctgctccctctccctctctccccctctccctctccgccactctctcttcccccatttccctttgcctcccttcctctccctatccttccctttctttccctccctctccttcttctgtctctccctcttctctcttctccctctcctctcttctccctctcctctcccttccctctccctttctttcctctcttctccctctgtctccctctcctctctccctatctcactccatatatatataaattctgtatacagttactccttgacttgtgttctaataaacccattgtaaagccacaaaattataagtcaaaccattaagttggagaccttctgtgtatgtatatatcacaaccatttgatacctatgactgactgtaataactataattaaaaatgtattcacatctctaattcacccttgaaaaaattatattctctgaagttggcttttctgctgggagaataagattagggcctactttatacggttgttgggtgaatcaaataagctaatgaattgagcttacagcatgtagccgtgtgcatcataaggactcagtaacctttaattgctatcattattattaacatcattaatatgttgttgtacaggaacaagcctaaacgtaggccctggtgtactgatggacctgcttaagttcactacttctgagcacctggagggcaaatgctatgaatcctggcttaagttgctttagtctagccgtggcatgcttccaccaaagttctcatcttaccatcttacctcttccaaagtcgcctaattactcgcagcacataaatccgcctgttagattaaattgtggggaaaaagcaagggaaactgcttagatttaatgttagagaatgccaagaagagacatatttattatgcttattttaatggttttctaacacaatagattgggaaatcatgagtttgtcaaaaacaaatcttaagtcatggtgaattgcaaatgcccagctaaatcaggacttaaaattactccctttgtggaaatctctttttcttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctggtattacccagaacaaataaattacattgctgatatcagagtgacctgttaaaagtataaacatatcattttctactttaaaccataatccataactcatatcaacaaggttaatcccaaactctttttaaaaataatctgtctactactcaactttctactcagttttttattttttatttttatttctacactttttatttctacagtaatatcaaatcacttaaaactctcccaacaaacaatacctgtttatagttttgtttatattactcttgttgcactgaataacctattagcatacttaaggcagagtctttgtccttttctccactattacctgagcaatattcctggtgtcttgttcatagcagatgcttgtattagtttcttaggactgccacagcaaagtaccatacacagggtgacttaaaatgacagaagtttattctctcacacttctagaggccagaagtccaaaatcaggtgttggtagggctgtgctccgtctgtaacctctaggggagggtcgcatctctcagcttctgttagccccagttgttctgcagcttgtgggagcataactccaagctcatctctcatcctccatcttcacatgctgcattccctgtatgcctgtgtgttcaaattttttcctcttctcataaggacataagtcttattggatatgacctatcctaatgaactcatcttaacttggttacatttgcaaagaccctgcttccaaataaggtcacattcacacgtaccaggggtcaagacttcaacacatctttttagcgacacaattcaacccataacaatgttccatcaatatttgataaatgaatgaatacatgcattctcactcagcagtcgctcccgagaatccttctttttatgttcagaagagaggttatcaccccaccttcattttataggaattacgtcttactataccttgcacacactacttattaattttcatgtcacagtatatttgttcatatatctatgacattggttagattaggaattcctcaagtaagggcctatatattatttatcttcatatctcattgccttacatggttcccagaagggaaaaatgagtgcttattgaactcaaacattctctgaattcaaactctgaattcaaacatttgcttgaattctgactggattattttccttccccacctcaaaattgcattgctgtctgcttgacctttgtgtgacagtagaatggccaggtggtaaagttgcagtattgagacatacaacccatagtttttctgtctgggcctgttttactgtaatcacttcagacaacaaagaatgctttccccatctggggccagttcccctaactagcaaaatcctagaatgccaatagctgggtttcttggaattagtttaaatcattgtttgcaatatgtgtttacattgcattgaaaatatttgttggaaaagatgttttcatttttagcagtcatttttggagacgtttatgtaagagaagcaaatatcacatgtttgaagctagaaaatttctaaggagtacatgaaaattgcaaagcaatttctgtttgtagcttttagatttaaaaagtgatggctaagggcacattttcctctttagaaacgaaagggaaacatttcaacgaattattaagtattacataagtcttttaaaattatttgagatgagttataactgaaacatatacatagggtagttagtgataaattgagaaatgcaaaaatttaattgagcattggagataattattgcagatatttgagataagatgtagctgcaactaagcgcattcaatttagagattatagaaatcatgcatgtggcaaacccgtgaacctctgtttctctccatctgttggctttgcatctttacttcaggaagactacctaaagggaagaaatagaagttagagttttgaacttgctaaccataagtcgtgtgacttccaatatcagttatagtctactatagtaataaataaatattcattttgtgtgtcatctggaattactcaaatttataaaacttatctgatagtaaatatacaataatttaaatgaatgaaatattgaaaaatatctaaagttacttagatgtgacacagtctattttgctgtatatctcttaaaaatgcttttggtaatgcaagggttctttacaaagtattgtctttgtgaagcagttggcaaatcacttattaaatatttaacctgatgagttagttttattattcttaaggcaaatctttattaagagtaaaaagaacatttaaaaaataagtgtacagcacttgctactactgtgaatttattttttatcaaaagaagtatgattttgtattattttgttttgactatgatgttacataataatggcatccttcttcatttatgcagttggcttttttattgtttaagaaatttgtttatattactatttggttacttaatacatagaagaatatttaataatagagacatttgaaaaatataaaaattataaggaatataatgatcataaacctaaagatagctggatgaaattcactttgattttcatttctaagctcttttccaaaaagccaattttcaaagcaggttttcttgttttattttgctgtttttcctgcaagagttgagacactggttttaagggatacacttccattattcttcattatttcttatgttccacccattatacgtgaactatgtgtatcattagaagacagaaaacaaagagctggtcttcccaagaataaagtgtgaatcaaattgattttaaaattgctctgtgccatgcaagctgtgaagttctagaagagtacagtcagcgtcttggaaaagcctgtgtaaaataatattttggatccattgttttggttttcacacagtgacttaagtgtggcattataatttaagtggaaggcttttattggaaatttagcttagtagagctagattaacaatatatgaaattaaaaaatttatgttttggcagcaatttttgtgttttgtctgcagaaggtccttcaagtggggaagtttcatgctgaaagagccagtacaaactatttctgatgagctgtagatacatttgctaaaaaattttcagttattattgctctaatatgctaaatacatgttaaatctgtttctcataatttaaatgttctggatacaaaaatgcttaagaagtaagtatatcagaactgttttcttctgggatcaatgcattgccattctcagtggatgaagagctgagatttgggataccatgttgcaaatagaggagcccacactggcctcccttcctctactctggccacaccttgctattaattactcgaggataagctaaattatttcattcctttgctttctctcagaataaaatccacactccttgctatggcctgcatagtcttatttagaaatctacctaaccaatggctgggcacagaggcttacgcctgtaatcacagcaatttgggaggccgaggcaggcagatcactggaggtcaggagtttaagaccaaccgggccaatgtgacaaaactctgtctctgctaaaaatatagaaattagcctgggatggtggcatgcatctgcaatcccagctacttgggaggctgaggcaggagaatcgcttcaacctgggaggtagaggttgcagtgaaccgagatctcaccactgcactccagcatgggcaacagagctagattctgtctcaaacaaaaaacaaacaaacaaacgaaaaccaggccaggcgcagtgtctcacgcctgtaatcccagcactttgggaggccggggtgggtagatcacctaaggtcaggagttcgagaccagcctggccaacatggtgaaaccctgtctctgctaaaaatacaaaaaaaattagccaggcgtggtggtgtgtgcctgtaatcccagctactccggaggctgaggcaggagaatctcttgaacctgggagggggaggttgcagtgagctgagatcgcaccactgcactccagcctgggcgacagagtgagactccatctcaaaaaaaaaagccacctaagcaacctaattttaactcttgccactcattcctgcatgttgtgcctccaaagaatacccttttcaccgtgatctatcttcacgtggctgcagccttctcattatgttgttctcggagaaaccttccccgtgatgtatcttcacatggctgcagccttctcattatgttgttctcggagaaaccttccccgtgatgtatcttcacatggctgcagccttctcattatgttgttctcgaagaaaggtgtaactcttcagagaggccttgctttcaactatctttcataaatgatcccagttctactactgatcgccttattttatttttctaatagctcttaccactactgcagtttatcacttgtttgttctttctgttcctccttcattcctctttccttttttcttccttttctttccttttactatggtctatctcccttgagaaaatgaatattccatgagaaaatggatcttatctatctccttcattgatgtatccccattgcctagaaagggaagaacaggaactttacagtgaagaaaaggaacctggcagataccaactgaatcaagtgatcaaaggtagcatgacagtaatgggacagatcattattatgagcttgttgatgggttgcactaagaaaaaaaatttcacggaagtatctaattatgaggaaacatcacacaaagctaaactttacaaaataattgtcctgtaatattgaaaattgtcaagaacataaaagataaagcttgaggaactgttcaagattaaaggagattaaagggacatgtcaagtgtatatgaactatctcagatttgctttggttttaaaggacattactgggacaactggaaaaatatgaatagggtgtttacataataatactatatacatgtttattttcagatgacagttttactgtggttattgaagaaaatttccttgattttaggaaatatacaataaattatttagggttaaataaatgtcatgtctgaaacttactgtcaatgggtttaggaaaaaagagtgtgtgtgtgtgtgtgtgtgtgtgtgtgtgtgtgtacagagggcatagaaattatagaggaaatgtagtaaaatgttaaattttgataatcttggcgaattgaagcatatagtaattatactattattgcaactttctgtaagtctgaaatgatcataaaagttaagaaagatgcacctagttaaagtttctatccattaatatataatcagagggcaaaatagccacacagaagcagcttcaaatactggtgtacattcaatgtgcttactaaaacacatgatatagcattaatgttttacttgtttacaagttgaattgatatgaataccgaagacttgtatttttcctgttgaaataattgtaggtaagctagtagagcttatgggttccacttttagaataacatacaggttaaatattttctatacagctactggttgattaataacctcaataggatttttttccccacctaacttcctttgacgtaaaacaatgtttgcagaattaaagcagttttacaaaagaaataatgttgaccatataaccgagacttcatcaagccactttaatttctaaataatgatgttttatttgtttcttgcacttggaaattttgctcagtgaattgcccgacccaaaccttcaattgaatgtcttttaaatagtttgtactcaaaaatggcattttcttctttcagaaaatattttgttcttcaagtatgtttttgaggttataaaataagagatgcaaagcagaattcataatggttattatctggcataaaattgtaataacaggtgttccttgcagattccaaatagctggactgtaatggggaaccagatttagtttgtaatgggctcagtactgaccttccctgctgcactacctgtgggcatcttgctaacatgataaaatggccagaatccgagaagcacctttgtttatggggttggatacttgccatatcttcaaatataataaccagcatccaatcaaaaatgactgaagcataagagtgaaacagagtgcataataagagtgtgttagagtcatttggtgtgtgctgattttaaactcatttgacatcctgttctctgattaaatccacgcaagccccttttatgactatttttacaactgtactatctcagctctacatggctgagtcattatcaaacaatatatgaagccatgagaaacccagagaaagatggaaaagctttggtattatatgaagaatacaatgaagtagctgtccacagcaataaagtcacagatgaaaaccagatataccagtctagtttattaactcatgttcttctaacatatcccccacacaatatgagtgaactgagccttgtttttttgttgggaagtataataaataaaggatgaaacagacgtgatgtttatatgtaatgccaagttagttagctcaaaatttagattgagaaaaagaactgactacaaaagctttgcattggaaatttacatgacgcagcaagaattctgagctcagagctgcttctcccataaacttttgagaatcaaagactgcccttgatcacaaaaacttaccgtagctagctttttgattttgacccaggaaagctcattgaatgcattctaatgtcccatcagttttggaaaagtggtagtgaagcttcttcgaataggggcttccagtctactctttaaatggggcaaatatggacagcagcataaagcactgagggtgagtttttattcaactcatttcattcaatatgttagaattattgtagctgcttcttatgcatctcagattagaactgaaccatctccaaattgcaccctgctaagcagcgccgagccaagtaaaatgttgctacatgaccccagatcagaaatgctaaatcagatcctgccacactgtctctcagccttcccaaatccacttggctatcttctgtaaggaaaagttagtgtcaagaaagcaaaaacaactttcacgtcatcccctgtgaggctgtctcttcaggaagtctataatcagctgtcctctggtgtagatttggtgattttatgtataaagtcacttagcttgttttctcctggctttagaacctccaacatttcctttgcaatctctgttctccaccttcatatccatcaaattctggtcattaaatgtctctggttggcttcctactcattatgccttgttaccagatgaaaaatatgcacacagtcttcatgttcaaggagaacctctgtagcctctcaatttcttttttttcattttattctattttaaattacacataattgtatatatggggtacagtgtgatcttttgatacatgtgtacattctgaagtgattaaatcaggataattagcatatccacctcctcagatatttatttgcagtgataaaattttaagtcctcttttagctatcttgaaatatacaatgcattattattaactatcgtcagcatgttgtgcaatagaacacaaaagctcattcctcttatttaactaaagctttgtacacttacctgtttctagaactcttgacttacccattctattagtttcctaggactcttgtaacaaagtaccacaaactgggtggcttcaacaataacaatagaacaccaaaactcattcctcctatttaactaaaacttcgtacgtttacctctttctggaactcttgacttcccattatattagtttcttagggctcttgtaacaaagtaccacaaactgagtggcttaaacaacagaaatttatcgtcttacatttctggatgttagaaggccaaaatccaagttggcaggttgattacttctgagagctgtgagccactgttccatcctattcttctaccttcttgtggtttgcctgcgatctttggaatttccttgggttacagcttgttgccttcattttcacatggtgttctgcctgagtgagtacatgtgtctgtctccgcatttcctatttttatgagaataccagtcataatggattagggcacaccctatgaccatatcttaatttaactagttatacctgtaatgaccctatttttaaataggtcacattctgagctgctgaagatttaggatttcatcatttgaattatgagagacacaatttaatgcgtgacactcatcttgccacagtgtcttgaggccttccaccttttaatagcatatggcagatagtaatcagtcattcctttttagtacatttctgttttttacagatgtatatatttctgtctattctactatacttagagaaatattatgtatctttattctagggagatatgcacttaacaaaaatattaatatgtgtgtacgggcctaacaatgtgtgagattatataaagtataataatgaacatttcaaatcatattaccttcttttttaaattatcatccttacataaatcttatgatgttttcaagtatttctgtcttcatcattgaagctatgagaagataagttatatacctaaagagatcaaggaaagataggaaagaatcattgtaagtccactatgctcttcaaataatataatgaccagtatgaactgagataacctttagacagggtagtaggaatcactattgctactacccccatcattgtcactgctcttggtgggtctagatatgttttatatcaattatctgttttaatcctcctaaccctaagagacagctattagttgggtgcaaaagtaattgtggtttttactattacttttaatattattctcatcttacaaataagaaaagtaagactccaatgttggtcagggttatccacgtaaaatcaaacaccagtctattttaatccaaagctcatcaatgaaagctaaattttaggcatattaatgaacatgaatttgcagagtgtgtcgtttaaaaaggaagttgttttttttttaatattgagaatgaaaaaaaggcataatagcatcaatccagagtaaaggaagcccctagaggctgagtaggcagattctagggtttccatgttaacaggaacagtatctgatcagagggacagggctagacctaactgggtgagaagatggaatttcatagatgcactggttcaaagataattgagacttatgtggaaaatctccttttgatctactgctaacccaaagtctcctttattaacagttaatgaaaactgagccctataccacataccaatgtacacatgaaaaaagtgctcacatctttagttacaagagaaatgaagattgaaaccatatggaatgccaatatatatccactgaaatggctgatatgaaagaggctgacagtaacaaatactggcaaggatgtggagcaactagaactctcatgtgttataagtcagggtataaattggtgcaattactttggaaaagggtttgacaggtttataaaaggcttaaacacatctatgctatgactcagccattatgtttattatgtttgtacacaaaggagtttttccaagagaattgaaaacatgtctacaacaaaccttatattagttttttttttttttttttttttgagacaatctcgctctgtcacccagactggagtacagtggcgcaatctcgactgactgcaacctctgcctcctgggttcaagtgattctcctgcctcagcctcccaagtagcttaggttacagacccccaccaccacacccagctaacttttgtattttcggtagacacgggattttaccatgttggccaggctggtcttgaagtgctggcctcaagtcatctgcctgccttggcctcccaaagtgctgggattacaggcatgagccactgcacccagccagaatgttaatagctttattcaaagtagcaaaaatggaaagagcctaggtgttcatcagtaggagaatacataaactgttgtttattcatacagtagaatatgatgcagtggttaaaaatagcaacatgaatgaatcttaatacatggtgagtacaggaagccatacacaaggaaatgcatactgtttgtattcacatacaacaccaggataggggaacataatctatagtgtaataaatgaggtaagccattcttttgggggcaggattttacaaggaaagaatataaggaaactttctagagtgataaaagtattttatatattaataggattatggattgaactatatactttccttttaaatttcaacttttaggatcacatggtacactgtgcaggtttgtcacatgggaatatttcgtgatgctgaggtttgtgttatgatcgatctcatcacccacgcagtgagcatagtactgaataggcagtttttcagtccttgccccactcttttcctctcctctctagtagttccagtgtccattgttcccgtctttatgtccatgtgcacccagcgtctagctcccagttataagtgagtacatgtggtatttggtttttctgttcctgagttaatttgcttagagtaatggcctccaactgtatccatgaatgacatgatgtcattcctttttatggctgtatagtattctatagcagaactataccctttagattgttgcggtttaccatatgtgaagtattgttcaataaaaataatctttaagattatcaagctgtatggcttataggtagctcttgtgttgaagaaactactacatgtgaattcttgtgcttacccacatgctcgtgtaggaatgagcgcaaacacacaggaacaccatataacacatgcatgggaacatattccttatggggctgtttgttgttgttattttttttttttttagacaaagcctcagtgtcgtacaatgacatgatcatggctcactgcagccttgacttcccgagctcaggtgcttctcccacctcagccttctaattagctgggaccacaagcatgcaccatcatgccctgctaattttttgtatttttgtagagattaagttttgtaacgtggcccaggcttgtctcaaactcctgggctcgagccatctgccctccttggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaaggcagcactaattttaaaactcaagtgttatgtctgggttttttttttttttattaacctctcctagaactcttctgtgctgtcatacataaatcagaagattatgaaagaactagtcaaagtggctgtttccttctaaggctgtaatttggttccatgaattattaattattagactgatatggcatcagctcctcagaacccaatataaatgcaaaagcctcaccttatcagttataatctaaggagctgcagtaatgtcattcttcccatttagtggtgtgttatggggtttaggatattcaacccaacaaacttctgaaataaaatacaaagtaaaggatatttttgtgtgtgacgagatttgaaattcagtataaggaagcagatgtggattgcttcaagggttttgattgttttgaaggatggagttgtttcatagatgctaaagcaaataacagggcatgtaaaagactgtggttgaagaaaactgcctgaaagtaaagctttggaacatcttgcatctctgctgctgttagggaggaaataaataatgcaccatggattgaagttgtgctaaagatacattcagtatatgttgaaagcaaacatctgatatagtaagtatatttttcttatgcgaattacagctcttatattctttgaagcaagaactaaaaacgtattaattttttgtttgtttgttttgctggagtacttagctttaatacttgatgatgcctcccagttttctttggttctgtctttaatatgtaatgtcatgttattttaaaatgttctgaagaaaaaaatttataagcttaaattctgttccgttttgtgagcacaagattagtctccttttaggtgcaagtttttttttttagcagtttctggatattttagaagtgtgctcctcacatatacatacatctgattgtatcaaatacagactacagtatgcagctaatgttgcaaacgccacactgctcagcattgcagtataaagaaggaagtaacacctaagctgtaatgtagccaatggattgggggttctatgaatggaaattctaaccaagtagaaatatatgttggagttagctatgctaaagtaaatgtgttctgtttcactaacttagccattctaagagattatttagaaataattagtttgctaaatctctgcaaactttcatattattcatagaaatttcagtagctttgttactctgagcacactacagcaaccccagtgctctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaaaaagtttcctgaaataaatagattgtgccacataatttatgactcattaaaacaaaaacaaaagatgatatttcttctttagtgtgaaataactcattttctattttaaattaattgctttctataggcaaattaggggcaaatattcatcagaatggcaattacttgaaattttttcatgtttaatatggtactgttttcagttcattaatactattgaccaacagctactataaaaaattaatacttttccaaatttactttctgtatgagagattgattcattatattgccattgaggggaaaaagctatgtagaagtaagtttactatggacaggtttagtcaatactgtgttgagtagactgtgcatgagatatagggtagatttagacctgaattaacagtgcatcagactatgaaattttgttcagtattaaaacaaaattatcttgataagcatctccaaaatcacatttctggcccatcattgttggggtgtataccacggaactgagagttccctgaaacacttggaaatgatcactgatctggacttgatcccaaatgatggggctcattctcctttcaattttgctaacttattttgatctcctgccttcagttttaccagagatttgaattatgtatttggatttgcaataaactatagaatatggaggctcaggcgtttccatatattgatttattacatacatcttaagttttaaattggccaaatcaaaggtagtaggtttaaaacccatatggtaacttaggaatcagacagcatttggggagaagcaacatacagaaaatatcctttggtccaacccagtcattaaaacaagaaagagctattgaactggggaaaaaaagaaagaaaagagaaaaaaataatatcctttaggttagagtgctggctttccccacccaatatctgtgtcagtttctctggggtccctttctgttctggtttgcccttactctgggttagtttagattccttatcaccagccatggtaagccatagtaagcatgttcagcttcctcacttctgtaccctatctagtgtcttatgttatttttgcccctgtaagtttgagccattgtaacttctgtggccatagtttcaagactatgcttatgatgtggatgaaggtgtttttgtttttgttgttgtttgtttctttttctgtgggataccttaggattcattcatttgtgatttcagaatggagtgagagagagctgtttttgaaaataagttatgctaacttactagctgttactagttacataagttctctgagtctctgtttttttctctatttgtaaatgaaaatgttaatattaactatcttatttgattattgtgagaattgaatgagataacacatgtaagatacttggaattcaccctccatatactaaatgctcaataaatctactatgttcgagtatgatatgaggaaggtttatgcttctctaaaaatcactgcaattaattctagtttgggttaataatggatttggtctgttatatggattctaagtggaataactatgaatgttatttaaatgtatatttatatcaatgaagagtgaaaatcaaatggtttcatcattaccagcttaccacataatcatgctgtggtggaaatctacttgtaaagagtaacctctgcatttttcttcagatacaatcaataaatgtgagtgatttcattacttatgaaataattcaggaagaaatataattgtgtgcatcatgtaatataattgaatgtggacagacaaaccaagactaattacgggcttgggttttcccaggaaatatttatgtaagtaacttctataggtggatatcagtcctgtaaggattttgacattcttctgccttcagtaatgcagcactttctcatcttcaagagctagctcatttgtgaagctttcctgtgtaaccctaccacgaaataatatttttctactttaaacaattctagtatcacaaaaccagaagcttgtttctgtgctattttgaaattttctccatttttccataatatatatgtacacacacaaacatacacacacatatgtaaaagaaatatatatatatatgtgggtgggtgtatgtgtgtgtatatgtgtgtggtgtgtgtatgtgtgtgaatatatatatatatatatatatacatatatatatatatatatatatctctttttttccttcttcttaaattttattacaagatattggaatcacatgcttaccatccacccttcctcctgccacttggtggatatttgtatttctgtagatacttaagtaaacaatatagctcagcttcaaaagtcttagttcaacaaatcaaataaaaagatgcaaaatgtaggtttagtaacaagttaatgttctcatgtatgagtaatggtgcaaaagccatgactattataattttttaaatatttgaagtgttgtacctataagcaaagaaactaactttgtggtggcttttatttcaagttttccaatccttactttaaagacatttggattatgctgtgcataataggagaaatactgccctatgttccaactttcaatttctaaatttatttatatattactatatataagtatattattcaaaccccatcacaggtttgaaattaaccctcttggggaacatcataatagttttcttcttagacttcttataggataggtgtgtattgggaaattagcacattacttatttttacacataaataatcacttcattttaattttctgctctgatttccacctttcaggtatgtataccagatactgaaatggctgatcccactttgatcacctgtattacagaattaggttattttccaaatttgacaaaattgcaattaagaattgcttcttagtagactttgcagagtatctgagttacgttctttggatctcatgattttagaaatgtttagagaacattttgttcattccactaatgggaagatagaccccaagaggtttctcaaggtcagagagcctgctagggaaggagtcagacccagaaatcaggtctcctgacttcttgtataatgtcctttttagtgtaccatatttcctcagtcagatcgatctactcgtccctgctgacattcagaaatctcccaggtatttgtagataatgtagctagtggctattttggagcatcagtctagaagttaagataataaaatagagttttcactttattatgtttttgtgtgtaaattatttcacaacttaaagctttatttttttctgtaaaataatcataggtttctaatattttggcttttctagttttctcaaatgacttgattgaagacaatctgagtaattcaagactagagaggcaaacaagaaagaaggaagaattatttcattcttattaggagtgaacagtgcacatggtttgaagttttcatcagggattccgaatctgttgtttctatagctaataatagattgctcttcagataggctgctaaactttgtagaggttaaaactttcaccacacgagtgtggctgtttgttcaccgcagtgcattgccaggtaaactttaaccgaaagctcaagagatttgatattttaatcctacaaaagcaattttgtttgccagcaaagtaatacctggatttttagtttctcagaggagctaggcatagaatttaaaatgtattagagctgcccttggggctaagaacatctgctggactgtagtctaataaaacagaatctgacaaagatgaggtctatgacatgtactctgctacaaccatacttgagtagatcaaacgggttggtttgacaaactgatcaagacaacaggcttatggaaactgcctcactaggacagctatcctcttccttcagggttctgccccaaatctcccttgcagctgaatttaatgggattttatcatatccccaacatgcagtctaagagctgaactcccacctcttttctgtttgacagaatctctcttatgagcttagggataaatattgggacttagaccaaacaaaaattggtgaaatttttggaaaggagatgtagatttaaacttagaattgtcaggttcaagtcttttcctcctccatctctgattttttattttagatttttaagtattatgaattcatagtagtcgtacatattaaaggggtacatgggatattttgaaacaaacatacaatgtgtaattattaaatcagggtaattgggatattcatcacctcaatttcctgtccctccatttatctgtattaggaacatttgaattccactctttcagttattttgaaatatacaataaattattgttaactagtgaccctacttgtgctactgaacactagatctttttccttctatctgtattttcgtactcgtttgccatccctctttatcccaactctgattttatctaagcctctcaatgtgtcttatatctactagtttcttataaaatatagtaatagcaattcccaccttctttatggtacaatgtttttctagggaatttaatatacctaaagtatatgaaagttctttaagcaggttataccttacgcagtacaaattgctgtgattgcaatagttccttgtgtatctcatcttttgaagagaggagtgtattaacttcctggagctgccacaaactgggtggcttaaataacataaatttattgtcttatcgttctggaggctagaagtcagagatcaaggtgtcggcagggttcgtttcttttgaggtctgtgagaatctgtcccatgcctttcttctagctttgggtggtttgatagcaatccttggccttctttgtcttgtatcacgccgagctctgcttaaaccttctctctatatactagtctatgtccaaatttcctccttctaaaggatgccagccatatttgattaggggcctgctctactccagtatgacctcatcccttacactagatataacctcagaattatatctgcagtgaccctatttccaaaaaaggtcacatcctaaggtactgagagttaggacttcaatatattaatgtgaagggggacacagttcaacacataacaaggaacataacattttttttgtctcactgttcttaacttactgctgcttttactcaaaaaatttgggatgaccatgatgtttctggatcttcccgtccctctgtccctgctcttcctgtaaatctcaacctactttctaatatatttcttgtataatctcaaagtacaagaatatgcataccataagataagcactgaataattgtaaatcactcttagtaaattagtagtctaggctaatctgattgtcagctgttaattttgtggtttctgagaatcatcaaataatgtactcaaacctgctgattgtttatatttttttgaactacaaagaactttcatttacagtattacatctaaaccaacatagttaatatttatattcttatcaaagatgtcaaacttcaggtgtagaggtgatgaaatgccaaaagtcacctggctagtaattaatacagcctgaattagattttaagagtttttaatttcaaacctagaattctttctgctctatcattatgctgctctttagaaaatgggtatagtaaggtttgtgacctctgtttgaaacccatggaactacatagtggaccctatgagtacagattgtccatataatactttctcaatttcttcacatcagacatttgtgatttctattatctatccacagtggttattgtgcatgaggctctatagttgacataaatagtgaaaagaattgtttcatttctctgaattgttgttctgcagaaacctcatgtatttgttttctagtgctgctctaatgaattaccacaaatttagtggcttaaaacaacacccatttattagcttacaatatttatggatcagaagtgtaaacacagcatggatctctgcttagggtctcacaaggcctacagcaaggtcgtgacaggcctttccccttcctggagctggaggagaaaatttgttttcagtctcattcaagctgttggcagaatccagcaggatgtgattgtatgattgaggccctcatattttgctggtttttggctggaggtcattctcagctcctagcatctgctcgcataccctggctgctggccctcttcaaagccagaaatgatggtagagttcttctcacattctctctgctctccctttctacctcatctgtcctgcctcaccttctcctccacatatttctgaaggaggctcttctgtcttccccttctgcttttaaggactcatatgattacattgggccaactgattatctagggtaatctccctgttgtaaagtcagctaattaatcaccttaattccatctgcaaagtcccttcacagtaatacttagatcggtatttgatagaataatcagtaaatgggaacctttgagggacagctctagaattcggcctataacatctcagtattttttttctttttgcattaagcattttcaaatcagttctttacccccaaaatcatgttgtttagaatgtactaggtgctttcaacttatgttattcttatggcatctgaatgggatggagacagtcatccccatttcttcgataagaaagtaaaggcaacaagtttaaaaggttttatcagatacacagggagtataatttaaagtatatcagagttcttctcagtgtaaagtacgtctgctagtttttaacataataaaagataacaagcccttattttattctttctgttttaatcatttatgtaattgacttgttctttccatatttcttcccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatggcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaaaaacagggaaagagaaaaaaaaaactatggtaataattgttgcagatgagatacactggcatgctaaatcttgtggatgaaagttcaaaaaaaacatttcttactctcaaagtatatcctcccaaaatttattaattataaaggggaaatgttaaatttcacattggaaaaacccagcagataccaccttaatcaagtgatcatgtttaatatcaatggtaagacattttgacatcatgtacccctgacatgacacagtgagaagggcacatcagttctgtggtttcttgtgaaaaatatataacttcaatctcatcatgaggctgcaccaggcaaacctaacatgaaggacactctataaattaacttagcatcattcttcatcgtatcttcatatcacaatacaagaagaggatgttagtgaaaccattggtaaaatccaagtaaagtttatagtttgttccctgttttgataattgcactgtggttatgtaaggtatgaaccttggagaagctgggtgaagagtgtatgggaattctctgtactatttttgtaattttttaaaatataaagtaattttttttaagtctggctctctcattaaatagctttgtaatattgtacaacatacctcttttgagtctcacattgtccatctgtaaagtttgcctaacaatacagagcctgttacaaagtatgtgaaatctaacagagagacaatgtagcctcatagttaaaagcaattgctttgaagtgatataagtgtggttttaccagttaaaactgtggaggaatgcaaaacttacctaactttattaagcctcagtttccccatttttagtactcagatgcacttactgtgaatcttaaatatgatatagcaggtaaacatttaacccttcttagtaggagatgaactgagaatgaggaactacaaatttgaatccaaagtcttaaattccagttgcacttattaggatttttttacatgaagcagatattaaaattaagcatgcaagatatctttcttcgtctaactcacatattgaagtgaacaacttttatttagggagtttttatacaacagcggacaagggaaaatttagctcgtgttattttgaaagtggcaggaataaatgtttgattaataagattacaggcatatttgcatctggagagaaggttcataaaagagttatttttacttgtaatttatttagcttgaaacagagggaaaaaattgagattaatcagttgtcaaataccttctgagaaacccaaatatacttaaagaatcatgctgagatctgacatacttctaggtttttaaaggaattttttttttctttttgtttttgttttggctaatcagtttatgaaccactttgtctatgggtaaaccaagatctgataactctcagaacagaactttcataaatctgtctgtggaaaaatgcctcaaaacatataaaaatcataaaataaagggaacaaatataaagaacactggagagggatttgggtgttgtgtctgtatttttgcagtcttagcttcatgtgctgcctgaccacatacttcgtacttgcttcctcctctgtcatttgagatgttatttggttgtgagaaggtggaaatagcactgtatgttaaaattgattcccaaatgcgtcaaaatgtcgtatctgtggtctgatggacaacaaacaaatgcaatcatgaaaagttattcccatcctgacaagactttaagaaaatccactattttgagaatgggtaagttaaaaaattactacataaaataaatcttcccttcatgtaatattccctatgtgatgagtctaaattgttggcagccatactcctaataatacacgtatgtacatatctgtgtgtgtctatgcacattttaaatacttgtgacatatttatttaaagtttatttatgagcagtatggtagtttaaaaggattatgaaggtcattctgtgtgtcaaacgttgttttaagaagaaagtatctgaaataaagtagcacttatttgttgctttgtttttattctgattgcagacaactgtgtcatacagtatatgaccaagtagatatttttctgtacatcctaagagagggcttggactaggccatttctgtattgatatcctgagacctacatatccctggagaccaattacaaaggttcacaaggttgtttttattttgttttctcttgattcctttttaatgaggtctcccagtaaacagcaagcatgatgctttcctgttggaggcctgtctgccgccttcaaccatttattactaattcatctgggaaatgatttataaattaaatattaggaaaatgtacttgaggaaaaaagtggtaagaggtacaatttataattctcatttaggagaaagtcatgccagcagtttgctaatggaaggatgctgagagtcactcatagaaatacagttgtggtttatgtaataaatagagatgtacatgaagagaatcttcaatgtatatttttgggcatgtgattcattttaataaattgtgaagacagaagttcccaatttttctcttcaagtgaacccttggaaaattgggaaataataaagagcagaagtgacctatcaatatgtgctatctcataactcctcctcatgacaaaaatatagtatttatcaatactaggtgaaaatagcttcatcatagaataaaatgtggtgttagtagatgtcagtgtcatcatagatttgtgcaagaagggattccagatgctattttagaacaatcttctcattgtacagatgatgaaactgaggtcatccctgtttatgacttacctaaggtctcataacttttaagatattaaatttttgagattatttataaagcttcaagatttatttttgcacttgtaggcagtttttgtatgaaagaaatctgcttttcagctaatcagtcagattaggattgtgtcttatgagaatatcttttacatttgcgttgttgaaggaagatgaacaatagctgtgtctctacacccagaattaaagaggaacaaaattatagctttggaatcatcttctaaaattttattaattccagggaattaaagcacactcatcttgcaggttttatttaataaaaacgtttgttactttttttaaagttctgagtaatttctaggtatcttttcttttcttttttttttttttttgagatagtgtctcgctctgtcgcccaggctggagtgcagtggcatgatcttgactcactgcaagctccgcctcccgggttcaggccattctcctgcctcagcctcacgagtagctgggactacaggcgcccgccaccacggctggctagttttttgtatttttagtagagagaaggtttcactgtgttagccaggagggtctcgaattcctgaccttgtgatctgcacgcctcagcctcccaaagtgctgagattacaggcgtgagccactgtgctcggcctctagatatcttttcaatactgctatagtggttgcattatagcaatcattaatctcaaagatataagcagtgaattcataactgtgaaatcataactttgtggttaatatttttttctgatcccattttaatctttttaaaatttcatttctgtttgaatatttagactgtacttgaatataaatttcaaacataattaagcacatgttatctttatttaaaagatgaggcatatgtatattatctatgtatacactatttaaatatgtccatgtatacataaaattatatgttatatgtaattttctaaattatatatatatactgaaacagacagatacagtttatggctgatattttctggtgaaaataatttaccagtatgggtttgttggtgtctggctgtcaccactaagaaaagattctactgggtcattataaaaatttcagtttgggggaatgttaatagaaattagccatattatagtttggacagcacctatatgcagtttcatttaccgatattaacttagcacatgctggtttatgaggggaaacagaattcagtggtgcacatttaatcatttttctttatctaatttaaatcatattcttcttgataaagtgttatcttggccaatgtaagaagatggaggaccctcccatgaactttgtgggacagacactgaaaatctgtgttgacagcatgtctctaactcatccttctcacaacatttgctgttggaatagaacagagaattctgtaagagtcatagtttttagataaagattgttacagaggcataataattccagaagatttccatcttctaacaatctcttgaaatcaataataaagacaatggctttctattcgtccactttaccacatcaggcagtggaaatagaaaatgatataaaattaatcccttctcttgacaattgtaaaatggtaatcctccattttatcctctcagaggatatttgaagataacttttttattatcctattttcatattctgtctcataacctcatatattgtatagcccatttcattgctggtggtcaaataagactgcggtagaaagccacaggtaggttactagggttctgaagaatgtatcagcacagaaaaccaatttcagatatattttcaatgttattgctttagaatacatctcctttactgagacatcaaaaatcaaagactagatgagctcattcatgtgaataagcttggggataaattacctctttctagtttcatattaaaagagcagtagcatagtcagcctgactgtgggatcttggtcaagcaaagctaaatgttcttttcctaatttttcatattatttaagtgtagtgtcagaactattccttagtgtctttgttagttttgctcttaactgtagtctcatgtgttcagaatgagcaccagccaacaaatacagacaaatgcaatatttcaactgtactttacatataaaaagatggtgttaatacactctcttctgtggttattatgtagtttacttacaaactgacatgcatttttctcacttataagtgggagcacgtatgagaacacacagacacagggcaacacacactagggcctatcggggtcaggggcaggatgagggagcacatcaggataaatagctaatgcatgcagggcttaatacttaggtgatggattgataggtgcagcaaaccaccatgatacacatttacttatgtaacaaacctgcacaccctgcacatgtatcccagaacttaatagaaattaagctaaaaagaagaaaaactgatatgcatgatgcatgcttatttcttcagaaatattgagatgtttatttaatagatgccataaagctacctgaaatctaactaagagaatcctagtttactgcatttgttggcaaaaaagtagactattgatataaaatattttgaagttgcagccttacatgattgccctgtttagttttttggaatgtcttttcataaggaagtttgattctttaaacttggaattccaaaattcccagtactttcaatcaatggactaatcgcttccctgcctgctgcctgcctgcctgccttcctccctcctgctctttctttcttcctttcctttataataaaaaatcaagttattggaaaaagtattgagtcactttattctttgtgtcttactatgtaagtttcaaatttttgtgcctttttgcttttattctgtcgttgctgtatttcgaagcatcgttttccccttttccattgagatgtagtatacataatgtaaaaaaccccttaaatattacgtttcatctattgctccatatatgtactcatgtaaccactaccttgatcaagatagagaatatttccattaactttaaaagttctcttttactccttgtctgtcaatacctcttctatcctgaggtaatttgtcttctgacttctatcaccgtagattaattttgcttgttcttggacttcatataggtggaatccaaaagtacgtactgttttatgtctggcttattttgctcaacatactattttttgagattcttttgtattccatgtatcaggagtgtgttcttttcattgctgtatattatgtcattatatgaatatatcgcaatctcttcatcctcctcctagtgatgaatataactgaagcaaatttacaaatactttttttttttttggaggcggagtttcactcttgttgcccaggctggagtgcagtggcgctatctcggctcactgcagcctcctcctcccgggttcaagtgattctcctgcttcagcctcccgagtagctgggattacaggtccccaccaccatgcccagctgattttttgtattgttattggagacggggtttcactatgtcggtcaggctggtctcaaactcctgacctcaggtgatttgccctcctcagcctcccaaagtgctgggattacaggcatgagccaccacacccggcccagtcaacagttctcgtgtcagatgggtgtacccacgtggggttgtggtttgctcttctaattcttatgcaatagtaatgagtctttaaaacaaaatcctgtgtttgaatgttcttgaaatctcagaaattatctagcaaataacagggcttttttttttcactgcatgtgtgcatcatacgtatatacctttgtaactgaaaacaaaaggtagaatcgtatagtagttaggatagaaagctgtagaatcagattgcctgaatttgaattacagatattctacttgatattgtgtgagttgaggcaatttatttatattagctgtatcttgctttttaaaaaataaaaaaggatattagaaccttcctcatagaattgttttggtgattaagttagactttaccttcagagtagacagtaagcactcaataaatgttaactgttattgttccaagtatgtacattatttttattcaaaaatgtgtgcaggattccatatgattctacaggattccatatgattctacatacatatgcatcgttaaaatgtactatgtagattaggttgatctaatgactgtcttctctaaccaaaattgtcagagggctaactcttctcactcattttggctcttgtatctctactttagtggaaccaaagtgaatgataacaaccagagagagattgcttcttgactacaaataatgagatactccagtttaaattagttcaacaatgttcttgatcaaatcattctcaatcacttattttcagaatccagatattactgctgtgaataacaaaagaaaactcaaatttctgttcttgaagcattaagcctcttgatattgggaaaatggtgttaagtgtgaaagaaagacagccatctaatttgttggacatctaggtgtgtcatgctaaattctttagatttgaaaaataaatttttcatagtatttttctattctgaaaatatttttatataaaccatgatttctttttttttttgagacggagtctccctttgttgcccaggctgaagggcagtggcgtgatctcggctcactacaacctccacctctcaggttcaagtgattctcctgcctcagcctcccaagtagctgggattacaggcacacaccacaacacacagctaatttttgtatttttagtagagacggggtttcaccatgttggccaggctttggaactcctgacctcaagtgatccacctgcctcggcctcccaaagtgctgggattacaggcatgagccactgcgcccggcccatgatttttaaaataacaaatttaaattatttttctgactacctaccatttatagctgtaagtgtggattctttcagttaaatatttaacgtgtttggtgccaacaactcagtatttagcctaatccctatttcagaatccagagtctatattggtgccattcgttgaataccgaggatggcacagagctaaacctccatcaccccatagacagtggggacagtgcctccagcatacgaatgatataggtagagatatggctgcaaaatggtagatgtgactttctgacttgagggatttcagggttttctaacaatgtaggatggtgggtagataccaaaggtccatggctttcatagaccagtgatgatacttgaattatttatgtaagtgtttcatccctcctattaaactgcaccttctttgggagtaaattttaggtattaatttgtttcttctacaccatttagcatattgcgtgcgcttagtagatcccacataaaaatttctcattaaatgaagtaagcatataagcctaaaaagtacagtgaaattttttaaaaatgccattttaaaagaatatgacaacaaaaatggcatatgtatgcattaaataaatatgtaaaatgactctcaataaaatgttaattgtgtagttatttttggctgggaattcaagtgattaaaacttctcttttttgtaattatatcacttgttaatagtaattgatattatttatattatcagaaacaaatgaatatgatcatagtagattataaaggaaaacataaacaaaccattaactgtagaaaaatcaaaattttcaaagctacttttcccaaaattatcatacctagacattcaaggagttgattttgttttgtatttaaatttttctatagtatggagaaagaaggaatattcaaaattatttttataaagccaccattacattaatacaaagatctgccaaacacagcccaaaagaatatttcagatcaattatacttaagaatatatgttcaagaatcctaatttaattcatcagattatttgtacattaaaggaaaagcacatagaaagaaaataaacattgagtgagcctcgttgcaaaactcttctgatatttcaaaattgggaagcagtttcctttccatgtaaatcattatttccaatatattaagtataatacaagtgtaggtttaatcaatttctattttggtaactcatttaagagcatcactattttttatactgtggatgaggtattctgacttctcagttgccttaaaagagtgccagggagtcatactgcagtgttaaatgtgctcttctgccttgcattcatgctaagaaaaccagtgtctattatgtggctcctcgctttagccttctcagcatgaatgaccattcaaggagcaacagtattttataaaagtattgattgtgttggtttgtaaagggccccataatgttcttcccacatcaaacctgtgctctctgtgtaagagaaccataatagctacagcctcctggtaatgtatatgaattgtacagaatttcagtttatggatcagctttgtaatagtgcagagtttcacttggcttaaccaggtgtgggcaattgttgggtgcctttaaaaagtcataacatttccagggacagggatgtaatgggtcattttataagaaagaagaaaatgtattaaacgtaccacattatttttagttcaatggtaggtgtaagacagaaagtacgtttgcttggtatacatttctgtgggacccagtgtttggctttggtctgctaatttcctttgccttttcctatttaagtttttttcttttattcttctattaataatatgatttctataagtttcagaaactttctaaacaataaagtactccatttctgcactattgaggttgatgttggccttatttattctcaccttttttttaaatttggtttttgatttgggatttggggtggcgctggcttattagcgttcttggttgcagcacattttcctccttcagtaacaactctagaagcttaataaccaaagttataacctacatttgttttactgtgctctaatactcttaactaccgggcagatttcagtataaggtgaattggcatgagaattgtttagtcaatcaatagccatttaataagcatttggttacatgttttggaatttttaagagacatataagatactagtgtgccatgttctcacagagtgaacaatctagggaagcaagaaatatatatatatatatgacaatggttttaggtaataaaatagaacttttaaaataagttataagcttatttcctcatagtgatcattccatatcacaggccacctgcatcctccataaaagaataggattcttaaatttgatgtttaatagattgtgtcactttacattagccctaattaactttttcctagtaattttgtgaccttcaaaatttacttaatttatcaatgccattagtttttcatttttaaattggagatagtaggaatatctgcgttatataacatatgtaaaatgtaatttaaatatacagaaatgaaaattgggaggtaatctaaccatcttgtgttacatatgaggaaatcaacacactgaagtaggaggcttccccaaaatggaatattgagcttcattagtggatattacatttgttgactcttcatgtttcctcattggagtttccagatgccactcttgcttctgaaaatcgtgtatgacttgtgatgtaacaaaaatcagagggctttccagtgtcgcaactttcttttttttaggacggagtctctgtctgtcgcccaggctggagtgcagtggtgtgatctcagctcactgcaagctctgcctctcgggttcccgccattctcctgcctcagcctcccgagtagctgggactacaggcgcctgcaacctcgcccggctaatttttttgtatttttagtagagacggggtttcaccatgttagccaggatggcctcgagctcctgaccttgtgatccacctgcctcagcctcccaaagtgctgggattacacgcgtgagccaccgcgcccggcccagtgtcgcaactttctatggtataagagttactttgtttagcagaagtctcacagtttgagaattaaccttctcagtggagagctggcagactggttataaataagggcttcagctcccttagtgtgggacatgctgcccgctcccttcaggtacttatctgtcctggaccagacagaagcacatctgcttttcatttagcttacttccatttctccacttcctctcttttgtcagtgttaaagcttaaaatgatgaaacaatccagcagttatccaactacagataaataactgctggactgtatcatcgtagacagttggtgaaaaattctagaccagaatccagtcccttcagtcttgtattctttctaatgtattgagaacaagacaggaacattgattacctatttttagctggtttcaaaaacagtaacctcaattccacaatcaagatttggattcagaaatactgagtttgcactgagctctttcctgcttcactttggggtcatgagaaaggctgtgaatttctgcttcattccgattccctcattttaataacctgccaggagacctctaggggagtgattgtaataaactagctaataaaatgagattagaaccttcaaaactaaacatcctcttatgatacaatccagcaatcacactccttgagatttacccgaaggaggtgaaaacttatgtttacataaagacctgcacactgatgtttctagcagctttattcacaattgccaaaacttggaagcaaccaagatgtccttcagtagatgaatggttaagtaaactgtggtacacctagagaatggaataatatttggcactaaaaagaaatgagctatcaagccatgaaaagacatagaagaaacttaaatgtgtattactaagtgaaaaagccaatctgggaaaaaagctatatactttattattccaactatatgacattctggaaaaggtagaatgactatgggaagagtaaaaagatccgtggttgccagggatttggggtgatggagagattaatagagcacagaggatttttacggcagtgaaactaatctatatgatactataatgatagatacagatacatgttattacaaatttttccaaaaccatagagtgtaaaacataagagtaaaccctaatgtaaactccggactctgggtgataatgatatgtcaatgtgggttcactgatgataataaatataccgctggtgaggtatattgatagttcagagaggctgtgtgtataggagggcaggcatatatggaaaatctctgcaccttcccctcaattttgctgtgaacctaaagctgcctagaaaaaataaagtctgttaaaaaatcaccacagaggcaaaatgtgagattagaacaacctcttcaaaataatacacagaaagtatttacaaatgctaactaagacatagggttcaaaacgtaaaactgctcacagcccaggtactaaaattagatcaatctaatcattagatactcaatcattagatacaatagaatttgccccagtagcaaatgtttacttttgattctgttatacactacttaacatggtccagtgtcagcataaggctgtaatttggcgattgcatttctttatttaataactgctgataaagctgaaataaagaatcagtaaaaaggtttcacttttgtaaagcacatccagggtttataggaaaggaaatatttcagcatttctgatatataaaagaacaaaggtgttatattaagaaaaaataatacataaaacaatatcagggacattgaattgatgaaagtaatcagtaacattttaaatccatgttggcttgcattgtgaaagaagggaataatttacagttcatgatatttgtatttagatgtttgtatttttattgtgtttagagaatcccaggaaaggaaagaatcctacaacccgtaggatgaaaaaagctttggatctcatgccaggacaagggcactgatgcccaaaaagataaaggccttcctcagaatcttatgggaaaagtcaaattatttaaaattagctccagggttcatgagtaagattaattggtagaagttaaatggctatatggttcacgtttaaaaataatttctaaaaattggataccccttatgagagaaaatataagtggctttgagtaatagtttatattccaattattgcaagtaatcaatcatataccaggtaatttcctgacatgagttacataccaaaaattatattggatgaaaagctcgaatgaatataggtaacattccactctaatgtagctttctgtatcttagaacattcaactttattaagactttatagtttttaggaatagagttaataaagaacttggaatcttctatcaagaaataaagaggtgggagtggggagatctacctctggagattctcatgtgttcaggatatattcaacgtttatttgttcctaggcagggtacagaataaactgatacccgtaagtccattctagcccaatgtttcaaaaaatgctggcattttagtgaaatgtaatatggataacataaggtaacattgcgaatagtgaagtctgcaactaaaagataaagcatttaaatgtcaaatagcattgtgtaaataaatctaaaatgaaattttcaaccagtttttaaaacttacttccactaacaaacataacatagtgtcatgcagaagatgatgaggaagcaaagaatatgttaaggaaacctgtagaaaaccaaatgccttcttgtattaaatgagtttaccatgtctttcaaggaataatcatgtttatacaaatgtgtgtggtttccaggacccatttttcttttccttccctatacatgcaaacatatacaaatatatcagctcacatacttatttccctgtggtttcagactattaaatgtttataattactctgcttgatgactgtaatttttagttacagatcgaattgtcccaggtgtggatgctgccaaaagccacggtcattggcaacatgacatctggaagacagtctggcatgtagagtcagggaatttgctagaagttgttcctcatacagtgcaatagtacaagcaagcattgtgactccctgcagctggtgctgtcagtgccctatccatatgcctcagacctttaattgtgtttctgaggaatgcttctaactcctagtatctgcaggtttgttcctcagcactttttccaaaaactgtgggaaattgcactgcttatatgcacaagtgagcttcatataaggagaaagaaaaccctctaggaatagttcttaattaatgactctcaagaggtgctgtataaataccaacttctctcacctctctggtgggataactctgtgaggtgtgctttatgtcatgtcagagtttctctgcaggattgcctgctatattcactgcttgaatagaaaattcttttttttttttcctttgagacagagtctcactctgtcccccaggctggagtccagtggcacaatctcgggtcactgcaacctctgcctcccaggttcaagcaattcttgggcctcagtctaccgagtagctgggactacagacatgcactaccatgcccacctattttttgtatttttagtagagacacggattcaccatgttggccagactggtcttgaactcctggcctcaagtaatctgcctgcctctgcctcccaaagtgcattgcagctgtgggccaccgcgcctggccaaatgttctttactggacgccttcaatccccttgtcatttcctcattttctttctggcctgcacttcttaaactagttacactgtaatacttgttttagagtctgcttctgtgattaacgtttctgatcagtaaaatggcatagcactgcttacctcaagagatggccgtattttgtcagagaaagaatgtacttcacgttttgcctaataaagtaaacgttcaggacccagcagttgcattttaaatgatcccagtgtttgccctgtttttgaagtacacatgtgcttctgggaaaactcaaactaagacacaccccacacccaactggcaaacacatgccctgttgaaagagtctgcagaagagtccttgcttcaggtacatttttcacattccagtcccagtttagccctcccccatcaccttaatgaccaccattgcataacaagcaatgccttcttgtgaggcattagaggtgactaggagtgagctttagggtgggtacccttcagggggtttctttttttttttttttccttgactaggagtctggctctgttgcccaggctggagtgcagtggcgtgatctcagctcagtgcaacctctactcacgggttcaagcaattttcctgcctcagcctcccgagtagctgggattataggcacttgccaccatgcccagctaatttttgtatttttagtagagacatggtttcaccatgttggccaggctgatctcaaactcctgacttcaagtgatctgcccaccttggtcttccaaagagctgggattacagatgttagccaccgctcccagccccagccttcatattgtttatcttgatttcttttttcttctctgttgtagtggatagcaccagacaatcagtagttgaagcccttttcacatcttcactgggcattctattaaatgacatatgtgttctccccaaactctaacatctgttcattgaaaatagggcaaacaccaagaccatttgtaatacaattgctgactattgaatatttactttgttagaaaaaatgctaagtactttacaatatttctctgcaataaaactcatcttttgagctaacaatgctattctcattctactaaggagaaactttagtcacagagagattaaataatttgctcaacaacacacaaggaagtaagagtctgggagagaatttgtacttttcccttccttttagatgtcattcataaaaaaaaaaaattagtgtacctgattttgtactcctagccactatttaatcctgcctctgtaattagcttttatggataagtttatctttccgtactcagaaaataaaatagtaaaataaaaaggcagcacaaggtgtcactaagtggctttcaccagaggtgaagttgtacagaattagagaggggttttaaccacatctagagcactgcccatagaggaatgcagaccaatttctgaagtcaatttgtgttatcccctgctccttaacctgggttccaataccagttacatttaaggaactctccttccccctctttccagacatttccatggtagaaacacagtagtagttcaggagttaggagacctgggctttagagctttttataaaatgggatgtctgaatttgatagtgtgcaatgttccttccaactccaaacagatgttgtcattttcacagcctctagaagccacaggtaccttctcaattagaagttctaaatgatttgtaatagtgagcactatttggattcctgacagcctatatcaggaaaataagcaaagttttggatcaagtgcttatatctaaagccattgctttataagctggtcttcactgccaattccttcttccctatagattgttggtatttctggtctggatgggttacaagaatttattttattgatttcctgaatctctgtacatccttaaaataattcagaattggaaagaaatacatttagctctttgtcacatagtgtagagatcttttgacataaagagagagctgctgatattctgtttcccctaatgcctgagtgtggcatggtttcaaagggttgctttatcacatgtagacatggagggaccatcaggtaatgagatataacatttcctggaaattaattagtggtgtgttgtccaggaactaaatttcttttactcctgtttgccacctgtcctggatgtctagtgccgaatttgaatttccatgccaaactgaaaaagcagcattggctttagttgccctctttttcacattaacttagggttttagcatgtaaagcgactgcgttgttttagtggaatgaacttagaatgaacttcaacagtgatgaactgataaccaattaaataaataattgattcatctgagaacagtctgactcctagaagtggtgttcctaagaagcttttgtgtaactgccctctggaaagcctcacaagttgttgcctttctttctttattttttccaaatggacaatttttgacaaacaaacttctaagagcagtcaagtgtcaaatacaaagttatggctggtgcagctgcctttgggatcacacgctccatttattcattatagaaagctcagatgcacaaacatgtggtgccattttgtgtacctgtcagtttagtgcgtttaatgaacattgatcatgctcatccagacacacttctcgatgctgcaagcaggaagtcagtggtttctgaaagacagggtgaaaacttgttttttttttttttttcaaatgtgcctctgtggaatcctttttgcccaaaatagatgcattaataaacatgactaaaatgtaccttaaattcactacaaaagagaaaagatgttgatgaaaaatttgctctggttttgctaatattaagtccagtatttgtctacttaaagtagaagttttgatgacttggataatcattagattgctatctagctatttgtagttttgtagcatcatctgttccaaaactgattttttgctctcttttaataccctgttaattacaaaacctcctactgggtagttttaccatacataaattctgtcaagtactgctgaattaattggtgccgaacatcgttccggtctatggtgggagtaatagttcttattttcttgccttttaatgtttggacacaggaaaaggaatatcacacaccagggcctgctgtggggtggagggagggggttttttttgattaggcaacatacctaatgtaaatgacgagttaatgggtgtagcacaccaacatggctgtcaaaattcctttcaaaattctcataaaagaggtagtttagcttctttttttaaattgtattatactttgagttctagggtacatgtgcacaacgtgcagggttgttacatacgtatacatctgccatgttggtgtgctacacccattaactcgtcatttacattaggtatgtttcctaatgctatccctcccccctccctccaccctacagcaggccctggtgtgtgatgttccttttcctgtgtccaactgttctcactgttcaattcccacctatgagtgagaacatgtgatgtttgtttttttgtccttgtgatagtttgctgacaatgatggtttccagcttcatccatgttcctacaaaggacatgaactcatccttttttatggccgcatagtattccatggtatatatgtgccacattttcttaagccagtctatcattgatggagatttgggttggttccaagtctttgctattgtgaacagtgccgcactaaacatatgtgtgcatgtatctttatagcagcatgatttataatcctttgggtatatacccagtaatgggatgactggatcaaatggtatttctagttctagatccttgaggaatggccacactgtcttccacaatggttgagctagtttacagtcccaccaacagtgtaaaagtgttcctatttctccacatcctctccagtacctgttgtttcctgactctttaatgatcgccattctaactggtgtgagatggcgtctcattgcggttttgatttgcatttctctgatggccagtgatggtgagcattttttcatgtgtctgttggctgcataaatgtctttcttcttttgagaagtgtctgttcatatcctttgcccacttgttgatggggttgtttgacttattcttgtaaatttgttagagttctttgtagattctggatattacccatttgtcagatgggtagattgcaaaaattttctcccattctgtaggttgcctgttcactctgatggtagtttcttttgctgtgcagaagctctttggtttaattagatctcatttgtccattttggcttttgttgccatttcttttggtattttagacatgaagtgcttgcccattcctatgtcctgaatcgtattgcctaggttttcttctagggttcttatggttttagatctaacatttaagtctttaatccatcttgaattaatttttgtataaggtgtaaggaagggatccagtttcagctttcaacatatggctagccagttttcccagcaccatttattaaatagggaatcctttccctatttcttgtttttgtcaggtttgtcaaagatcagatggttgtagatgtgtggtgttatttctgagggctctgttctgttccattggtcttcatctctgttttggtaccagtaccatgctgttttggttactgtagccttgtagtatagtttgaagtcaggtagcgtgatgcctccagctttgttcttttggtttaggattgtcttggcaatgtgggctcttttttggttccatatgaactttaaagtagttttttccaagtctgtgaagaaagtcattggtagcttgatggggatggcattgaatctataaattaccttgggcagtatggccattttcacgatattgactcttcctatccatgagcatggaatgttcttccatttctgtcctcttttatttcattgagcagtgctttgtagttctccttgaagagctccttcacaacccttgtgagttggattcctaggtattttattctctttgaagcaattgtgaatgggagttcactcatgatttggctctctgtttgtctcttattggtgtataagaatgctagtgatttttgcacattgattttgtatcctgagactttgctgaagttgcttatcagcttagggagattttgggctgagacaatgggattttctaaatatacaatcatgtcttctgcaagcaggggcaatttgacttcctcttttcctaattgaatgccctttatttccttctcctgcctgattgccctggccagaacttccaacactatgttgaataggagtggtgagagagggcatccctgtcttgtgccagtttgcaaacgaaatggttccagtttttgcccattcagtatgatgttagctgtgggtttgtcataaatagctcttattattttgagatacgtcccatcaatacctaatttgttgagagtttttagcatgaacggctgttgaattttgttgaagtccttttctgcatctattgagataatcatgtggtttttgtccttgtttctttttatgtgatggattacgtttattgattttcgttatgttgaagcagccttgcatcccagggatgaaacccacttgatcatggtggataagctttttgatgtgctgctggattcggtttgccagtattttaatgagtatttttgcatcgatgtttatcatggatattggtctgaaattctcttttttttgttgtgtctctgccaagctttggtatcaggatgatgctggcctcataaaatgagttagggaggattccttctttttctattgattggaatagtttcagaaggaatggtaccagcccctctttgtacctctggtagaattcagctgtgaatctgtctggtcctggactttttttggttggtaggctcttaattattgcctcaatttcagtggctgttattggtctattcagggattcaacttcttcctggtttagtcttcggagggtgtatgtgtccagaaatttatccatttcttctagattttctagtttatttgaatagaagtgtttgtagtattctctgatggtagttaatatttctgtgggatcattaatgatatcccctttatctttttttattacgtctatttgattcttctctcttttcttctttattagtcttgctagcggtctatcacttctgttgatcttttcaaaaaaccagctcctggattcattgatttttttgaagggttttttgtgtctctatctccttcagttctactctgatcttagttatttcttgccttctgctagcttttgaatgtgttttctcttgcttctctagttcttttaattgtgatgttagggtgtcaattttagatctttcctgctttctcttgtgggcatttagtgctataaatttccctctacacactgctttaaatgggtgccagagattctggtatgttgtgtctttgttctcattggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttatacttcctgttcttttacatttgctgaggagttctttacttccaactttgtggtcaattttggaataagtgtgatgtggtgctgagaagaatgtatattctgttgatttggggtggagagttctgtagatgtctattaggtccgcttggtgcagagccgagttcaattcctggatatccttgttaattttctgcctcatggatctgtctaatattgacagtggggtgttaaagtctcccattattattgtgtggatgtctaagtctctttgtaggtctttaaggacttgctttatgaatctgggtgctcctgtattgggtgcacatatatttaggatagttagctcttcttgttgaattgatccctttaccatatgtaatggccttctttgtcgcttctgatctttgttggtttaaagtctgttttatcagagactaagattgcaacccctgcctttttttgttttccatttgcttggcagatcttcctccatccctttattttgagcctatgtgtgtctcttcacgtgagatgggtgtcctaaatacagcacactgacaggtcttgactctttatccaatttgccagtctgtgtcttttaattggagcatttagcccatttacatttaaggttaatattgttatgtgtgaatttgatcctgtcattatgatgttagctggttattttgctgagtagttgatgcagtttcttcctagcctcgatggtctttacaatttggcatgtttttgcagtggctggtaccggttgttgctttccatgtttagtgctttcttcaggagctcttgtaaggcaggcctggtggtgagaaaatctctcagcatttgcttgtctgtaaaggattttatttctccttcacttatgaagcttagtttggctggatatgaaattctggattgaaaattctttgctttaagaatgttgaatattggcccccaactctcttctggcttgtagagtttctgccgagagatcagctgttagtctgatgggcttctcttagcgggtaacccaacctttctctctggctgcccttaacattttttccttcatttcaactttggtgaatctgacaattatgagtcttggagttgctcttctcgaggagtatctttgttgcattctctgtatttcctgaatttgaatgttggcttgccttgctagttggggaagttctcccagataatatcctgcagagtggttttccaacttggttccattctccccgtcactttcaggtacaccaatcagacgtggatttggtcttttcacatagtcccatattccttggaggctttgttcgtttctttttactcttttttctctaaacttctcttcttgcttcatttcattcatctgatcttcagttactgataccctgtcttccagttgatcgaatcggctactgaagcttatgcatgcatcaggtagtactcgtgccatggttttcagctccatcaggtcatttaaggacttctctgcgctgttgattctagttagccattcatctaatcttttttcaaggtttttagcttctttgtgatgggttcggacatccttcttttgctcagagaggtttgttattaccgatcgtctgaagccttcttctctcaacttgtcaaagtaattctccatccaggtttgttccattgctggcgaggagctgcattcctttgaaggcaaagaggccctctgatttttagaattttcaggttttctgctctgctttctccccatctttgtggttttatctacctttggtctttgatgatggtgacctacagatgggattttgttgtggatgtcctttctgtttgttagttttccttcaaacagtcaggaccctcagctgcaggtctgttggagtttgctggaggtccactccagaccctgtttgcctgagtgtcagcagcagaggctgcggaacagcaaatactgcagaacagcaaatgttgctgcctgatcgttcctctggaagcttcgtctcagatgggcacccggccatatgaggtgtcagtcggcccctactgggaggtgcctcccagttaggctacttggaggtcagggacccacttgaggcggcagtctgtccgttctcagatctcaaactccgtgctgggagaaccactactctcttcaaagctgtcagacagggacgtttaagtctgcagtagtttctgctgccttttgttcagctgtgccatgccccgaagagttggagtctacagaggcaggcaggcctccttgagctgcagtgggctccacccagtttgagcttccttgctgctttgtttacctactcaagcctcagcaatggtgggtgcccctcccccagccttgctgccaccttgcagttccatctcagactgctgtgctaacaataagtgaggctccgtgggcatgggaccctccaagccacgcgcgggatataattttgctaaaaccattggaaaagtgcagtattaggatgggagtcacccaattttccaggtgccatctgtcacggcttcccttggtgaggaaagggaattcccggaccccttgcgcttcccgggtgaggtgatgcctcgctctgcttcagctcatggtccatgggctgcacctactgtcctgtacccgctgtccgacaatccccagtgagatgaacctggtacctcagttagaaatgcagaaattggccgggctcagtggctcacacctgtaatcccagcactttgggaggccgaggcgggtggatcacgaggtcaggagattgagaccatcctggctaacacggtgaaaccccatcaccctaaaaatacaaaaaattagccgggcgtggtggcgggcgcctgtagtcccagctacttgggaggctgaggcaggagaatggcatgaacctgggaggcggagcttgcagtgagccaagattgggccactgcactccagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattaccaaaaaaaaaaaaaaaaaaaaattctgtgttcaattagtttaccccagctagaggtgcattatatttagcaatgatttacttataactgttgtgtgggagaatatcctaatcagtttttggaaaaggctaagtatacctatattattctacatgtgttgttattttagcatttatatttcttttgattgagattttgtttcatcaccctggggcacaagatagctcaagaagacagatgtgctcaaattatgcaacagacttatctaaacagctcatgggtcttccaagttcctgatgaaaattagaattgaatcataatgctaagtgtctcacatatccaccctttagacttgatcatcttgtgaaataaatggagcattgcatccagtatgtggtacacttcaagaaaaaaaaatattcacctagcctttttgtggtctaagactctatcatttaaaaactttaaacaagtatataatgaagtgtattcagagatattcattgtagctttgtttgtaatatgaaaaaatcatgaataatctaatattctatcagtagaggaaaggttctaaaaggtatgggccgcacctgtactagaatattataaccccattaaaaataagataggccagtatattctgttatgaagagatgtgtgtgtccgtgagaaaagcagcatatagaacaatatgcatattgtgattattttcatttcataaatgcattgaaaaaatgtacttcttttttatatgtacgtgtatgtaggtaaatgcaaagaataagttttgaagcaaaattatcttcctttatggaggagaatgggatagggcacattgaaaaggtgcttttgatacaaacatctccacttttcagttttgcaaaagtgatgcattagactgaattttgtctaattgtgtgtaattgactttttttaaagaagaaattccgtggaatagataagaggaaccataattaatccaatcaactcagagggactgaacacgtgttatgtgtcagtcactatgcttgccgctgaggacacagtagagagcaaagaaacatgctggccctgacctcagggatatagaaactataggaaattgtataagtgtgcaaatttattattatgtaggaaaagtacaggaaattagaaaatcttacagttttctggtcagtgaagttttcctgaggaaggaatttttgcaccaacaactggagcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagccaggtaatattgaagccagaatatttttgtttcttcatttttgatttacttacgtagaagtggcccaagtgagtttcaactcaccatcacccacattatttgagtaactaaacatctgccattgcccaagccatacccaaatatcacctgaactaactctccctttctcccttccatcactgtgcttatgcattcatgtgtccaataaaatatttatggaacgttttgtatatgctagatgttggggaaagcaaacatggtccttactctataaatgtgtattctgttggaagaaacagacaaaaattaatagtcacaaaaagtgattaatgttatgaattaaatgattgaggtgccaagatagagaataaagaagagggcttattttagttgtttttttcagtgaaggtctctgaggaagtagcactgagctgagacttcagcattagaaagagccagatatgacagcatttctccccctttttaaagccaaatagtattccaccctgtgtgtgtgtgtatgtgtgtgtgtgcgtgtgtgtatgtgtgtatatatatgtgtgtgtatgtatgtgtatatatatgtgtgtgtatatatatgtgtgtgtatgtatatatataccacattttctttatccatttatgtgataatggacaccaagattgctttcatattttagctcttgtgaataatgctgctgcagtgaacgtggtagtgcagatatgtctggcacactaactgcttttttttttttttgatacggtctcactctgtcacctaggctggagtgcagtggtgagctcttggttcactgcagcatccacagctcaggcttgagtgatctcacctcagcttcccaagtagctggattacaggtgcacaccaccacacccagctcatttgtttttttgtttgtttgtttgtttgtttagttaagatggggttttgccgtgttgctcaagttggtctggaactcctgggctcaagcaatccacccacctcagccacataaagtgctggattataggcatgagccacagtgcccagcaaaacacactaatttcaattactttggacatatacccagaagtgaaattattagaatcatatagtaattctatttttagttttctaaggaactgccatactgttttctgtattggcttactaatctacattcccatgaatagtgcacaatggtttccctttctccacacctttgccaacacttcctttgtctcttccataattgttctaacagatatcaggtgatagctcattgtggttttaatttgtgtttccctgattatcggtgatgatgagcatgtttgcataaacctattggccatttgtatgtctactttagagaagtgtctatttaggtggctcatttttttattaggttatttgtgggtttttttgctgttgagtttcatatatattttggatattagccctttattagatgtatggcttacaaatattttcccccaatctgtggttgtctctttattagttgtttctttggctgtacagaagctttttagtttgatgcagtcccatttctttatttttggttttgttgcctgcgcttttggggtcatatctaagaaatctttgcccagaccaatgttgcggagcatttcctgtatgttttcttctagtagttttgtagttttcggtgttatattcaagtctttaatccattttgagttgatctaggtttacgatgtgaggtaagtttccaatttcattctacttgcgagtgtcttgccagttgccacaacatggatgaacttggaggacattatgccaattgaaataagccaggcgcagaaggacaaataccatatgatttgacttgcatgtggaattttacaaagttgaactcatagaagtagagagtgatggttaccagaggctgggggagggattggatagggaaaggggaaatgttgatcaaagggtgcaaagtttaatttagacaggaggaataagctttggtgatctattgcacaaagtgatgactataataaataataatgcattacatacttcaaaattgctgagtaaattttaaatgttttgccataaaaaattaaaagtatgtgaagtgatgaatttgttcattagcctgatttaatcatttcatattgtaaacatatttgataacttcacattgtaccccacaaacatgtataattattagttgtcagttacaaataaaatttaaaagaattgaacaaataaaatgtaaaaatatatctgtttaaaaacaaaaaagaaagaaagactctacaagaagagtaaagggaagggcatgtgcaaaagtcttgagctaggaaagaatttgggacattcagccactgaaacaaggagaatgtaaatggagaagcatagcttcagttgaacaaagattgtagtcccagattggtgcagcatctgaggggaaaacaatgaaggcacagcccttattgagacagtgaaagattagagtttgttttgtaatttccggggctggcactgtttttcttggaatcattgaatcttaggtgtggaagactctaaaaggtgatgtaattaggtcattttctctgttgcaggcactttatattggaggtgtgagtagctaaagttctctatgactacaatttttttccacaccttggagccgtttttgtgacagactcaaagacctatcatccatttcttccacgaaggcaatattgaatatatttggagcatcactcctgcctcttcctatatgctgttaattcatgtcgccagcgtcctaaatgaaagtcttcttcatatccaaagaatcttggcaataggaagcatttaaagtcgtcattattttaagtgaagctctcttaaactctgagacagaggagaataattctcttataccacaagaagggctttttcaaatggtcccccatgaaatctatttctgtgtctttccaaaatatgtgaagcagagagttgagccaattatctaaatcatttaagtcaaagagcttaatactaaagtgaatatcctgaattattcccatgattgtgtgtattattaaacaccattaattctaccaattaattaccaattcataaacttctaaaaaacttaaatataaatacagtcatccctcagtgtctgcgaggaattgcttccaggacctcccttatataccaacatccatggatgctcaagtcccttatataaaatggcatagtatttggacataaccaatgcacattctcctgtataccttaaatcacctctggattacttataatacctaatacagtgtaattctatgtaaatagttgttgtaccatttagggaataatgatgagggggaaatgtctgtacatgttcagtacagacacaaccatccaactttttccaaatatttttgatctgcagttggttattagggagaggccaactgtataagctgtatacaatctgtaatagtgaccctggcagcctgtttcagcaaggcttctcagttgacctgcagaacacaggaaattattttagttactcatcttcttagttctcccaaaaaatgctaatgctgttctgttagtattttaggtgcataagagaagcagataatctattacatacaagggatgttcctctatttagaaagcccacttaagaaaggctggtaggttatttaaaaataaaacctagacataaatacatgcctacatgcaatctgtacaaattctacagaaatcattttatatctatttactcttattttcttcccacagaacgtggagcactactatgatttctattcccttgtaattaatttctggttgtcgacttaaactgtgcctttattggcaaagtaaagtgttaaggcaattgaagagacaatgcaggtcaaaaaactgtttatatctctattagaggcaaaagctagacccttagtaaatgtctgttgagtgaagttgaattgaattagtttgagttgaattgaattgaattgctttgagagagcagtagctggagccaattatgactttatcctttggccagtattttcagctgaatgtttcaacaattattcattcaaccaacatttttattgagtgcatacctattatgagccaggcaaaaatgtggttcagggttgtagattcaaagattaaataaacaaggtccctagcttattattactcaagatgtacaaaggaagataatgccatccatgtgtaaaagtaaagagttgtaggcatctctcacaagcataagtaaatgagacaggaaaggcagtgagtgctataggagaaggcattctgaaggactcagcaactgattagagtctcaaggtatgaccttcctaatcagatgaggaaggacgtataattgccatttagtaggcaagagataatgttagtattttctcttaggtgttttttaagcttttaattattttattgaatctttctggaatcactctcttttggcctttggtgttgtggatgtggaaatagggtgttagaaaggaatcctttgtgattttaatgtttggttgggatgttaactgcaaattatgccatcaactctgacagctattttatatatattcattctcactacagtttttaatctctgatctgcagtttaatgtctcttatatcttttattttaagcaacttcatatatttccttcaaatatatatgaaatatatgtatatattttcttcaaatatatatgaaatatatgtatatattttcttcaaatatatatgaaatatatgtatatattttataaatagatatggaggtaaattggtagattgaaaataaaatatatgtattaagttgagaatataccttagaactatactttccttcttttgggaattggctagttgatttttctgatcggtttttttctttagagtatagaatggtggacttggagtttataggtccttagataaaatgtttactttgtgtatagattgcttgagacagattgtgttaagtgtttcttcatcttgaactttttttctgctttctacccatttttatgccagtggatcctgttcattgccaaagtgctcagacacatttaagaactgtatattcctcagtctcaattctagcgagtaaagggaagactctaataattaagtctgtttagttgacactttcataggtttttccctctcttggaatgctttagaagaaaagtttttataaagaaacctactccattagtgtcccttaaaatactgtataataaaataatatctattaagagactcagttatcttaattttcttcttgccatgtgatgaatgacagatttttactgccgtaaatgtgcattttatgtaaagccctttatattgtgaaatttaaaacatataatttcaaataatcaaaccccatatttctaaattcctatattttattccagaaaactagctacttaaaagcaattgaaaaaagaaaaaccctagcataagttctaaaaattttaacatgcaaaagtatcctttctatattgattaaaagatagatatacaaactcactctcaaccattctgatggaaaaaccctggcctgggctctgaagccattttttaaatggaaatcatgaatgattatgattcaggtggcttctagtacacactttgaaaaactctgaagcgtgaagcgtaatcgccaatatctttgaagattcatgacatttatattggcaaggaggaaaggggcacatggtgagctgagggagagttcgtgtagatgtctgggggtaatggcttgcctactttaccagttaaggcatacatcttgaaaataaatcagcattcaatggggtctttgcagtctttgatgtctcagtattaatagatccattcccagcatcaaaattggtactgcattatattttaagcctatgaggggatgccctgcctccagccagagtggttttgcctaccttaccttctaattttttaattccacttcttttcacttatgtttctattgacctccgcaaggtcatagactttctactctttcttaacagtttgttccctttcgccctttatttctttcaccagttctttaaaagcgttcagcattgtagaattttcaggatattcctttattttaaaactgtgttatttggctgggcacggttgctcacgctagtaatcccagccctttgggaggccgaggcaggcggatcacctgaggtgtcaggagatgaagaccaggctggccaacgtggtgaaaccccatctctactgaaaatacaaaaattagccaggcatggcggtgcgtgcctgtaatcccagctacttgggtggctgaggcagaagaattgcttgaacccgggaagtggaggttgcagtgagccaggatcaagccactttactccagcccaggtgaaagagtgagactctgtctcaaaacaacccccccaaaaaaaacctgttttgtttattcatttacttatttgtttgtttactttgtagcaggcccaaacaatgtcttttactcacacttcctattcagaattgtttgccaagataagaaataacaggcagaaagtcatgactcagtacagttaatgatattccaaaagatgctcagctcacatatggtggtggatctcccactggcttggcaggtgcggtaatagcaggctaaagaatgtggaccacggtctggagtctggttctcaagtgggcaatgagttttaaacaggatatgaagccatttctgattgactgatctgattaacatctgcagcagtgtttctccaggtatgattcacagagacgataaagatatactgtatcttcaattctactttttagagagaaaggggccactagctggatgaacactgggacagcaagtgcaaactaggatagtccaggctagactgtggccatggtcaccctgcttctcaactaccatacctagaatcatgggaaatgtttgttaaaattggagatccttaaggattactttaagatgtctgaaattcaaatgggaatctgcagtgcttcctgtttctgggaaattaaaacaaagataacttttatattagagcattaggacattagatgtttcaaagtgtgggctcctgaccaacaaatccacaccacctgataacttgtaagaaatgcagatccctaggcctcaccccagacctactgaactagaagctgggatggggccaggatatctgttttaagactttccaatttattattttgatgcatactgaagtttgagaaccattgttctgttggatctggcaaaccagtgtctttttactttattttatttttttttacttggtatcataataatatgatttttaaaaatctggatgttcttcccactagcatttcctcatgtcagtgatgatcgaattttaaccatcattgaaagaactatagagagatagctataaggagatatgaagatatgaatgttccaccttagcttgaattgtggtcatctgaagtatctgtgttcctctctctttctgtctctgtatgtgtgtgtgtgcgcgcgtgcttgtgtgtgtgtctgtatctgattctaaaatggaggaagaagacaagtctagtggcttggatagctaagggaaaggagtgaaaggaattatggagaagagaagagcaataaaacagagacaaacattgaagcagttgtcttcttagagggcctggttgtgatcctccatttccagtgcccgaggcattcagctctgcagtgaacaccaagatggtcaagttcaccagatctttagctcaacactctgaccattttaaaagcagtgccttttgaaaaaaaatctttgggagtaaattttttagttttagccttaggagtgtcaaaactagtgctagcaaaagcctctggcaataagtaaatgagattaacaaagccaagggaactgcacagaagtgttacaaacctgaagagcagttttctttttcttccataaatattatatttgtaaagatatgcttggcattcagtcatttgtccactgtccagatcactttttttaaaaaattattattatactttaagttttagggtacatgtgcacaacgtgcaggttagttacatatgtataccatgaaactggaaatcatcattctcagtaaactatcgcaaggacaaaaaaaccagatcactttttagtttcataccggcaaaggtacgagctgatggattaagtcacactgacctcagatccattaactgacacaacttgaaaatccctcatatgtctttaaattccaaatgtatgaatgaaattttgtgttgtcatttgtcattgtgtgtctttgtttagatatgaccttaatacatattgtgagcagataatttgtgaattgctcataattctcaagagttccagttcctctcttcacttttaatatgtgcgtgttgtgctaaagcttccaactgatgtcgtgtgagtgtatttgagaatagagacatgtgtttgtctttgaatgatggggtatctatacgttgcaaagctaaacattctgaattttttaatttactcatccattcaacagatgtatatattcacacatatacgtatatatatgtatatacacacgtatgtatatacacacatatttgtgtatgaatgaatatatgtgtgaatatatatacacacatatttgtacatatatattcatacatatataacaaatatattcatacatatataactatatatattttatatatacatatatacatatatctaacatatatgtatatatgtatatatatatacatgtatataacaaaaatatatacatatataaaaagattatatatgtgtttatattttcacacacatatatatttctatatacatatgtgtgtatatgtatatgtgtgtatatatatataaaggttaaatgagtattccatggccctgtatttgattaatggttaattcaggattggaattgatgcattatggtgaggtatatctactgtacattttgggcaccattcacttatatggtcatcagttcatttataaagtgtcactaaagacaaaatgagttgctgcattttaccttcagtaattacaaaataaaagaagtgaaaacatttggaaaaatccgagggagctcctaagaactccattattgggatgagtggactatgatatgcagtaataagcacatgtattaatatgtgattcaaaagtaacattttctatgaaggacaggtatcttatttaagcctcctgcctgtatgatctgattgaatcagcattgcttaccataggacccaagagaaataaaactatatttcccaatattatctgtccccgaaagagactcttgttcatggagaaatattctaacaaagctgaagataaagtataacctttgggggcctcttcttcaacatattctattctgcagagtagcaggtaataaataaggtattagggtagcttttcagttcaaatttaattttgattcctgcagtggattcgactgtggcattcaaacatagatttgcaggtgcagagagagagtgttacttagccctgcagtgtgactaattgctggtaattgtctataggaagggcgttagaaaggcctgtctccagattttcatcatattttacccaaggacactggcaacgtgaggaggcagtctggagcactgtagccattaagctgttggcagtgtgcagtatacaaaatgttggatctaagtttaaagacaagcctgtgtaaaatgaatttttatataaatagaaaactgtgaaaatgtaatcattgaaaaaatgctgtattttcatttctgattaaccttcatttgaaattggctcttagcaacatatacttccttctcatgtcttgcttttttcctctttccagtaactaatattctataactagtatttaatatgctggttagaaaaccaccaggggatttaactggatatgaaacaaaattgatttataatgaaaatatgtgttgaagtaagctttataaaatgggaatttagtatatccttaagtcagatatttctgtaaccttgtgaaaaagcacagttcctatgtcattttggtcacattgtttttctttcctttccctcctgtttctattatgcttttgttaaatcgaggaaggaattcaagtaattagcattttacaattgtctggaactgccaaaaaaatacctaacaaaaaatacacattattatgggaactgtaaagatttaagcagatataactcaagagataaaatgagttattccaaagtgtgaaatgaagaaagtccagatcttggcaaatgagaaaattatcttgctatctgcaaagcattctactaaattttaagatttttttttaatagaatcagaactgcaaggcttgtttgtctttatttattttatcctatgttccttaaatattgaactattgtaatcttgtcgttaacccccatccctaacacacacacattttttttttaattgggagttttgtggatttgtctaaaaaaggaaacactgtgatttaggattttggtaatattcagcataatgattagttttattctattatgtggaccttaagctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagttaaaaaaaaaaaaaaagaagaaaagtaacttagaattcagagggataagttttaaaggaagccctgtggaagccttgcaggaaaaagttttctttgacaaacctgtcctttcaacataattgatgagttggttccagcctggttccttgtgacccatccagcactgagtaggaaatgacacagaaaatgaatgttgtggtctcatttgtcagccagggccactagtttcttgcaggatacctgaattttcttctgtgcttttctcacatgtgcccatccctccttttctttcagtgcctttctctccctttaaccaccagggcgactgcccttttattagtttcttagcgttagttctaaagagtctgatggcctcttgtaacgtacatattgagcttccatagcaaagaatacaaatcatcacaaatcacaatagtccaataagaaagaatattgatctttccaaagtaatttcagtcatatatgactgagctcaattttaaatatgtatttcagtgtcgacttacccaacacactgaacctgcttctctgatctggtattagacttgtactctgcctacagaccagtgcctaggttagttcatccataaagggaccaaaagcagtgaccactcctcctggggtgaagttcagtgtttctttttttcccatttacttagttaagcagtcagttttaactttactatccagctgattttgtgtataaatggattcatttgtagtttatcttgtttttgctaggctgtgggctaggaaggaccaaatggatttacgtagtttatcggataaaccaattttgagtatcattttgtcaggaaaccctttttaacctcttcctggatagccccagccaccttaatttacactcctctgggagcatttatctttccttcatggcaatgtaattttgtatatatttacatgttctttttaaggcttttcattcagtcttttttgaacaactactttataccaagtcccgttacttcaatgaatataaatggataaaaatctctgccttatgaagcttgtattctagtaaaaaaaaaaaaaaaaagcagaagttaataacatgtaatagaacatcaggtaatgaaaagtgctatgaagataaaacgaggcagagtagaaatagagaatcacctaggagaagaggcagtggcgacattaggtatgctgttccggagagtcctctctgaggaagggatgcagagccaggaactaaatacaaggagatgcttgtcctgggaagatgggcgagaactcttcaggcagaaggggcagccttcttggaagctcatttaccgtattcgagaaagagaaaggcaaccagtgacgctaagagtggtgaatgagggaaagtggcagaaatggcgagtgtagaggctgacagggatcagatcacatagagccttgttgggtgacataagaaattcatatttttttctaatttaagtggaagatcaaagtaggattttaaattgtagctcacctgttagaccatgcctgccatatgaggacagagtctgccattaccactgcagcctagtactgaataaatattggctggctggctggctggctggctggctggtcagacagatgaactaatgtccttccaaccctgttgcttttacttatgtggttttattaaaaacaaagcattttgttggtttgctttgttgctatcagagttacacatattgttattggtattgcatttgtaccccttgacaaaaggaagtttactatttattatcactagataattagaatttcctacctcacatgcctgaaatgccgcatccccccaccccacttcttactatgtaaaaaaaaaaaaaatctatctctctatctatctatctatctatctgattggctcgacagcttgaacgtgattgagtgtccatttaagcctacttgtattttcatctgattactaatcctgaaggataatgttaagccagattctgcagcacagaggtcagaggatcagacatcagctctcctaaaatgatgggatgggatagaaagaatgatgataacccgattaatctccctttagggggactctggagtcaggagatgtgtttgtggccttggtaacagccttcctgctggttagaggaggacctgcatattcttgggattcctctctcataatgggtcacaccacatccaggtattaccacctgggagaagaaaggtgacagctatttttaattctttgataaatctcgaagatagaggtggaaccaaggatgtcatggaacatcatgcaagtgttaactaagtagtcctctttgaaaatatttagatctatagactatcttgccgcttgaaaaacattttatattgctaagtaggaactgtcttcttaattttcttataattctctttgcttgaattatccctaaaaattaaccatagattttcaaataagctcaaagaaaacatggatgttaatgctagattcatcatgtaataattattattatattaatagtaattcacctttgcattttttcatgtcttagtatttaacttctgtttcatgatcctgttcatcctaaagttagcacctttttcttgccatgtatttgccaggcgacatatttgatcggagcttccagaacccatctctctccaccacatcctcttttactgacactccgggatgctgctaatatcaatttgaggttttgcagagatgggggaagcctacattgtctgcatgttctgcccttgtctaggttgtatgattcttgagggtagtgactacatcctattcttttttctgtttcctgtagcacctagcagaaactctactgtatagaaggtattcagctagctgttcaatgactagatggacagatgaatgagtgaatattttatttcctgttctgattttggtaggattcttaagtccataattccctaatctgcccactttgctcagagatacaaatttcaaaattccccttaaccttggagagaccctagggaagggcagcattagcttaagcagtgggagacattttttcagtgtaggatcttttttcctgtgtgttttaacctcttagagagaacgtgggttctttattcctgctgtggcacggtcctgtttttattagcgtacccaactagactgcagcacatatgttacaatgagccatgccacatgcaaagataaacaaatgtgatgttaatgagatttgagtgtagaatctgtttttctcttctatagcctccagagttttagagaattttgtcactgtcccatttaactggcatctttcttaaagggctggctttattcataccaattattttctcattctctccctgattcctttcactcaaattcagtaaactctcatcttccagtacattatcctgcagctcatttataccttcaccctcactccttgaaatgaattcagaatctgatttggagcttgtctctctaagtgtaaaacacctcctgctataaataaacacactcggtttacttaggtttgatacttagatgagttgcatcagcatatgttctacttcacgttatcagcgtcttctgagttgaattctcatcatttttttgccttaaaaatgacagtgctaaatatgtcctgagggactaaggcaggttgagaaaacctctctgcagtattggagaaagccaagttaaatccagcctgctagcctaatgtaaacaatataatcgttcttcccttatttactttatttgtgaggatcatatactagtaaactggggtagagtagatgagcaaaaaataactaggggaagaacaacatgaacggcaaagttgcttatgcaacaaaagacatgtcatattttatctttcaatttaagaaaaaattatgggagtttcatatgcttgacactatcattattcctctactaactgccttctattataatgagtcttctttttttctcccagtcaacacattacatatacctctatttaacatttatttcttgattagttgttcataggtgtatcttttcccagtaccccacctccctccatacaaggagcctaagcatattgccatgaatgtaacagattccaagtacatgcctgttgtgttgaaacattgctcaccaatcacaaattttggcacattctaattatctaatgtctttaagagttagtgttgtaataaagacttaataattatttgtctatcaatcattaagttgatatcagtgtaccaggaatagtaactcctcaaaaaaagccagtgtttatgattaacttctaacatttaaatatgctatgtctatatttataatatattttatgtgcttgtttattctctgtatccactattataatgttcataagagcaatttctttttctacgtagcaagacctgtaagaatataggagagatactgtatttatatatgtatgtatatattcaataaatttattcaaaaatatgtgttgagtacagatatatgtacatattctgaatgaatatattaaaaatgtatataccttatatgttcatatactcagtatgaatattcaatacattatacatatctatactcaatacatatttttgagtgaattaattgagtacttcttatgtgttgggttctgttaataagtacttcaaatgcattatctctttcaatccctcaagattccagttaagtgtagatactattattatcctaattttaaggatgaggaaatgtaggtttggcattggtaagtggttttctgaaagatattcaattcataaaaaagatagaatcaagccttaggtccaggcctgtctaacacaaaagcaaatgcccttagctactgtgatatacttctcctacagtaattaactgagagaaaattttgtgtgaaaatatggaaataattgtgcctggtgggatcatggacactaacaggataagatcatcaaatagtcctgtggtcccctatgatgaggtgagcgtagccaagcccagagcaggcagcgaagcctggtgggggaaaagctgtggggcacgcaagagaaagaggtcacaagcctggggcagagaatgtagtgtccagttggaagcatcatgaatcagaatctgggtgatctgtgattctggaactagagtgttgccttaaaagcaagtatattcacctctcaagaagaaaaaagcaaatgagaataaagatggaatggaagatctatcaagtcattgggacactattctcgactgttggagtgatagggagttgtgtgcagtgattgggcttctcaaatgcaagtggtgaaaactcaactcaaatgaacttgagaattgtcctctttctccccaggatctaaattgaacactcgaaagctatcggaaggttggtcgagggcatgaagtagtactctgccaaggcttttttattaacagctcccttttctgcatattcccatggagccagaggaagtgattctctgaatggatatattctgctagtaacatatcgtggcagctgtatccgttatccatttaacaattattactgagtacaggacaatatagagaatatgttacttcctctgttaactctgccctggttgtccagcagcccaggtgtcctcacctgttaactgagagtgagcaagtctaatttgtgtttggtaggcagattaagtaaaaatgtataggaaagcatcgtgtgaatgatgaggtaccatatcaatatgaggtactattttatcatcagtaccaagccatgtaaggctacctttctatctccagaggcttttactttaaatctccaacctagcccatgtaacttttttttattattacactaatttccacttccataaaaaaggtcacagttttcagagagtgcatattacttatataactgtttaatcaaaggatcatgctaagatataaggaaaacctagaatctttatacattttcccaagctagggtgatgtttggagcatgttggatttaaaagacagaaaaataatagagaaaagctttgctattttcgagatcattatttgaaagatagtttcatcaaccactgataggtaagtcatctattaatgggcatttgggttgttttcagctattgactattgtgaataatactgcaataaacttaagaatgcagacagatagggctgggcgtggtgactcacacctgtaatcccagcactttgggaggctgaggtgggtgcgtcacctgaagtcaggagttcgataccagcctggccaacatggcaaaaccccgtctctactaaaaatacaaaaattagccgggcgtggtgatgcacccctgttatcccagctactagggaggttgaggcaagtgaactgcttgaacccaggaggcggaggttgcagtgatctgagatcatgccactgcactccagcctgggtgacagagcaagactccatctcaaaaaaaaaaaaaaaaaaaatgcagactgctagctctttgagatcctgatttcaattcttttggacatatatccagaagtggtattgctggatcaaatggtagcttttaaaaatgtggtatatttatgcaatggaatatcgttctgtcttaaaaaataatgaaatcttgctatttatgacaacatggatgaacttggaggacattatgctaagtaaaataagccagacacaggagtccaaatactatatgatttcacttatttgtgttatctaaaatagttacactcacagaagcagggaatgggatgcagttgctagagaatggagggaggaggaaatgggaattgttgttcaatgggtatagactgtcagtcaggcaagatgaaaaaattccacagatctgttgtacaacatagtgcttatagttaacagtactgtattgtcactttattttttgttaagagggtagaagctgggtgtggtggcttacacctataatcccagcactttggaaggccaagatgggtggatcacttgagcccaggaatttgagaccctcctggcaatatgacaaaaatccaatctctacaaaaaatacagaaattagctggtcatgctggcacatacctgtagtcccagctacttgggaggctgaggcaggaggatcacttgagcctgggaggtcaaggctgcagtgagctgagatcacaccactgcactccagcctgggtgaaggagtgagactctgtctcaaaataaataaataaataaataaataaataaaataaaaaagatgccagtcaggtgtgtgtataggagctaggagatagaagagatgtgtttgtatgttttcttgtttaaagatttttgaaggctatgatgattctcaatattgcactttgcaatggtagtttggtgacaggtttagcatagctatttggcagtgggattccttggaggtgtaaaggttttatcagtgtcactttgtctcctgtccaggtttttaccggttaaaaaaaaagaactaaggagccaaatgccactcaaggttttattaatagagactgaataactcccaatacaggctccttgctaaaatgcaactagtgaatttggcttggaccaaagcccccactttgaattaagataacttgtccccaagaagagtcaacctgactcaaccaaacaagttacaggcaaataaattggaataaagaaagaaaatacctggctgggcctgaaaaggcagaccctgtcctctctgcttaccataggcaggcaagaaccaagctgagctcaccactcacattgttaaaggaaaagatcacagcagatattacagagaccttcctttccctagggaacaagtgaggaagggtgaaggggggccaagagtggtattaactttgccccctgaggtgggaagactactcaattacttttctatgacctaaaagaagaatgtagagatagaagggaaggtatttggttttctccttcatgattaatcaattttatttatgagaatagagaagaaatattcctaagtaaggaagtaagagtgaccttgaaactaggtatattattatccagatatggttatagtctgaatttaatttttattaatgtaataatagcttacatgggccttatggcgacattactagcactctaaaatttaattagatttttagagcttctattaatgtcttttgtaggattatacaatctggggcatcaccagcaagcttcatacattttattttcattatgatttgaaatgagaggaatatggtattttgtgaattaaaatagtttagactggggaggtcttaaaaaaaaaaaaagaaaagacaaccccagagggttgaaatcagttttttttgtactaaactggttatatgtatttttatatagatcttaaatatatttattcaccaatattaaggaattaccagttttttatttttatcaaatttttaataaatattagttgactgtaaccatataaatgtagttatcctcacgatagtttaaaaataatcattttcatgcaacatattttctttagtgtgtatatttcttgagttttttgcgctgatgaagtaagtattccattttcatggtcccttcattattgtatcctgattatatatgtaatatgccttcccaggttcagtaaatcctttaaattaatagaaaaatctgttcagccttgttgagagtcactgcatcaatgtactggttacttttgtaaattttaacccatttatctctttccctcacattccaaaaacaagaactcagggcacacattaaatctctattttacataaagcgtgctcttgaaaaggagatagatactatagattcttagtgacattctttgagttttcaccattcaaactcttaatttagagtagcctgcaaatcaggtacatgcctaggtgacattcacagagaatggaaaagaataaccctatccagaattgacataaagtgttagcattgtatacagagcaggaaaaatgggaacaggaatcagaagctcatttatagactctgctatctactgctatttgatccagaaaagtcattttacttgccctggcctgagttttcttctctgcaaaattaggccgttgggaaggaaggtctctgcatcccatctgagccccagcaatatataaagttgattactgcaggagcaccaagtgttagttgctttgtgcatgcatcatgcgaattcaccgaggctttgtgcagccatgctctgctgcagtagttctgtccttacatgccttctggtggctttagagagagattctatttgggaagggacttagtctggcatgattagagcctagtaattacaaaagtgccaagtgatcctcatctataattacagtgctagtttgttactcattgtccccgaggccataacattaggtggaggagggcatgcgcacggttcctgaaacttaaatgcatccatacttttagtgctgtattttttgctgaattggtatttatctttaatgaatgccaggcttctaccctttcggaatcaatcacttctgtttatgagttggaaaaagacagggaccagagcatgtaggagtatatgagagacagtgtcttattactcagcttatttcctaatcctcgtatgaagataagatcataaaaaatacaaaacaatgtcagggaaagggaatatcaaagcccagcttgttaaagagtcatgaccccagagaagcctagacccctcttctccatgaactctaaaaaatcacctttttttgtgtttttgttgtaatactggccttcattattgcaaatcttcctggttgtactttacaatgattttaattttgtttcctgattagatctttgcaattattcgtaatgttcatctgagtgaaataaaatgatatacactgaagcagtgttaacagattgtaagatttgatatgttttgaaaagaaatggtaatgataaatgacagtgacctaatttgtggaacaatcttcttgtacaaaataatctagtggttggtaattatgtgattaactcaccaagaaaaaaaaaagtcaatcaagtcagaatcatcaagttatagaatcaaaaaaaatgtctggaatgttcccagttaattcattacctacagtgaacttttcatgtgaatgccaaaacataaatactattttaaaaacatttaggggaaagatgtacatttattaaccctaaaactcaaaagacaatcaagaaggaaaaacagcgaaaatctcgaaaagcagtaatgatagctgcttgttgttagtacttatgaggcactttcaccaacataaaacctcatctcaaaataaatgagtgaaggagtaaggcacaatataaccaagtccattttcaacatgaggaacttgaggctcagtgggattcaatgccgtgttcatgatcatgtagcttttcagaggcacggcttcaaaatttgttacctacttcatgctcttttaactatgtgctgttaagaaaataaaagtgaaatatctatgggatatcaattctgaaaaaatattagcacatttgattaggaactgcatcattgagaattcagttaagactttatttataatgcacaaaagcaatagatatgtataacttgaaggtcagtgttataaacatagcccaaactacaagtcaacagagtgaattatagtttggttaatatgcaaaatcattaagatggtttgacttgaaaccagcaaatcatatgaaactgtatttataaaactacaattacaatttagaagttattttgaaaagaaaatcacactttcatgatgggaatatgaaaaatattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaacggctgaatacctgaatgtgtgaatatttttaaaaactttttcgatcacatttatcctggagtgagatgaaaatatagctgttgcatttaagaatgtaagtagtgggtgagtaatttagagatatcataataagcgttttggaagtagagctaaaagataaaagagtctttgattataaataactaaaaggagcagccaaatcactaaataccaggcatacttcatctgttagtggccttagggacaaaaataaaaccagtaaatatggtgtggaagcaactaatcatcgctggattgctcaagagaggatatgtgtgagacccacataaaggtagggatggacttatgagttcttccagtaaagggctgccattgaacacagcaagggctgtggcagacagatatgcaggaagcaataggcaaatttaatatcagtaaggaagaatcatcaagctgtgtttggcttaataataaccattattcttcatttggggttattgattgttctgaaggctacgacaagtgtaatgaactgttaccaccactttgggtgaatgttggccctcaaatgatcattatccagagaggacaatataaataaagtgctgaaagtacagcaaaaagaagagagttagaaaagggagaaagtgggtcttgcttccttccctagtcttttttcttttttttaaggggagacacctttgcttctatactttacttcccattaccggaaatctcttcagcgatccgttttaactgccctggtagtggatcagaagaaggaggacatttttactgttaaggttttactgttttgtcagtgatggaggaagggcgcctccaaaaaatatgcaaagttaaattcagtgtttcaataaattgtttgtttagccagacgtgtctgagtttcttgcctcttcgggtagtcattcctgaagtgtgtcttattgagcagagataacattattgtgtagtccctgaaagagaattggaaccaagttttgggggaaagcttttgtgcacaggtcagcaaagttaactgttgtattagtggagactaaacctggacactagatattcaaaacttgcctctcttctctctgtcagttctctcaaaatcagggttaatattcaaatatattaaattcaaattgaatttgttcctagtaagcacttactatgtgggaatattttgctaggcacagtagattatttaatccatactgtagacaggtcacataggcatttataatctctgttgtactatcatgaattgaggtgaagagagattgggtcacctgctatctgcacagctaagagcaggtagagctgggaactgagttcaagccttcctgaatctgaatctcatgatcttttaccatacaaacttgcctgaatgtgaattgactggccttatgagggagtaatttccccatcactgtgataagagtagcagtcttcctcctcctctcccttcttttcctactcctaataaagcaacacctgcctctattattatgaatgttatctcaaattgtatatatttatttctattgagttgaaattcacataacatagaactagccattttaaaataaacaattcagtggcatttagtacgcttacaccgatgtgcagccatcatctctattagtcctaaaatattttcatcaccttcaaataaaaccccattcccgttaaggagttactcagcattcctcttcctcactccacttccaaccctagcaaacaccaatctgctttccgtctctttggatttacctattctggatatttcgtataaatagaaccatacaatatgtaaccttctgtgtctagcttttttcatttagcatgatatgtctgagactcatccacatcgtagcacctgtcagtatttccttcttttttatgtacaaataatattccactgtgtatatataccgcattttgtttatccattcgtctatctatggacgcttgagttgtttccaccttttggctattgtgaaaagtgctgctgtgaacattcatacacaagtatttgcttgaggaactgttttccattctttgggagctacatctgtttttggcatttactttgtgctagtcaatgaactgagtgctttgtaccaggaactctttagattctcagaaccctatgaggtgaatactattattatctctgttttacgaatgaggaaatggattcacagagaggttaaagtacctcatattgggtcacgctgagattaaacccaatgagccaggttcctgagtctgtactctatactctttctttcttttgttgcgtcagcttcagacttgacacctagagctgcttctgctgttccctccccaataccaagcttgcctgcttttcccgggcatactttcaattgttgtgtttcctcttaaaattcagaatccaatgttgcatacaatattccaaaagtaatttttataattattaccatcattgccattgttgatattttgataacatttgaaaggcactttgatgtttttcaaaacaatatgtattagttttcttccttaataatgaaaattatataacaaacaacaaaaaacaagccccaagcttcatagcacagagtatgcctgttggcattaaaaaataaagtcacggtatatatacagggttaaaaatccaaacagtaaagaaatatgtaaaatgtttattaggatttttttctggaaaagtaaattatgaatattcccaaatgcttgttccagatgtgttctgacaatggttgggcgcagattcccatttatgtcctcaatcagctcattttaagctcattcagcaggtgtataacaaaccaggggagactaaaactcccaggtccttttctcgtgatctgctactgagtcatagcccctgtctgccatattgggcttatgcagttgattttctcaacctaaatgcagaaatttccatgtccctgtgtaattcattaagcatgttttagcccaatgcccttctcaaggtacgtttacatcccaagtgtgagatcctgtctgttaactgtctttctcagttgagaaagcacagataactctgccacttggccatgctgagggctcatgaattacattattagtagaaatgagattttgaccacctcaggattcacttagaagcgtgttggaaagattcctgctcagaccaaacatctcccaccttccattttcagagtaatgtgttccgtctgtggaaccacagcttcatttgcatggaagtgatagggagccattctctacagcattgcaaactatggagactgtatacaagtctcagttgcagtactgaattgcacactctcctgctcagtataatttattagctggagatgtgcctacattaatagtatttgaccacattttaatttaactgtgctacaatgaattaaaccaaatagtaaagttacaatgtatgagtccatttttataccattagaagttaatattaacctataaagtgaattgtgtttaaaaaatgaacgatgttttatctaaccctgacatacatatctttcttgtgtataacagtcctatagggtaagttgagctaagcttttacttgtatctttttaaataaactatctttgttagaatggaaatctctaatgatcagatatgtataattgagttttcatatcttcattaagtttaaagatattaattaagcattatctatctatttattccctcttatgagatgttgatagagatcatttgggagcggacaatacttgttaaaactatgtgcagttttctaatgagcctttcaagaatgtgcgatttttttttccccacgaagttagtacccatgaattttgtgatttcttttcttaaggataaagacaagccaaatggttgtcttgcttttttaaggttgttttatataactagagattcttcttggcttcctttttaaatggattttttgataggaagaaaatgcaaatgaagtaacagtggagctcataaatttctagcctggtgactataatgcagggtattggctttgctatcaaacttccccaagcacatttgctttgtattagtgacttatgcaatattggatctttcgtctgtacattagactgtacaattcttcctttccgcctagcatgctttgcattccactctttagacagatgtgtgtgaatgtagcattctttctcagctgaagctaacaagtgtcagcatcagatttcccctatatattccaaatctgataaaaggataccctgtggttatgaaaattatagacacttaatacctaaggcaagtggcttgcagtctcagcagattcctaaatgatgatctgccccatggtgatgcaaaagtgatgttaacactttcctaggaagatcttcaatggggaatgttcctttggcaatttgaatgcatcactatacttttccagccttttttcttcacctcacctaattttatgagttgtatgcatatctaaaataaaatgtgcatttagaattggccacatgtggacacatgccatgatatctcagaagacagtaaaaacgaacttgaaaaccagaaaaatgcacaggtcatatagggatcacttataattgcccctgcttttcccatggcattttcagtcccatcattattccatctacagcgcatctccaaagcaaaatatattatgaaaaagtcatgtatggtatttcaaattaaacaataacattttctaggtgcagagcaactctcgtgatatggccagttagacttttcatcttggtcttgccctttagatatactttgtgatgctggtggccaggtggcaagcagagaaggaggggcattctagaggcggtactaaagacagctcaaagctctagaaagtgtttaagtcttttattagaccactatggctgcaacaaaaggctaacctggttcctgtcctttctagctaaataagcccaaccaatgtgtccacagggcaaccagtgatataagaggatgatctgatttttatggtattacttccatttctgagccaagcatagcaaatatatagtttaactgttgtcagtcttcttcccttgtatttatggaagttatcattaattttatattgtagtcttttctgctaaacccaggcattgcttcataatctttcacaagatagcgcatgagagagctattgctgctgggtcagagttgttacatgagttgcatcttatctggccatctatctctgggctgagttacggtcacatttccctctgatagatctctaatatagcaggtgtagagttaaaggtctttcactttttctgggaggtcaccctgacaatagaagaacctggatttcttatcctatgtatagtttatcaccacggttgctcggcatgctcttttctggtatccctagctcaaccctaactttggtcatcattgtttttcaggttttcaatcaccttaaagttgccactgttccaaaagtcatttggtgagccattctgactgtttccactttgagaatctcgtgccaggtcactagagataaatatgcttattctggaactcccagacattaatctcagggtcaattcatggttctgtgaatgcttgataccaccatcagcactgtgaggcctggaactttgccatgactgctacctcctttgggctcaaatattaaggagataggggcagatactgggcctttgattaatatttctcctctgacgtacatgacccctttatcctcttcacttccttgatgttcctgggtgttgacatagatgaagatgatggttttccctatcttaagtgaaaaacaattcatgtttcgctttgggtagactgaatggcctttaaggattacagttgaagatagttttatccaaaaggtctcaacgcaaatcttttcttatagattagtctattaaatgtgaggggcatctctaccagagattctggcagggatggcaactttggttttaaatttgttagtcaataaatatttgagtaactactgtgtgtgtggtgccatgataatcactggaaatagtagcagtagctgaaagagtgagagttctcatgtagcttccagttatggaagacgataagctaagctgagaattctgctcctttatggccccttactaggaaataaattcgtgtgatctaggaagcccctgtccttctgggtgatgagtggaattcatctacacagtcttaccagtcttacaaatgtctgtcctaaaagactagtaacccaccttacccatattccaaggaaccttgaggcccatatttattatacatggccattatttgtatccatgattatataaacacagatgaattggtcatttcccctgtctgtgttctctactcttaaataacttagttctcctcccttgtacagatatgtgtatttttaaatctagaaatgttagtagttatagaaaaagctactaactgttttcactcttcttcccttttatttatggaagttatcattaattattaattattaattaattagttaacattaattaatgagataatctacattatctcagtgaattttcacactaaccctgtggagttatggttttaatatccaggtattatggtttcagaaaacaaagttatgcaagctcagtgatctctcccaggctggccagctactaagcggtagatccagggctcccacccacgtggtctgattctagaacctgagctcttaaccgctgtaccgacttgtatcactagccaacatctgggctgctctctgctttatcaatgagtaaactgaagcccaggctcttaagtgacttgtcaagttaacagactattcagcaacagatttgaattttcgtattaatatagtgtaaataacaacagttaaatcatttatagtgcttattatatgccagccactcttctaagtgctttttatattggctcatttacttaataactactggttattgtccccatttcacttagaggcaaactgatgctttctgagaccaagttgcttagggtcacacagctgccaagctaagcagctaagattctaactcagcctgtctagtgccagactttgtgttcggatttggtgattctcaaagagaagaagctttcttctcccactccaggagcatgtgcaatgcctggagacatttttggttatcacaactttgggggaggggagacctttatataatctagtggacagaggccaggtatgctgctgaccatcctcaagtacacaagatagacccttacaataaataattatttgtcctcaagtgtcaacagtgttataaccacctttctatggttataacacaccatcagtggcatccagcaaaagatttccaaatcaggaaagcagagagtagcctccagtgtccatgcttagtttagtgtgtcttttatcatgactgcaattctgggctggaatgttactgtttagtatgtacctcataaggataaagactagcattgtgcccagcaagagccaatgggggctcattaattattacaatggaagcacaaattggtgtgtttagatataggatgaaagaatgggaactcagttggagaaaatcataaaagtagcactctgatgactagtggtgatgattttggcttcagtaaagagaagtggccacattgttattcaaaaacatgatattttggataggaagaaagctgatgtttcaggcgttttctttttgtttaaacaaacctattttgcagattttgtatgccttttatcagtcatgcagctcaattacagtctgggcagcaagtttggacaaaaataaaaagaggaataaaaatatttttatacctacattgtatatttctcacaagagtttccaagtataattatccatgaatttcatccaaaaatcttcaactgtgtgaatcttacatttggttacttactggctaatcaggattgggcctaaatccagtgtatacattacataaagaggtgaggacagataatccaagcaaaagaaatttccttataaaattcctaaaatagtatcatttcagtatgggaccgatataaaaattattaatgggatattttacattttttctttgctgtctttgaacttggtatgtatttcacacttccagcacatctcattttggaaaagctataacaatgtttctgagacttaccatatttgagaaccatttccttagtctgtgcttttaaggaatgaagttgttggacgcggtgtctttttacctttatttgttgtcatagatgatgatgactaaaagtgtcttgtccaaatacaaatgtgaaaaggctgaagaccaagatataaatgaaatagaaggctgttatctactaaatgggctttttaaaaaaaaaaaacacttgactttaagactactaataaaactgtaaaataagagcatacttttgaaataagaacacatcaaacaaagtaaaactaaagtttagctcctttgtgtcccaggctgaaataaaagcatgtgggaggacctaccaatttatattatcaaagttaaatggacacaggtcatctttagcatacaggataaggttttagcatgaggaacactttatataaaaatatactgttttttggttcatgtgaaagatattattggccaggtgcggtggcccacgcctgtaatcccagcactttgggaggctgaggcggatggatcacctgaggtcaggagttcgagaccagcctgggcaacatggtgaaaccccatctctactaaaatacaaaaatcagctgggtgtggtggcgagcacctataatcccagctacttgggaagctgaggcaggagaattggttgaaccttggggatgaaggttgcagtgagccaagatcgtgcgaattcactccagcctgtgcaacagagcaaaactccgtctcaaaaaaaataaataaaataaaaataaggaaacgtattattaaaataggaatgacttactttttgtctcaccctgcttctttgtgtctggtactacggtatgatatgtcatgcatcttactagaggaagatgctgcctttatatgtgaagtggattcttatgacctagaaccagaacaagtgtgttaggcttcattttccaagcctcataatgaaatgccttgaagtattcattttcctgtccaatcttctttaaaaacaatatttgcacccctaaccgtaggcagtaattttgtacttctcagaccattgcaccaagtttgatttctacatgaagtttactattgtttgtgtatatggaatggcttatgacaacttcatttgtcctctgctctatctatcctaggtactagaatacctagggtcctagcagtccaatatgcctggattatgccaaacataacacactactggagatatgtatttgatgaacattccgtattcttttttggccagcttggcaagcaggagaatccgcagttagctcttcctttgaccagttatttctaagtgttgttgcaggaagtggcgcattaggaactagtctttttggtttgttgtgcaactagcacttgtgtaactccctctacctgaaccattgcctctcccatcagccagggtagcttaaaggaatgttgaggaaataaaaagtaggcataaaggtattgtgcatagtagtggggatatagatggggaaacagagggaggaagaggagtgactaaagagaaagctacatgtagtcaagtgttgtttatcagactctggtgtggatcacaatcgcctggggacgaattaaaatgatacattattgggattttacattcttcccaaagaggctttgatttactgggtttcaggttggaacaaaatgcattttatcaaggactacagttgagacactctgctgtagaggaaaggcaaactctgccctagaggaaaatgaggtatcctaaattccattttctggttcttcttcaaggcagaaggccaggactgaggttattttgtggcaaccacatttattgaatctccttccctggcatgtagctcatctggaaatgactttcctgtggaggctttgataaccttataggctcttaatttggattctggaacaggttgggataagaagaaaaatttctttcttgtgtttctagaaatgtataaactatatactaagcacagagtttctgttgggaatgatgaaaaaggtctgaagatggatggtggtgatggttgcacagcagtgtgaatgtacttatgccactgtattgtacatttgaaaagtaaatggtatttatgtatattttactgctatattatatattctatgtatactacaataataactttattaactcactacaacttttgagattattttagtaatctgtgggcatgattcctgatgaggacttcagtgaggcagacaaccatgaagactaactaactgttcatcaatttagaaaaaataagtttttgcagttgatttctctcttttaaaacttttaaatttcagcaaagatctgaaaaatgtgagtgatgccttcttcggtctcttaaaaaataaaaataatgtccgggcgtggtggctcacgcctgtaatcccagcactttgggaggccgagatagacggattgcctgagctcaggagttcgtgaccagcctgggcaacacggtgaaaccccgtctctcctaaaatataaaaaattaaccgggtgtggcagcgtgcgcctgtagtcccagctactcaggaggctgaggcaggagaattgcttgaacccgggaggcagaggttgcagtgagccgagattgcgccacttcactccagcctaggcgacacagcgagactccatctcaaaaaaataaaaaattcaaataaaaaaataaaataaaaataattaggatagcaaagcaggtgttcaacttgaaacctctctgtgttttcttgaagcttgaaacctctcagtttctgccttggatcagatgatatctttgttggtccttttctgacatgaggtgctataggtctacagtttactgagataatttacataacattttgatatggaatattttacctaaaatggagtgtgcaattcataattggaaggtatagggaggagtgtttaattgacttgatgcattcatgtgtcatgctcaaggtcaaaagcctcaagtatgtgagtactttgtaactggctgtctgtcaaagataccagggaattcaatctattacatgcacttcactgcactaaaccaacactacatgaagccatcagaacataggatggcctcactaatctcgctgcaataattactgcaggtgtctcctgatcatttaaaacaggcatttatattaggatgcattattctgttcaaatattagggccattagaattttaagagaatttcactttgaatatttgatacaaaagatgaaatgcttgtcaaactaatatatcctgcacgttctcagcccctaaacctaagactgttttcttggtacgaaagtatgcatatgtgaaacaaaacgtaagtgtttgtcgctgctcttaacttgtatctttcaccaacatctacaggagttgtgtagaataataagattagaacccttcaaagctttaaaaaccaaatctgggatttcaaaataaaagaaattttcatgggagagaggggagggcagtaattttgtaaagtacatttttaaaaggactggaatgattcattctttcagcgtgtgattgtgagtttgctggtgtggcagaaagactcttgttgctatggtatccctggacaatgttttgggcattggctgtcatagctgtaactggtcattttaagggggtgtcatacatgcattttgactattgttttcatgatgaagctggattgttttgatatatattctatttcaaattaaattatttaatacaaaaccctcttaaaaatgagcataataagtgaacaaaatagctcttttatggtaatggtaattttttaataacaggaagtgttaactattttcattccaactgttatttaatcattgtagaaagtagagaaagtagagggtcctttgttcttttagcaagaccttaatcttcatttcttcgttaaattagtttttttctttctttctttctttctttctttttttttttttttttgcatttccagctgccaaagtgctgtcactgatctaattttagtattcacacatatggagtagatgccagtcttgccttatttaaaaaaagtcttccagtatcgctaatacatatttttcccattggatgatatgcaaaattatgggtttttttttttttttttgagaagagaaatcctggtcaggacctggcttcccaaaatacccaagggtatgaatattgatgagattcctaaattggtgcacttttgctaatacatttactttctgaattctaaatttagtttctagctagagtccccattagtcctttctatagtttggcctctcagtgcaaggactgggaaactgtaaatgttaattatatttgcccttggacagttattaactctacttcccaactatcttcaacatattttttggtaagtcacagcaaaattgagttacatgtgtgaaatgcatcttaacataatagcaagagaatggttttcattgtagaatagacatgagcctgtatctcagcctttctccttatgtttgtatgacaattgggaatttatttaatgtctctgagccactgttccctcaaatgcgaatagtaatatctgccttgtgatgattacataaaacaatatatgtaaaggtccaggtagaatgccctataaacagtagttatgcactaattaataacttattattatcagtaattaattaattaaaaatctcttagatataggtgtaaattacaacagaagataataatcttttaaaatcaagaccaaatgtgacagagacagacctgaacttggccttgcagtgtcctggtccctcctgagtgcagagactattcctgctaatgcgaattccacctttcttttgccattcatgcagcattcacacatcacctcatacttttcaaaagagtttgatgaagtgggtatctttatctatattttatagccgacaaacctgaagcccaaagagaacttcgtcattctataagtggggacaaagttatacccagacccaggctctcctgattcctagtttagtgatattttactcgaccatgctgctcctagtgaattgagtcccttctttgttaagaaaccagagcacaaagagtcctattcataagactgaatttgacatttaaatttttggacatttttggcattttaattttcttattaaatgtaattaaccaaaatagaaaaactaagaataaagaaataacaaacaattttaatgcaagatggtcccctctgaagaccatatagggtgttcatggaggattttcaggaatttcctcgagacccatgaaattgcgtgttccatgttgtatgctaccagtgtatttctagggcagtgggcatatcagattttgggtctgtgactgcttctctaaacatataacaagaaaagataccatcaagcatatgagataagcagattgttagaacaagatactaagttgtcattttaagggtatcatatattattacatttcagaaatgcagagtcttacggtaggctgttgtgtctgggatctacagagaagactacatcagtcagaatgtgttaggctgcagaatacctaccttaaataatattttatgctatattactattacagtttttaattggaggcctgtagattaggtagttctaggactatctcagaggttcattcatgtcagcagtgacctaggttaattttttttttctttcttctctatgcttctaagtatcttcgcctttagttctcatgcatctcaaggtatggtctcaaaatgccatcattctatcagaatcacatcagggttgaaagtaaggaaaaatgggggaaagggatgcaccattaggcttctcttattcctgacacttttataaagaagggaaagttttcccagaaatcctcttccatgtaagactttccttgtagctcattggtcattcctagctttaaggtgtcaaagtacataagcatctggcaaggagaaataagattgctataattggcctagtccagtcaaaatccgtcactgtggtcgagctcattgctacttagatgagaagtggtgttctgttgtctcagaaaaaggagaaactggtagttagctaaccactatctctctttactgtgataattttgcacaaaccaagatgaattgactaagtttcgctctttactagattgagaaatacgtttcattcctaaaatatccaaatgtactaagacataaccatttacttaattctttgcctcttaagtatggcaattatttctaatattctacttttaaagttgaagctattcagactaagaaaacagtgagagattcattaagtaagtaacaaagttaaacctgcaactgatcatttgattttctagcaggtgctcattctgtcccatgttaattctaacagaggtcatagctgaacatgatgccttatttcttctttaatctatatacagttttatggactttgagtcttttatagccctaaatttttagaataactcttaaaaggaaaaatgcgccagattttcagatgtaggtttctcatacaattagaggaatattctaacactgggtcaacttaaagcctcattttgggatttatcagaatatgcaatctgctgtttggagggaatggccattttgcaaccagtttttcacctagtttatagaagctagaggtacattgtgtcagtacaaaaacaggccttccattctcttgatccattgtttcatatatatgggtgatgggctcagtataaaaatctaatgtttgaatttctgacatgtgttattagaatctactccctaaggtcttagtgaaaaacgtaaataacttttcactgtctaatttaactcatctgaagtctgcttatgaattttgcaggaggaggcacaagactgtattagtgtttatatgtgagataaaattgttgactaaaaatcttttaaagaaatggttttttacattaatttgctaatataagtatataccatgggactgacattgcttttcaaggttctataacatttctttgatgactaggtatatgttgctttcttttttttttttggagacagggtctcgctctctcgcccaggctggagtgcagtggcagaatctcagctcactgcaacctctgcctcccaggttcaagcgaggttcaagcaattcttctgcctcagcatcctgagtagctgagattacaggcacatgccaccacgcctggctaattttttgtatttttagtagagacggggtttcaccgtgttagcccagtggtctcgatctcctgacctcatgattcacccatgttggcctcccaaagtgctgggattacgggtgtgagccaccgcgcctggccatgttgcttatttttataaaacagggttattggatagttttacgcttctcaacagtgtaatttttctattgataaaattgtacaacttactctttttttgcttccttatcgcatcttgagactcttgtgcattctggagcaaggttgtagatgtatctcttaacttcacatatagtctcatttctgctcctgtcttaatattgtgacctttttcccacagtcttgtctgccaccatgagaggccaacagacacttacacccccacaatgtatttctctctcatattcttttgaaagactctaatagtctctaacccataagaacgaatgttacttcttacccacttgagatagtgataaaattagacctggcctgcctctcgttttaggaatatagcatacttagagttatgcctgtttgcacagcctctgaagctgaactgaggaaagtttaataaatccaatggtcaatcaatagacaactatgtttgagacgtctggtatatgtaaggtttgggactggatgcttcgagagatgaaaaaaggacaaaatacagcctttacccttaagatgctgtcacatttccaagggaaaagatggcacatgttcatgaaaaattaactgttacataagactctgtatacattattggttgaattaattttgttgaatgaatacagctccagtaagaacacctataggaattcataggagggaccaatcattgtgagtcaaagaaactaaaaaaatcacagcacatttgatttggaagaggttatcgagttccccatcacccagatatgtaaagagacttctcaaactaagtcccagagagtgactgtgattttcaaagagctacaagcttttattgacagaaccagtatttatttggagagactgatagacttgatttattcaggaaggaatggagaaaaatcctaggtggaaaagaatatgtttatttgacagatgtatttggaaaaaaataagcatttatctatggaaaggagagagttaaaaaatatggttaagggctagccttctgcttcttgccttttattttccctaaaatgatagcatgttctagaactaatggaataattttttttccttagaagtgagtggcatctgtgttttctctttttaatggggaaaaattattatttcccttccgaaatagttaattcaaggaatagtgcccttttaatcttatgattgtcctccataaatgttaaacttgtaaatcatctggctttgttgaattggaggccatctgtccctccagaggtgcattggttcacagtattccaaaatgaggtgatcatggcatgtgccaacgggaaattaaaaaagctctcctctaaatgttctaagcatcaggttatggtgtcaaaatcatttgccaatgaacttttcattaaccttgcctgaatcttgtattagaatcatgggtcttagcttctgagcacatttataaatgccttattttcgtcaaagctgtatacaatacacattgtaaaacctagataaaatgctcagatgtggcacaaaatgtgatctgagtaattttgacatcaagaatcccatagatgtgaagtatttctcaagctacctagaattgtaaacaagagaaggactcttgagtttaaaaatgttctccccgaaaccccatctctactaaaaatacaaaattagccgggggtggtggtgcacgcctgtaatcccagctactcagaaggctgaggcaggagaattgcaacaagagcgaaattccatctcaaaaaaaaaaaaaaaaaagttctccccagctctccacctgataaatcaaagacaagtgcttttcttttgttgttgttgttgttgtttgttcattcatttgtttttgagacagagtcttgttctgccacccaggctgtagtgcaatggccccatcttggctcactgcaacttccacctcccgggttcaagcgattgtcctccttcagcttcccgagtaactggattacatgcatgcatcactgcacccagctaagttttgtatttttagtagatatgggttttgtcaagttggccaggctggtctcaaatttctggcctcatgtgatccacctgcctcggcgtcccaaagtgctgggattactggcatgagtcactgcacctggcctcaaggacaaattttacttacatggtaagcaagattattttggaaatgatagaatgcaataaaggtgatagataaccttagagaaaaagttgaaaaaggaaagaggcagaggcaatgtagggccttgacaatagaagcaataaataaactagaaatgaatccttaagcaggctccattgcagaagaaatgcaagatttctcccagaaaaacatttgacattagattcctctaattccaacataaggaagaagttgtagagagaaccatagaattttataggtgaactaaaagtataagattgtctatttttattctttcagcttctcctgatttttcttgtaatgtgtgcatgaggggtaggagtgtggtgagtcaataagtgattaaattgaattgaaagactagcatagtcggcagggcgtggtggctcatgcctgtaatcccagtactttgggaggccgaagcaggtggatcacctgaggtcaggagtttgagaccagcctggccaacctggtgaaattccatctctactaaacaaaaaattagctgggcgtggtggtggacacctgtaatcccaggtactcaggaggctgaggcaggagaatcgcttgaacccaaaaggtggaggttgcagtgagccaaaatcgtgccactgtgctccagcctgggcaacaagagcaaaactccatctcaaaaaaaaaaaaaaaaaaaaacacctgccagcattactctcctgctgtactacgatagcatcttcactagtctccctgtctctaactggcttcctcaattccacctggactctacctcactccttgccactttccttcttctctactattccataccttttatactagccattgtaaagttaatttatttgccccaaagcagtgtactccaataatgtagctgctagccacctgtgtctgtttacatttaaattaattaaaatcagataaaattaaaatttcagttcgtaaattatactacccttatttcagattctcaatggccacttgtagctgatggttaacatattgaattgcaccaattttagaacatacctatcaacatgcctgtcattgcagaaagttcagctgggcagtgatgcttcaaagattagtggtctcccttgcattcttctcataagccagaaagttactggggtaacagtatacaacatttgccggccaggcgcggtggctcatgactgtaatcccagcactttgggaggccgaggtgggcggatcacttgaggtctggagttccagagcagcctgaccaatacggagaaaccctgtctctactaaaaatacaaaattagccaggtgtggtggtgcatgcctgtaatctcagctactcgggaggctgaggcaggagaatcacttgaactcgggggaggcgaaggttgtggtgagccaagatcacgccactgcactccagcctgggcgacaaaagcaaaactcggtctcaaaaaaaaaaaaaatattgccaagtcttcctcatttcccttctggtttcatatgctaaggttccttctgggactgtctgccggggtgtcatctcctttttcttgccacctcactagcctgccttaactttgtttagataccctttctatgctgttctttttacatagggcttcccttagcacagcatttcatcacatatatcgtaattgtttggtttttagtctctaccctccaccaaactctaaagcagtatttcttgctcttgctcttgctcacgttcatgcttggggcatgcagcttaatgcctagcacttcttgaacactcaataaacttttgattaattagtgaattacttaaaatgtttattcagaataaacaggcacacctaatagaattaatgcatttataatttatatgaacttaagccttttaaaacatttcgctttcattataaaactagaaattaatttcttcagacattgcccttaagaaaattactctaaggaatgtgtaagttatgtaaaatatatttaaccctaaaccacacaatgatgatgaaggtggtggttgtagtagtaataatgataataggaaatgtaaggaaaaataaggcagtctcacaccctattaagaaggaaacaacatttagaataagcctactttgtgtcaagccatgttagaaacccattatttaatataattagtacaaatcaactgttttcttttttctatgttgcctccaacccttgagtacatgaatgcataattttccacttgaatccatatctcaggtagtttatatttgtagttttagaattaatatttcattgtaggtatccaacatagtataattatttttaatgactgcatgatattctttctgtgaagacagtatcatttacttagaaactctctgattaccttttagacagctaaattgtttttaatctttcatattttaaatagcaatgcattcaatattttcatgtaaacagtttttcttaatgagaaggaggtattttaccttaagctgaattgctttggtttaaaaatatgtgagtttattgaaacattttgccaaatatttcttcatactgttgtaggcattgtcatcattttaaattctttgttaatttgacaggtacgaaatggacaaaaaggattttaaagttgtatctggggtgggaaatatgtctcaaaacacttggagataactgctatcatgttgaggaagaagtccgttcaaagaagaaaaggatgccatttgttttacttagttctttaaactaaagcactaacctcttttacaccaaagttaatatcccctttataaactctgagttcttaggtgttcttactcaagagggtaaggatatgacattagtgtcacatcactctatgtggagtaggatccagtgagcttaggaacccagaagaaacatgtattcacagcttggctttgatagaagcaatagactgattttcatttgctctaagggtgttttacaatatgtttcatttcaaaatgtaacaaatgatagtgcacagatgtttaaatcttcctgtatacattcccttctgccaatctcccatgtcagttcctttttattgatgcttatttttgtttgactgtttaattgccatgatttaagctattggtggttcaggatgcacttgcctgccctatattaacaacagtaatgcaaaaataacaacaataataataatgcctgtttattgagttttctcaaagatgagaaaactgagtcacagatgaagtaacttgtccaaaattgcactgctattcaaacataggcagtctagtctgaatttccagctcttaactcatatgctctacacagtggatcagggttcttttgtttagtatttcaggtagttataggtgaaattctgaaatactgtctgcaaaatgtataaaaggtgttcttgaggactggtttgtagttgtagtttgggaatacttgccaaatgctcacaaaatctgggtttgaaaagcatatggtctgagaagcagtctaaattcactccaaataagtcacaaaaaattaatatccctttttgttcatgactggtgggccagaggactcctttagggtgggactgctggccttcagcaagatatgcagcagcaactttaatggtatccttgtggaaattgtggatgacaatgagtagttcaggtgattttgtgggcttgcactttctgatgaaaccagaggcagagtaggttaagtacatggaagtggagtgagccaatgtcagttaagattttggcgtttccactgcaggatcttgagtacatttttgtttctctaaaagtttcacattcttcctctctgctctagggatgctaatgtgcagcattcaccacctgatagctgtaaacataaaaatggggtcatgtatgtactatgtttgcatggcacatccatacaatgttatactgttcagcaataaaaggaacaaagcactgctacctcttacggcaagagtgaactcagaaacattttgctaagtcaatgaaaccagatgcgttgtatgattccatttatatatgtccaggaaaggccaatatagagagacaggaagtagaatagtagttgcctgggactatagatgtgcgtggaggattgactgcagagggtcctgagggatctccttggggtaatagaaatattctaaaattggattgtgattatgattgtgctattctttaaatattctaaaaactccttgaattatacacttataacaggtgaatttttatactctgtaaagtataccttagcaaacataaaaaaagtagtcaataattgttggtatcattttattttttattattagtctttattgttcatataactgagagattctggggatgtgctataggaccctgtatttgaacttcatcaggattttagctactttttggatgacaacatgctttcacatttgagaatgacacagctggaagggataactaatggcttagaacccctaaccaagattggaattgttttgacagcctaaaaagctggttgaagcccataagatgaaattgaacaaaaataaatgtaaaatctggcacaggctgggttcctcaggcaagcaaaagaggtttaagcagctggcttctaaagtagctcttgttcttataagaaatgtttgtgcctctcagaaagggagtggcagaaaacctgggacaggattcaggccaaaactgaaggctccaactataaatgacatctgaggtttttgttagatgctggaagagttacttagttggacattccatgttttatgttcatatactaataatagtaattattattatatttataatgataaaactccatgcttcccatgacataagctctgtggtaaatgctttatatacattatctcattcaacaattataacaaccttacaaacagaatatttttatcctatttacatatgcagaactgagtcttagtgagcctttagtcaaacagctagtgaatggcagcccagttagaaagcacctagtcaggattgagggcccatattttcaactcttaagctctatcttctacccttagaatttcttattcacagaatatagttcttgaaatctagcaaagtgaaaattcaaaagcaaagaagtacatagtctatgcattttgcggggagaacacagatgattttaccaataccaagattggtttattttcgctctaatcctttgggagggactaatttccatcactgagttctaaactgctacgtctaatgagctgtgcgaaaatgctgaggtattgcaggctgtggccattcaagcaagaaggcagtaagctcagtaggaacagctgcttaataaaaggctattagtaggccagaaaacaaacaggagattttgctgaaacatataatctatttttaaattactttgaaatagtcacttgggcattgatacagaggaggattatcaacagtcggatggtttatagaaaataccttgaaatagacttttagatatttcctattttatcttcaataatctaaggagggggaaagggcagtcaccatgtatttatgaaaaataaaatagatgatgcgttgacttgaaaccttttcattttaaagaaggaaaatgcattctacaaagtcagaaaagtacatttttgatgttttcttatttcagagtgtcgcataatgcatatctttgtctgagatgtgctatagatccaaggatcgagggctagaagtctaccttctggctcttttatagtgtgtatgaataccatagaaatgctctttaattactttttaaaataataaatgaaatatgtgagttccgtgatacatagttgtcttttctttatctgtttgttttttttttttatttccaacttttattttaagttcagaggtacatgtgtgggatgtgtaggtttgttacataggtaaacatgtgccatgatggtttactgcacagatcatctcattacccagatactaagcccggcatcagttagctattcttcctgatcctctccctccgcccacacccgtccctctgacaggctccagtttgtgttgttccccaccatgtgtccctttgttctcatcatttagctcccacttataagtgagaacatgcactatttggttttctgttcctgcgttagtttgctaaggataatggtctccagctccatccatgtccctgcaaaggacatgatctcattcttttttatggctgaatagtattccatggtgtatatataccacattttctttctctagtctgtcactgatggacatttaggttgattccatgtccttgctattgtgaatagtgctgcaatgaacatatttagccctaattatattatatttatactttaatttttactatataatatcttgatcacagctttggcaaaaggctttttttccttttcacaccaatgagagaagcttatcttaactgcatattctcttatttaagctttttccttttcccagcaggactttcatctttgctcattctttccatctttctgtcactttggcacagtctatgactagaaagcatcaaccatttcaataatatttgttttgtttctccctttaaatatcaaaaaacctatataggtttgcttttttaagagaaaaaaataataactttatctgttgttaccatttctatagccttttatctttttgacccaggaaacaagttacttgtaaaccttttttcacttaactaaacaaatgaacatttttaaaatttaaatttagctcctactgtgagaaaaccttttaaatggcttattttcaaggcataagtctaagccctggcagccagcctgcgaatgtaacaaaccacacaactcatgcgccttgaaggtcaccataagtgaacagaatgtagaggaagggtcagcccataaaagggaagaaagtttcgttattgggaaattgaaacttaagcggggaagggaaccagggtataaccttataagggggataatgaaacttacgcgatgcccgggaagattgtaaccccatagtactcaaccagtgaggaactgggggagggacttgcatgctaggagataaattacctgctgtagcttccctgggtgtgcctgtctatcagacaccagatcttgcaatactgccattaaaagtcttgcttccgctgttcttcatggctctgagtccattctttggatttggacgggtgagcgtgtttctcacactaccaaaattagacaaacacattacaagaaaataaaactacaaacagaaatttctcatgaatgtagaagcaaaatcctctacaaaatcttagcaaattgaatcaataatgtataaaaataattatacaccaccaccaccaagtgggattcacatcaggtatccaagggtggttcaacattcaaatatcaattaatgtaattcatcacatcagtaggctaaagaagaaaaattagacagttatatcactagatgcagaaaagcatttgacagattcaacactcattcatgataagaactctctgcaaactaagaatagagaagcgcttcctcaactttgataaagaatatctaaaaaaaaccctacagttaacatcatacttaatggtgagaatctcaaagttttcctaccaggatcagaaacaaagcaaggataacttctaccactgcttttcagcatcatactagatgtttttagctaatgcaacaagacaagaaaaagtaaaagtatacagattggaaaggaagaaattaaactgccttttcttgtagatgacatgactacctatgtagaaaattccagaaaatcaacataaaatctcctggatgtaataaataattgtaaccgagatgcaggatatcattgttaacatagaccagtaaatgactgactttcctgtatatcaacaatgaccaactggaacttgaaaataaaaacataataccatttatgttagcacgccaaaaatgatatactttgatataaatttcacaaaatatgtacgaggtctatgtgaagaaaactagaaaactctgataaaagaactaaataagtggaaatatatttcatgtttatacataggaagactccatattgtgaggaggtcagtttttcccaacttgatctatagattcgatgcagtcccaatcaaaatcccagaaaggtattttgtggatatgtacttattgagtctaaagtttatatgatccaaaatagccaattcagtatggaaggagaagaacaaagtagtcaattgaatgactctactcaacttcaagaaatgctgtatagctacagaaatcaagacagtgtggtattgttgaaagaacagacaaatagatcagaacagagagcccagaaatatatccacatcaatatagttagctaatctttgacaaaggagtaaaggcaataaaatgaagaaaagatagtttttttaattctttctttctttcttttctttttcttttctttctttctttctttctttctttctctctttctctctttctctctttctctctttctttctttctttctctctttctctctttctccctctttctttctctctttctttctttgtttttttgaaacagagtctcgctctgtcacccaggctggagtgcagtggggcgatcttggctcactgcaacctccacctcccaggttcaaatgattttcctacctcagcctcctgagcagctaggattacaggtgcacgccaccatgtccagctaatttttgtatttttagtagagatgtggtttcaccatgtttgccagactgatctcaaacttctgacctcaagtgatccacccgcctcgacctcccaaagtgctgggattacaggtgtgagccactgtgcccagccaagatagtcttttcaataaatggtcctggaacaactgaacatcaacatgtaagacaaaaacaaatcaaaaaaagaatctagtcactgacttaaaccccgcgcaaaaaaattaacccaaaatggatcaaagaccgacatgtaaaatttaaaactgtaaaacctcttgaagataacaaggagaaaatctatgatatggtttggctgtatccctacccaaatctcatcttgaattgtaatcacataatccctatgtgttgtgggggggaccttgtgggaggtaattaaatcatgggggtggttctcctatgctgttctcatgttagtgagttctcaaaagatctgatggttttataagcaactggcatttcccctagagagaatgctagcactcattctctctcctgccgccctgtgaagaggggcctccatgcctcatgccatgattgtaagtttcatgagatctcccctgccatgtggaactgtgagtcaattaaacttcttttctttataaaatactcagtctctgcatagcagtgtgagaacagactaatacagtaaattggtactgcagagagtggggtgctgctataaagatagacgaaaatgtgaaagcgattttgtaagtgggtaacagaggttgaaacagtttggagggctcagaagacaggaagatacgagaaaatttggaacttcctagagacttgttgaatggttttgaccaaaatgctgatagtgatatggacaatgaagtccagtctgaggtcatctcagatggagatgaagaacttcttgggaactggagcagaggtgacttgctatgatttagcaaagagactggcagcattttgcccctgccctagagatctgtggaactttgaactttagagagctgatttagggtacctgacagaagcaatttctaagtaacaaagggttcaagagaaagcagatcataaaagtttggaaaatttgcagcctgatgatgtgatagaaaaaaaaaaaccattttctggggagaaattcaagccagctgcagaaaattccataagtaataaggagctgaatatatcaccatgacaatggggaaactgtccccagggtatgtcacagaccttcaggacaggccctcccatgacaggcccagaggcctagaagggaaatatggtttccttgaatgggcccagggaacccctgctttatgcagcttagggacatggtgccctgcatcccagccactccggccgtggctaaaaggggccaaggtacacacagggcatggcttcagagggtgcaagcctcaagcctaggcagcttccacatggtgttggtcctctgtatacacagaagtcaagaattgaggtttgagaacctccacttagatttcagagggtatatggaaatgcctggatgttcaggcaaaagtttgctgcagggacaaagccctcatggagaacctttgctagggtagtgtgaaagggaaatgtggggttggaggccccacactgagtccccactgtggcactgcctagtggagctatgagaagaaggccaccatcctccagaccccagaatggtagatccacctacagcttgtactgtgcacctggaaaagccacagacactcaatgccagcctgtgaaagcagccaggaggggtgctataccctgcaaagccataggggtagagctgcccaaggctgtgggagcccacctgttgcatcagtttgacctggatgtgagacatgggagttaaaggagatcattttggagctttaaggtttactgactgtcctattacattttagacttgcctggggcctgcagccgctttgttttggccaatgtcttccatttggaatgggcgtatttacccaatatctgtacccccattgtatctaggaagtaactaacttgctttcgattttaccacctcataggcagaagggacttgtcttctctcagatgacattttggacttggatttttgggttaatgctggaatgagctaagactaggggctattggaaaggtatgattgtgttttgaaacaagatttgggaggggtcaggggcagaatgatatggttttgctgtgtttccacccaaacttcatcttgagttgtaatcccataattcccatgtgttgtggaagggaccccttgggaggtaattgattcatgggggccatttccccaatgctgttctcatgatagtgagtgagttctcatgagatctgatggttttataagtggcatttcccctgctggcatgcattttctctcctgccaccctgtgaagaggtgccttctaccatgattgtaagtttcctgaggcctccccaaccatgtggaactgtaagtcaattaaactttttttctttataaaatacccagtctcaggtatttcttcatagcagcgtgagaacagactaatactgtctagatgactttggatttggctatgatattttggatatgacatcaaaggcaagatctatgaaagaaagaattgataggctggacattattaaaattaaaaatattttatctgcaaaaagatactgtcaagagaatgaaaagaacaaccacaaactgggagaaaacattggcaaagacatacctgataaaggactgttagcaaaatctacaaagaactttcttaaaactcaacaatcaggaaacaaacaacaaattttaaaaatctgttacattaacagatattttattgaaaaaaatacacagacagcaaataattatatgaaaagatgctacacaccatatgtcatcagagaaatgaaaataactatgagatactactacatgcttattagaacaataagccaatcttggaacacagacaacctgctaacctgataagacagtaagtccaattctattgctagacaacattgctcaatgtaaaaataactcatggtttgttaattgcatcggcatgaagaggaactgcaaatggcctatgaatactagattgtgatgtgatgctttgggcttccctggcatgcagtgactcttataactgtgtattccatgtgaggaccctggaagcaatttatatggaattgctaaaggaaatactggctcctataggggatgaggcttgtaaaccagggtgacttcagcacaggaccaatgtgactcttgtctccttgtatctgaactgtcacccagaaggctgtgtcaacggctacaaggacatccacagtgaggaactgctgctatcctgctgacatgctgtgctcttgaactgtatttttctgtgtatcctgagcctattgagaggtgacagcgtgctggcagccctcacagcccttgctcgctctccgcacctcctcagcctctgcgcccactctggccatgctcgaggagcccttcagcctgccactgtgctgtgggggcccctctctgggctggccgaggctgagccagctccctctgcttgcgggaaggtgtgcgagaggcacgggcgggagccagggctgcaccctgcgctcaccggccagcgcgagttccaggtggccgtgggctcggcggcccgcactcagagcagcgggctggtgccactggccccgggcagtgagtggcttagcaccctggccagcagctgcagagggtgcgccgggtcccccagcagtgccggccggccagtgctgcgctcgaattcccgccaggcctcagctgcctccccgtggggcagggcttgggacctgcagcctgccatgcagagcctctccccctgtggctgtgggctccagcgcggccggagcctccgcagacagcacctccccctgctccgcggtgcccggtcccatcgactgcccaagggctgaggagggcgggcacgcggtggcacgggactggtggccaactccgcctgtggccccagtgcaggatccactaggtgaagccagctgggctcctgagtctagtggggacttggagaacctttatgtctagctaagggattgtaaatacaccaagcagcactctgtgtctagctcaaggtttgtaaatgcaccaattagcattctgtatctagctgatctggtggggacttggagaatctttttgtctagcttagggattgtaaatacacccatcggcactctgtgtctagttcaaggtttgtaaatgcaccaatcagcactctgtatctaggtaatctgggggggacttggagaatctttgtctagctaagggattgtaaatacaccaatcagcactctctgtctagctcaaggtttgtaaacacaccaatcagcatcctgtgtgtagctcaaggtttgtaaatgcaccaatcagtgctctgtgtctagctaatctagtgggtacttggagaacttttgtgtctagctcagggattataaacgcaccagtcagcaccctgtcaaaacggatcgatcagctctctgtaaaatggaccaatcagcaggaagtgggtggggccagataagggaataaaagcaggctgcctgagccagcagtggcaacccgcgcaggtgcccttccacactgtggaagctttgttctttcgctctttgcaataaatcttgctgctgctcactctttgggtccacactgcctttgagctgtaacattcatctcgaaggtctgcagcttctctcctgaggccagccagaccacgaacccactgggaggaacaacaactccagacaccctaccttaagagctgtaacactcactgcgaaggtctgcagtttcactcctgaagcccgcgagatcaggaacccaccagaaggaagaaactcggaacacagctgaacatcaggagggacaaaccctggacacaccagctttaagaactgtaacactcacccaccgtaagggtccgcggcttcattctggaagtcagtgagaccaagaacccaccaattccagatacactatgatagtcttatgtttagctgaatcaagaggaacttctagaaggtagtaaacatctgactagaacattatgatcaaaatagtgaaatgtttggatttttgaatgattttaatatgatagtgaaaaacagttgttcactaaagaccagataatttaacttgattcttatagaaaaatataatatttattgaagtctactgtgttaccccccggattcatagctggatacatttttaaaaaaattataagacactaaaaacccaacttaaaaatgaaaatttatacctgacaagtatttgttttgtcagaataccagcttggctgagtatttttgttactgtctccataaattttatatattttctgaataacatttatttgggtacaactgtaaaggaatggattagccttcatgtttgataattggagaatattgggtagattggtcatgttaccagaatgggcaaaaatggaccatttagagtgttgaatttaaagttagggtcctagttttctccaaactgttttttattaacttcaagattatataaaacaacatatttatgttatcttatgtatttgtgttcttttttaaaaaaaataagttaggcgatcctttctttatataaatcacatagaaatttatagcctagttgaaatgggccaccaaattcctgctaccttctccccactttttttctcatctagcagcttttgaggcatcactagggatccacaaagggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagcatttatccttccatccaccccacaacaattatttgttgccaggggatttagagataaatacataatcgttgccttcaaaaagccctagtcaattatattccttaggatactaccagcatttccaaatactctttagcacagattatttccttcaaattaaaataaaatgtgtgcatgactctttttttgtttgttttgttttgttttgtatgagagattgtgacttcaagaaagtttaaaagcctttggctagatactacattgatattgatctctttcttcttatacctttgtaatttttgaaatacatgagaaactgtcgtttacgctttcctttcattttccaatctcctattgtatttggcacatagagttgaaaggaaacaatattagcatttagtagcaaattaattttcgcagtaacaaatgacatgtaccaataagttatatttgttcatgaaaatacatttagagagttatattatgacttggtgaattttaagaccgaaaataaagagccaacttagcaaacctgtggctgatcaacacagattaagacacttctagtttctccctctttccattggtgtgtaccttaccaatcaacaccctcaaagcaattaaactatatatagttatccctaatacacatttacttccttgggcattagccagaatgcacattttatgatcacttatccttcaaatacaactactggtaattatctaagatgtttagatgcagaggtttgacaattagcaatcaaagttcatgtttgctaggaaaatgtacagcaagtcctcaaataacatccttttgctcaatgtcatttccttataagtttgaggggaaaaaatccattcctagctggagccattgtctgtatggagttcacacattctccccatgtcttgggttgtctctgggtactccagtttcctcccacatcccaaatatgtgtatgtttggtaaattggtgtgtctacattgttccagtgtgagtgagtgttggggggtgtgtgtgccctgtgtgagatgtcctcctctccagggttggttcctgctggtgccctgagctactgggataggctccagccacctgtgaccctgaactggaggaactgggtaaatcatttgttttgattaatctttcttaaatgtaagtatagcttacattcatctcaatgtttaatattaaatcttgtttatataaattagcctatgataaaattggtttttatatgtcatttcacttaaagtcagtttccaaggacctatcaacaacatgaaaagaggacttactgtgaacacatctgaactttcaaagcttgtgtagtagcattcaacggaaatgcataaacttctctatgcattagtacattaacattccctttaattgaaatgaatgcttacaagtgtgaaaagcaactaatgtagtgttatttaaattgaatgtaggctccatttttaataatagatagtctagaatcatagataaaaaggaatgataaataatacaatagagtccaaatcattcatctctgcatcactctacagaaacatgctgctttccatcagatattttttctggcatcaaacctctgtttttgcaaattacttttttttctgtgagtttttaatgttgaaatattttccacattagcatgtattgactcagtttactttttggtgcactattgaaatcactcaattgaacgggaacttatgccagtcctgagaggataagaaacttgttgaaaattatttttgccctctcaacaaaagacattagatttttaagtatcctagaattatcatgttatgtctaatagcagtcatcatagtgattaaggcttcccaggcctcaccaagatttgggtaacaaatgaagcaatgtagtagcttcgttcacccattttacttatttgaatgaaactggagaaaggctgggctaaaggaaagaagccctcactcccacacttaccctcttttttctcattcccttatgctatatttgtcttctttgccatattaaaccagaagcctcagccaaaatgaagagaaacacagaaggtatttcttagtttccaaagtacaatgttctgaggaattaagagagtttgaagagtaacttcctatgttcaatttggggagagttatgtagtaattttataacctccccactccaaaataatgctagtcataccagtatctgtcactcatagaaatgccttttctgcatgttaagtttaaaaaatgtttctatagggtgtgatgcttctgcttagaataagccacatatttagctgtgtgaaaagatgatggaatttagtctttttcttcttcccttcctttctttctactttcctcccttccaacattctctgttttattcaatttctctaaagaatgctggggagagcccagcctatcttgcctatttgacctttactctgaaaaggatgtatgtatgtctcgtataaaacatacagtctattctgccattttatatttttctacaaccactaataaccaaattgtaaataggggaatgtgaaagtcatatgaagtcatatattatcctatacagaggtttctgaaatagcaggattagaattattatctctaccaggaaaggaaaaaaaaaaaaacctctcaagtaacagccatatagacaagagaattttcaagtctgcttacaaaaaggaaaaaagaaaacaagcaaacaagcaaacgtgaacatctgcaccaggggcttttccccttgaaaggcacacgctcatctgagcatggctttctgccggtgtaggctgcactttctcaaagcctactgctttctgcaagaaactgtcacgcccactctcatggttttgtgtactttgaagtaccacctagttagtctccaactatgctcagctgcctacctaggttatccaagataatttcttagggggcactaataattgtctttggtaatgttcttgttatggagctgtaagagtttttagtggcctaccaaaaatttgtttttcctcataagccatattttggggatataattttacaaagagtaaagttgttcaaaaatgcatgtctccgggtatggtggaaatgcctattttatcctcctttatgctaatgcagaactcttttacagttttatatttgtgcactaagcaacattttgcaaacatggaaaatagcttgaacactggaatatatgttgcattataagtaattttgtctactttgtatgtattattaaatttatcttataggaaaaatctcaccctgaaatatggtcatgaattaaaggcaatcaactttcaaatcacgcccaccctttattttctcattcccgtatgctatacttctcttccttgctggatgaaatgagaaacttcagctgaaatgaaaagaaacacagaaattatttcttagtttccaaagtactatgtttagcgaccaagatgctgttattcaggcctcccagttgacagaatgacctagatctagagatcaagataccaccttctttagtgtatacaaatttccaaataaagaaagaataggggggaaaaatcagtctttccaggagggtagaatcttctacatgaaagcaacaaatatacttcttcagagcctaaatcaatctggaaaaccaatagaacaagacatttaaaagtgtatattgtgcctaatatatctcttttctcctccatatcacccagcacatagtacgtactcagaaatgtctgtaggaaacagcttattgtgaacaaattcacccccaaatgtatgaatttatgattatcaatagaaataaagatagttgtaagaattgaagaactgaattacacaagagtaatagattgaaaatttttatatgagcacagtctccttaccagatgccttacgctctaatgggtcaacaattgacatgaaaagaaaaaatacacgtgtatagatagatatatgtgtatgataaaatgtcaactgctattgaatctaaattttgggtgtattggtgattattatacttaaaaaatatttttctgaacgtgtaagcactttcacaagaaactaggagaagaagtattgttgcataataagagatgtctaataaaagagatattactgtgaaatcttttataggccctcacaggctgcaaaaatcattttcaaacttgtattatttagtttcaactatcctatccaacctgtattttcgtgtgtagttcaaatctctttaattatagttttcatatttatggcctttgatattcagtatggtagaaatgcccttaaagacatatatagtctcctaatttaaatccttcagtaaaactagaaatcgacattttctcgaatcttccgtcaaggagcagactgcctgccgtggttttattgcagtctggtgctttacaccactttcttctctgtgattatttgtgagtcattttgtaagtttttactttgtttcataaatctatactgtaaactttttaggcaatgattatcttaagtctttgtttttttttagttacctgtgaatcagaaaatgagggaatttagactatatcacattgttttgattttgatttatttaaaaaaaatctatgcacctttctgcatttattcaataataactcgaaataataataataacttgaaatctccctgaaggcaggaaatgttgcctcctgcgtttctagcacagtggcttttatacaatggctgcttagtaaatactgttgaattttgatgtaaaaggtggcacatgtaccttgcagatattttgtactcttttattatagcgcctgttttatagcatttgtgagcccttccttctaaacgtgtcccaaatttcagagagattggagtttgcgatagtgggtcagatttttgggcttagtcctgcaggcttatcatggatctggggcagtaatctaaagacattggaactgagatgtcatacccggttgacaactggggctctaattcaggtctgcgaggcctcattctctcattgacagaacgagagagcagattctacttttaggtatattgttttggagatccaagagctgggagcagccatttcttctcatcttccttttccatatttacagatacgtaggtgaccatgttatctgtaatagatattttttactctttgttgaaataattgggaagaaaattcttagttgtttggcttattatcaaattttcttagttttttatttaatctatttttatgacactttggatccttctgtttaagagactgcaataaatgaaggagaggaatgaagcaaataaacttggattagctgtctttgttgatatcgtttaggaagaaccgcatgccagtaccctaattaacaaatacatggtgtgatagtttatagttcaaacagtattgtctaaagtcgttttaatctatcaggtttttataggaagataccacaaagacttgatggtacagttacacagatttaattctatgaacataaaaaaattgattttcctgggggcattaagaactgtttttattgattgaatattttacttgcataaatggtagttcttaaaaacagctgcacattttactgttagtatctgaaagttcttaaattgtaggcgtaaatgtttcattttaattgtgcatttccatccttcaacccaagtaacaagaagataatatagagagtgtgtcatactttttctgggtacaaagatgataaagttgctgtccatactctcaaaataacttctttcttattccttttgtttctacctgctctaagataattgactcaatgggactaccctaatactcttgcagaatctaaactagattatactggacattggaagagtttacgtatcagaaaatgccattcctccggacataaggtagtgagataatattttagcttcttcaggaaaactttcctgaaacctcaaagctgaaggatgtcttggaagcattcgcatttctggcctccctcattttacagggctggagatgcaaaccacacacggatctagttggtgtcttctcatgaactagaaatcttatttttagaatattcttccagtgatttctgccactatagttttattgttggtttgagcagttagtattgaggattcattttggaaggaactgctagctgccaaccaatatcctttatttctttgtactttaataatagaacaccaattttattttgggcaaccatgtgcccagataaaatactgtaattgctaacacattcacaactaatacggtcatgtggctaaattttgtccactaaccagaactattatggggagacttcagagatgtttctggggaaatgattcggctgggaattgtgctgtcatcctcttgttccttctttttgctgcctggaatacagacttgatgactggagctttagtggctatcttggaccaagtgatgatcttgaagatgaaaatgctattctagaatagtggcagagtgagatagaagaagcctaaatctttaattgatgactatagaactgttataccagtcctggattgtttattaggattttttttttttcctgtagtcagaaatgaacttctcttttatttgagctattattattttcctcttacatgttattgaaccaattattgatgaaagagagtcaaactctgtaaaatattggaaaggatttatgtttagccaaatataagtgaccaaggcctaaggcacagtctcaagagttccggagaacacatgcccaaggtggttgggttacagaccaattttatacattttaggggacagaagttacaggcagacatcaatcaatacatgtaaggtatactttggttttgtccagaaaggtggtagaacctgaagcatgtggcagggggcttacaggtaatgggtagatttaaagatttgctgattggcagtcctttgacagggttaagctctgactgaagagatgaggtcagcagaaggaaatatttgtagttaagataaggggccttgttgaagccaaggttcttgttatgtagatgaagcttccaggtagcaagctgcagacagaatagctggtaaatgtctcttatcagaccttaagaggtaccagactcttagttaaatctctcctggatcagggaaagtcctggcaggggaaggagattcactacagaatgtagcttttccccacaagaaacagcttttcggggtcatttcaaaatatgtcaaagaaatatatttcagggtaaaatactttgatttctttcagagcctgctgtctgttgtgtgatgctataccagagtctggttgtaatagtctgtgtggtcagtcttaagatctctgtgttaatgctggccagttgtgcctgaattccaaagggaggagagtaaaaaatactgtatgtatgtacaatatgttttccattaataatagtccttgttctatatcagggtttctcaacccaaagttcatgaatttcttgaggtattatgaaaaactatacttgtatatacattttttttcctacaaaggtagtccattaagtcctcgagagatctggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttcccataatactttaatacatactctcttaaaatacttacctgtgtgttttgaacttcttcaagttccttgaaagccaatatcacatctagaccaccattaaatccccagccatttacaaatatgacttattcaataaatccttgttggatgaataaattcctgaatccattggcttattttggtggacacactacacttttaatatggctcttgtttggtccccaatccccaggccatggacaggttacctgtctgtggcctgttaggaacctggctgcacagcaggagatgagcagcaggcgagcgagcattacctcctgagctctgcctcctatcaggtcagtggcagcattagattctcatgggagtgcgaaccctattgtgaactgcatacgagggatctaggttgcaccctccttatgagaatcttactaatgcctgatgacctgagggggaacagtttcatcttgaagccatactccccttgcctggtccgtggaaaaattgtcttccatgaaaccagtccctgctgccaaaaaggttggggaccactggttgaaaacataggaaacttcagcctcaaaagtaatttaataggaaggctccaaattggatccaggtttcagccactagaacatagcacagagaaggcacagatggcagtccacagcacctggctgaaacacagattggcctcttgtcttctgtccctaaccatccagatgatagatttatgcacaagcgggctcagaaaaattagacttaagaagatataaaccattttctacctgggagatatcagttgtcagcattctattttctgtgtagtagttataaaacaaaagaaagttaatcaaatgtttcctctggatacaaattctgatttgtcatgtcattccaaaatgtagtggcactgtaaaattctaccagtaggaaagccatttactcttgatgacgtccgatgtgcttacagtcgatattgatttaattctgcttggttgttgtttattagctcatttcatttttactggggtattggacatttttagatatgtcaggaaaatattgttttaggattttagggagcttaaaaacaatgcctctctttctccacaaagttcagaagcaatggggaaacatatgtaacagtctgatacaaataaaaatataacatttattatcgatgaagtgaaaaatatgacatagatttgttgaccagtagagtgctaataattcacccctgaattaagtggatttacctacccagttactttcacgcttggacaatttcagtctcctggagataggctctgtgatgggtggttggaaagcagaacagaaggcaccatttttgaaggtaagggtttcagaaaaaagaatagaagaagagctgagatgcctatgttcagttcccttttccaaagtcactaaggaaggtccaggaatgttgtcctaccattgtttttccaaatggaaatatgtgatatgggtaataagtgttcccttgtgttaaggctctccagagaaacagacccaatatattaagaggtcatttattgtgggaattggctctcacaattatggagactgaaggcctaagaactggggacttctcatagaagtcctggagtctgaaggcttgagaatctggagctctgatatctaaaggcagacaaagatggatgtcccagctccagaagagagcaaaattgcccttcttcagcctttttgttctgtctgggctatcaaggacccaggtgatgcctgcccacattgatgagggcagattatctgtactttggaaacaacgtcacagagacacccaaaaatgttttactagctatgtaggaattccttaacccacttcagttgacatattaatttaactatcacttccttcttctttcatatgtatttcactgtgttcctctgacactgtttgaaattttaagtgatgtcatcattttcttctcactacaacctttaatggacactcttcccctattgaatcacatataaagtccttggcacctaagattactgtgaactggcccccagtatctaaaatcaatacctgtagttcacatccctatagcattttcaccctcaaatgacttagctcattatgtagtttttggaaaatccagaatgtggtacattttcacacctactgttagtagttctcaccttgacttgtataatgaaccatttaatgtcctgtgctcatgagtggcaacctagggagacctaagcgatcttcagtaagaagaggtttgaggatttaggggtgggagttaagtctcataagatccaggtgaagttatataagcattgtggcatatgaaatttcatatattttgtattaatattgctgattggtgatgtgaacttatttaatgtcattttcctgttcttgcctacccgattgaatactaaagagctaaaatttttattctctcttatgacttttgaatcccttatagagcacttaacagaatctataactattgaatttacttatcaattacttatctgttatctttctccctccacgggatataaacctcataattgtcatgtttgtctagctcttcaatatgatcggcaccacatagaccataaatatgagttgagtgaatcctctcagttatttacttgctcacttctactctttttctctacctttccacccacccataatcaactattactaaaattagaaacaaatgaagtaatttcaaatgccttatagaaatatagtaagtcaatggtagtaaaaagttgtttatatcatgatataatatatggccaattcattgaatattactacttaatttcatctttatgtatttttgcaaatatatatgaatacttatggagtttgaatatatatgaggaatatatatggagtatgaatatatatggattttgaatatatatgaatacttatggagtaaatactgattgcatttatggcaacatattcattaataactgaaacctaacatgagcactgctgctaggttgtgtggtaattacagttcagttattttagaaattgctgaaatgttttccagagtgtctctatcattttacattcctcctagcaatgtatgagtgatgcagtttctccacatcttccctagcaagcaatattttcgctaatttttgtttgtttgttttagccattctttttgttgttgtcgttgttgttgttggagacaggatctcgctttgtcacccaggctggagtgcatgcagtggcatgatcatggctcactgcagccttggcctcccaggctcaaatgaccctcccacctcagcctccagaggagctggaactacaagcgcatgccaccacgcccagctaatttttgtatttttttgtagacacggggtcttaccatgtttctcaggctgatactgaactcttggactcaagagatccacctgccttggcctcccaaagggctggtattacatgtgtgagccactgcaatttttcctcttattgatggtgcttttttttttgagatgaagtcttgctctgttgcccaggtaggagtgcagtggtgtgatctcggctcactgcaacctccacctcccaggttcaagtgattctcctgcctcagcttcccaagtagctgggactacaggcgtgcaccaccacaccaggctaatttttgtatttttagtagagatagggtttcaacatgttggccaggctgatctcgaactcctgacctcaagtgtttgcccgcctcagcttcccaaagtgctgggattacaggcgtaagccactacacctggcttgatggtgcttttggtatcaagtctgagaactcgttgcctaaccctagatcttgaagattttctcttgcatcctctaaaatagttttatattttatatttaagtccatgatctattttgaattaatgcttgtagtgtgagatttaggttgatattcatttgtctctggatatccagttgctccaacaccatttgctgaaaagcctatccttctgctattatattgcttttgtacctttctcaaaaattagtttgactactaatggatatagagtttattttggaggatatgaaaatattcctgattaaataataatgatggttgtacaactccattaacatactaaacagaatctataattattgaatttactaaattgtatatctaaagaggtgaaaattatggggtgtgaattacataccaataaaactgttatttttttaaaacttgggtggatttgtattgggtctatttctgggttccctacttgtattcattgatctatgtgtctgtctctctgccagtatcacactgtcatgattaaggtagctatatgtttaagccttattactgggtaaattgatttctctcatattcttcttttttatctagattgctttattctagggtgcttatctttctatataaattttaaagtaagttttaaaatgtctactaaaaccttacagggagtttgataagaattttattaagcccatatatttctttggggaaaattgacatcttttttacattgacccttccagttcatgaacctggtatgtctctctgtttacttagttcttcttttatttcttccattgtcatttagttattttcaatatgcagatcccatgcaagttttgtgaattttgtactgaagtatttcatttcctttggaatgattttaaatggtattatgtttttaattttgccttttaatatccatttttaatgtatacaaatacaatagattcttgtgtgtttatcttatgtcaacatcctacagtatcttgcaatattgctgaactcaacctttaaatttttaaggtttatgaatattggactttaaaagttttatattaattagtatttttatcttcccctgaataataccaggagtttaaaatgctaacttgaatcaccttctttctgaggcccattaattgcagcctagtattttagatttgccttcttttcacccttaaaaatccttattataagtgttctttttgttgcttttttagtcagtaattgtgtagatttctcaaagtgttattttagcttctaagatcatcattctttaattaacgtttacccagataaaagtataaaattatattttgacacttattttttcttaagtgtttgaaaatagtattattccattgtgttcttgcccctcctttctaatgagaattctgcatacaatctaattgttatttctttgtaaatacttgctttttgtttctggttgctttttaagatttttctctccatcttgggtatccactggtacactaatatgattggttactttaggctttgtttttattaaaccttttcaatgttcagtatgtttcttttttttctgaagacaacttttgatataattcattcttaaacagaatctatttgatatttaattgtcctttgagtttttttcttaattttttctattgaagtataaattccacatactgaaatacatagtcattaagtgtgcaggctaatgagtctttgcaaatgaacatttacctgtgcaagcatcgtatttgtcaagataaggaacattttcttccctgcagaaagttcctcatgtcccactttttcaagtcctcttttttcccccccgcacaatgtatagattgttaaaattgtactctctgctcttagatttttataatgaatttaaatatgtattttatatctttcaggttcttccattatttttaggtttttgcatgccagttaatacttgaaacttctgtttgctcctgatgatggttgtcattgcatggtgtatttttagcagatttttttgttaactgtgggagacccatatgctcaggaggatagacatgtccctatatagaaagtccattcatttttgtgaggtttcaaatggatttgtaggagtttgtctagtttttgtgttaacatttcaattccggattactagaccaccactaggaagtgtaaatttgggctttatatctgttcagattgaagttacatttgttaacagattttaccctctgtatccattttctattgctgttgtaacaaattattaatatcacaaatttcatggcttaaaacaatacaaagttgttctctgactattctgcaggccagaagtctaaagtgagcctatagggctgagttccttcaggaggttctaggggaaaattgttttcttacctttatcaacttctagaggccacctgcattccacagcttgtggcctgttcatataaaaagctagcagtgtaccatcttcaaatgtcactccccaccctcacttccgttgtcatattaccttctgtacctgtgtatttgatcctctcatatccctctcataaggacccctgtgattatattgggcccacccatataatctaggataacatcccatgttaagatctttcagttaaatcaatctttaaagtccctttcactgtgtaaagtacaggcggagcattcccaaatcctcccaaatctgaaactttttgagcctcgacataacacctagattccaccatttaagcaaccacgcattgtccacatgggtgcatgagatcctgacacctttgctttctgatggttcagtgtacacaaacttcatttcatgcagaaaattatttaaaatattgcatggaattaccttcagactttgtgtataaagtacatataaaacaaaaattaatttcctatttatacgtggatccaatctctaagatatcccattatgtatatgcaaatattccaaaatccaaaaatttttgaaatttgaaacacctctggccccaagcattttggataacagatactcaatgtataatatattcatagattctggggattaggacttgaacatttagtggggagcattatttagcctccaaggcctcctttctccaaattttagagatactccacttctttaacacttcatgtgctaagggtggagttttactatccacgtgtctcatggtgcattcctctagtatcccagttttaaaccagggttttaaagtttttgcttcatgtctcatctgtctctgcagtatattcaaattcacttgcagcccccagaggtactttcttgcacaattccaggaagtacatttacattagatagtacatgaatggcacctcctacagttgtgtagcctgacactagagccagcaatcagggctcctgtctctatgccttccatccaccatcagtggatggaaccttactactctggcttagcacttttgtttttcaagctcagctgtaaacatgtgaacaggtgttcacacataattttgttatttttctttccttttgtttaaccagcattttcgtggctgtaaagagagaaggcttagtccaccatattgttggaactttaccttcattttacagaggaagaaagggctttccatatgagtgaactgacttatctgaggacacgactaataaattaccgaatcacagctagaactttggtgtcctgactctgacacaaaagttcttttataaatcttagtaacagtgcttttattatgattattcctgttatcactgatactcattactaacttcccaaattacacaagaacctgatgaaaactatactgttgtatgtccttgtgaaccgcaacacatatacaataaaaattcatttattactgaaacatttttggagatatatcattaagctaggtgataggtatacaaaactgaatgagacatgatatctgccatcagggtgtcatagtctaatagaagaaataggtgcataaacagatagttacaatgcattgtgcccaagtatcatttgaactcaagatatagttaagctgttggggaaagtgggattgattagatggggaggagagagaatgggttcaggatgtttaatcttcaaatagttattaccagatagatggctggataggattgagggatgcatagatggatagttatatgacaaagcaggcatagtaagatattagttgtagaatctagaaaggagatacacagttgctcactgtatcagtctttcaacgtttgtctatgttcgaaaattttataataaatggttggggaagtatcgtcttcatctttattatagctatcattcattgagtgcttagtgtgccaggcgtctttaagagctttacatgatttagctcatttaattcccatatcatctgcaagataagtactatcattatccccattttacagaaagttgggcatagagaagttaagtaacttgttcaggctcacacagttagtaagtggacaacccatgataccaggctgtctgactctagaattttcactcttaactttgacagagctatctctaaaagattgagaggatttttttttaataaagtgggtagggatgaggaagcattacaggcaaaggagagaatatatttacatagataggaaaaatagcatggatttttcaaggcaaacataatcctgggtggtgaatggaatataaagcataaatcattgagcaaaggaggttactggggggttgggaggactctgtaagaactggccatatttggctttaccaggtagctgagagggatccactgaaggatttttaataggaggactgtgtgtttagatctctattttgaaatgggagctctgatgtcagtgtggagaatggatttcaactaaagcttttctttttttttttatttccaggtgaaaaatgctagaacaaaatagaacagtttagagatcaataaatggtacaagtaaagtgtctggaaggagctctctgcttccttaatagagagtgcattctgcagaagttgaaagtgaccctaatctgagaagtgtagtatttttagcactagtagatatgaagagggatgtctcgttttcagtttaaggcattattaagaagaagactgatttccaggtttatcctgacaatttccctcttcctttcaagaagaagtgaagttcacatttttctaccatcttcatgttttctggatcatatagcttttgtgaataggttgattagttgatatcggcttctgtttctgagaaaacttcagaagcctagtatttcctcaatggcatctgttgccaccacttctcattttgtgtgagagggttgagtgagtgggtgggaccctttaagaaaataaattgagagatgagttaattatacagattatcaatatacgggtattttctaaccattcttataacaaatgactcaatccgcattcctcaatgtatgctaaaactactgagtgaaatgctattggagaaaactatatgtaatctcaaagttgcttccaaatattattgacaagttacaaaagtaaaataatacctttacatttaaataacagagaaatattgtgatcaaacaacaacaggacaaattgaccataccttcctcctctatgtagtattcttcaaaacatttgaattaatcacaaaaaagcaaccagaaaaattcaaattgaattacattctgtaaaataatggggataggctctttaaaaatgtcaatgtaataagagacaataaaaggttgggggactgttctctataaaaggaaggtatgaccacaaaaagcactgtgtgatccttgattagatcttgggtcacagaaacaggaaacaaacaaaaagaagaacccacccagctataaaggatgttattggatcgatttggaaaatttgagtatagaccatgtggtaaatagtagttttgtggcattgctgcatttcttgaattggttcattgtattgtggttgtggagatgaatgttgtggtctttctggagaagctttatttggtgtattcttaggagaattatttactgacaaagtgtcatgatgtctgctattttcactcaaatgactttctaaaaatgagtatgacagagagagaaggaaggagggaagatcggaggcagagagtaaaaacagaaagcagacatcagaatgtttatattggttctaggtcaaaggcatatgtgtattcattgtgccatcttttcaacttttgtgtaagtttgaaatttttaaaaaaatattgaggggaaatgggaattcagatgatcaagttcaaatggaatgttctatagtcctatccaaacttaattacattttatgtgttattttagaccaatcctgcccaacagtttcaaagtttatacatttgctttatttttataccagcctgttgtgaatttgcaaactgtttaaaaattgcaaagacctacataaatatatcccttagcataagggtggccatgcactttaaaattacatatgattatgtggctgtgtcaccaagattacattaatttcatattctcagaattaaaggttgatttccctatatttgacatttgcttgcaatgttactacatcatatagataaaagaaggtagaaaggtgtgaatttaggcagaggtttccctgaaaagagcttttaaaatatctacttaaagagaaacttgaactctgctttacgctctgatttacgtgtgttctaaaattaagcctttcctctgtatctgggaatcagttggggagaaaacattaaaccattttctgaaagcatggaggaagaaaagcaggcatcttattcctcttttcactccataaaatatatataaggacaggttttgcccattttaaacagacactcgcttttttttttctaatgtaacactatggtaatcttaacaaatatagaacattttagatttagctttgtttctgccggttttcctcatgtggacgccttccttctcattttgttccatctgcaccggatctaaggagagacactttccctttaagaaacaaaggttagctgtgactcctgtcatgtaaaagcctaaagaaggcttttcatagttgatggaagtgatgccaaagaataaaatgaaaagcctctgctatctacctagcgcctacacgccctggagccgacaaaagagctcagtaccagagccgaagagtccgtggagcaccacgttagtgaaaaagccgattataaataataatgaccttagtggatgctgagaactgcactaaagtttttctgagccagacagaatgatgtaggggataccatataaatgcatagaagtctataagggaagaagatgctgagagattcaatttcttcctccaataatttaaattgatggtgagttagtaggtgctcaataaatatttgttgaatgagtaaacaaaagcagtctaacaacggatttcctaatgaaagttcatgaattgaagcatgtttgcattgcatcccaactctgtattaaaactgtatctatttcaggagtaagatcagaatcctgatagaggaacatgcaaaatgttgcccatctatttagggacaatcatagagatagaaagaaaaaagatatttggaagtacatggagctcactttgcctatgagttgtgtgcatttcgaggtgggagacgggagagggagtgcaagagaggctggaatgagatttttttttgtagtgatacttggttttctgaggcataatctagtgaggagagagggccttgacgtttttatttagcgatcatgcctccagtcatgtgttctgaggctcatgttcggttttgcattgatagacttggaattataggacattcttggcttttgaactagctcattgtgctgaatgtggtaatttttgtgaaagcatactgaaacgtctaaaataacttccaaggcaaaacagtttagtacagctactgcagctatatgtagagcaccaacatttatacttagtcgggttttaatctcagcactcagttcttcggtattccaactataagaaccccatcatgcttcccttgggccagggtatcttaaacatattgaggttaacatattgagccagataattcgttgctgtggggggctgtcctgtgcttggtaggatgataacagccagtagcacccctaccccaagtggtaacaaccaaaaatcagggttttttttaaactgtctttgttggaaggaaaatcagaatcttctgaggaaaaggatttttgttctcttcttggatgttaagaaaattggcttgtgttggctgggtgcggtggctcatgactgtaatcccagcactctggtaggcccgatcactctgggaggtgatcttgtgggcagatcacaagatcaggagttcaagaccaacctggccaacatagtgaaaccccgtctctactaaaaatacaaaaaattagccaggcatagtggcaggcgcctgtaatcccagctactcgggaggctgaggcaggagaatcacttgaacccaggaggcggaggttgcagtgagccgagattgcaccactgcactccagtctgggccacagtgagagactttgtctcaaaaaaaaaaaaaaaagaaagaaagaaaaaagaaaattggctttttttttttagccattaaaataaggataagtcagttctcccccaaaaattaaatgagaagtaacactcataaaacaatttgttctctctctcttttcttctccctctccacacacacaccccctcaaattttttgctaatagtgactacaaatttctgagcagttagtggtagatgaatatcaaggcatattgcacccttttatctagctcataggtcaatttgatgtcacattgacataattatttaaatgggctattttctccacagactgttttaatttcatgaccctggtctctgggtcattgttattagaatctgattatctcatggaaaattaatatggccacatattttcttatgtgcgtccatacttttggcttacttcttgaatattttattactggctccattgcttttggttggaaaagaaggttcaatcattgctgcatagattatcattccagtaggtgccctgggcagcaatttctgaaccatcccttttgaaattttgttcccagctggagaaatgtcacagttgtctcagcttttgactctgacttttagtgagagatgcaaggaataggaaaacactttcaagaagaagcaatgagcagttgtatgcacatctggtgacttattgctgaagattctaaagcatttaaaaatattgattaagcctcaaactgttgggaaattgttcccataactttcattctgcccctagatttgctgaggttttgagctgtatttagcttggtgaatcttgtgtaatggccagaaagagacctcaggagccccatcccccaggttcttattagccttgacaagagtgttgttaaaattgcagactcttcacagttccaaagagatgccgtttcttgctgtttcaataccaagtctaaaacaatctctgtatacattttggcttctaaaatatattctgaggtaaaatagcaggttctactgtctttgagaagaccatttcttttgtttgtggtaactagtcatgttggtctcttttttccttctctttgttatatttatttggactttaatgttggctatgccctttaatgaaaaaaaatcaggcatttcccagatttagatttttattataaacacttcatattttaagtggtatatctctagggagaaatgtatgaagaattgatggaagttggaaattttttagttagtaattaacacctaccattaaaaacaagtgcaaatcacatgatggcaaagtgaatctattacatatcataatcaaagattaatcaaagtaattaccaggcaaacagggattgaatagaacttaaaaccaattaaactatttcggctgtaccactgaataaacactttggtattttaatttctcctctcttcatttgcttcagcaatatgtttgctaatatgactgaggtgcacaattgctatttaattaacctatttttgtcagaacctcacacgagctgcgtggagtagatctgctaaagtctcaataataatgagcctgataaaaaataaccaacatgaaattcgtgccagtcattttacaagttatgccaaatgtaataatatctgaagaaaaaaagaaactggttaccttacagaaattggattgaaagtacttaaaaaacatgttgaaccaacacaaaattactcaaaagtttagtaaaatttcaaaaatgtataattgccttgtttctttgtaccccactttgcatatcattaccattaactattggtaataaatctattcgagggcatggatctgttttggggatacttgagttgataatgggcacagaagggtttggtagtggacatcttttacccaatcatgtatcctttgggagagaatacttttctagctattgagtaaggcatcacgaaagtgttgatccattttgcttttattccctaagacaatcaaaacgctaacacagtttgggtggtcttggcctcaatgatacacattttttcacaaaagataacataactaaccatgtgaagaaagcctcacctttctctacctttggatagtagggatgaaagaaagtaagatggagaaatccacattaaatataaagactctttccccacaaaatcccagagctcttctgattggcaccatgaagacaaaacattctgattggatttttggttcttcacccaggtgttttactatcaggtagacacagtttgtgtacaactaaataagaccatttcctgcccaagctgtcttttttccccacacatttaaaatttactcacacttactgagcatgatgtttcaagttttctgaaacagctggttagtagccagttgatcactggcccctaaaggtaacaaagaccctccatccccaaatttttgccagtcaaaaaagcatgactttatttcactcccgtcaccccagtgctattacgaggtgtaagcacctttctagtgaaggtctattttctagatcttaggacaagaatagaatgtcacattgtaagcgttctcagaggtctgcagcaaagcccttattgtacagaaaagaaaactaagactcacaaaggtgtagatcacctgtttgtttgtttggggtttttttttgttgtttatttgtttgtttttgcagcaagatgaggattagaactcagatttctgactccctcaatgttctcccttctttatcatacaggctccttaactactggctgctttgcgtgtggtggactttaaatgatcacacgggtgccttaatcacagcctttttatgagtgacacaggcgctgagtctccctttttctaaaatggaatgttttatatccataacccagacttgcttaactaaggtcaaatttacataaacaaatgtcttccggggccagcaggtagcatgtctgggcaaaagcgtgtgtggcaaggttttgataaagcgcagaacacatgttctgtttaaaaatgttcacattcagattctcaaatctctctcttgccagaccaagcatgtccacaggctactggtttataacccctgactgcatcacgatgcagacagagtaaggaggagtgttcttacagttatgcaaatggaatccatatcaccagttccttttagaatactagatgtcccaagtgtgccatgccaaacccttttgctttgaatgccctggacttctagtattcaatgaagaggcacgacttggggaacatgaaacacccccataaacaccagctttagttcagccagtgtccccaaagactgactctgaaaagaacatacacgtgtatgtcgcataaaatccgtagaagagatgatgctgctacccacaaccttcttgggagctgctgagaatccctaacagacaaaccgaatcatagggcaaacccaccctatgtaccaaacaaccagtgtaattatattctgtagttgaggaattacataaattgcccattgggaaagaagccttaatctccatccctcccccgaaatctatcaacagctgtgtgagcctctgtgtatttttgaaaggttgaacacatttgatcggagaacaaacttgatttcctaatcaggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctgtaagtaccaggttttacccccctctttctccctacagctccatgtgaatgtgactttgcaagctgcatttgattttctgttccattgctctttgttgaatcaagctggtgaggtagagtgtgatctgtttagagcttgctgtttctgttaaatctcttatataattgattcatacaaggaaataggagcctttcagaatgcttttatagaaattagaaattattggctttgtttttaatttgggagtgtggttgcattatctttggtgccaggatgattagagcatatatttatcttcttctgtacctctggccattgcaagaaaaatgtaagtaaaactaatatatatataaagagataatctttatatgcatgcctgtataaaagaagtgcctgtatttccagaatttaaatttaacatagtttattttgctgttctctgctgctactaagaaaggcagaaacagaaaagtttctcttgtttttcagttgcatgctgtttagaaactttgccatggaggtgggcaggataactgtttggaatatttgcaaatataaactgtatatctccttttttatgagacagtacataaaataagagtctgtgtttagccccttattgcttttgaatgcaccacttcttaagaagtaatgtgaattaaaaaaacaaaaaaaatcactttaaatttggttcatttatctttttatgtatcctcaaatgccatctatcaaattaatatttattattcatgcaagattcattgtaaaaatgctattagaatttaatattgttaataatgtttgcatgatgtctttcacatgatcaatgccttagtgaaattaaagattgttatcactgtggaaagggatttgtggatttttctgtttccctaacctaaacataaatcacacctgtctttttttattaaaagtggaataattgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttctgtgctacccaagtacactagctctttagttcctagaaagccctggggttgagccaagtggaaagaattttgtaaattgggatacagcagcagagagttaaatctccttgcattctttgttttggaccctcggcagactgttttgtttgaccccagagctgccggcttaagcacaaagaggactttataacgtcctcagcggcatttggaagcaggacctctgcacacaaatcataccctaaccctccttaacagcttagggcagccactgtgaagcaaggaatgcagttctgtgaactgtctctatgatgacaagttaaagagtgaatatgagctgggtgtggtggcacaggcctgtagtcccagctaccagggaggctgaggtgggaggataggtcgagcctaggagtttgaggccagcctgggtaacttagtgaaactctgtctttaaaaaaaaaaaaatgaatatgactgaatgaaaaataattaatttagtaactgtaatacttttggatgattttaaatgttatcaagccttaactgtgcattgtcaaagtatacactccattggttatctctagtaacagtgaaagattgagttaacctcctgtaagatgctgtgcaactctaacaagctgctttacctctctgtgcctcaatagcccccagtaaaatgaagtatgatttctgtgatccttccgaggttaagaaagttacgaactcatgacatcttattctaactgggcattcatgcctggaacggccttcaaattgcctagggacagggtgacatgtgacttagctgtcattttaaacaatatttcactaggatgctttcattttttcttctttcatttctctttctttcttcctccctttttcttccttcccttccctccatcttctgctaccccctccctctctctctttctacccttctccttctccctgtctgtcccgttccctgttctcctctccctctgcctccctctctctctttttcatcagttaattgtcctcaagtcaagtgtgactttagaaacgaggttcggattgtctgctcatttgcataacctgtttgcggctttctcttatgatagttcattgaagtatcaatgacttactgatatactgctctgttatatattagaattacttagctttaggcatgtatgtgcagcagggacccagaaagttatgctgcatatgtaagtgtgtatagattgcccatgttaatttttaaaataagagtgttgttaatcttatactctaaattgaagatgattaaggtgaaggatttatcttaatgtattaagctaacaatatttactttaaaaataaaacaagtgcacaaacaatagcccatttcaaggtagcaggatattaaagagcttgatttttaaaaagagaaaatatgttcatcgaatgatttgatttttctgtaagaaattgtcttgccaaacagtatggaaaaataaaaggcatacatcattttattaacaaatagatacccgtccacataatgaagtaagcaactttgtgaaacatgagataggaaaaatattttatggaaagtttttttaatgatacacttcttgtaatcttaggattgcttatcactagataagtcctcttagttgaaaacagcagatgaagaagttactaaatccatcactaatgagtgcttcttgatatactcgaaccaacttgtgaatacacttcatttgagaatctttactgcagatactggaaaaagctaaattaatttcataatttatacttgtaggacatggattgtagtgctttttgtttcttccactgttaaatggaatagatggaatggcacaaaaatttacggactaatattttactgtacagttgactatatatatatacacacacacttataaatattttttaacatcaagtgtactccaagatggatgataagtggccatttgatgacagtaatagcttggatgggctcatcttatttcagatcagggtagtgttatgacagcttttaaatgttagttgaaatactcatttttctctccatttttattattgggaggtctctatatgtgtcttactattctggagtttgaatattaatgttattccttattgaacttgtaggctatatttgatgcatatatatatatatttttgatgcagagtataaaattaattttccaaatctcataaaactgagtagatatcctggctttttaggcagcaggcctgttgtaagtagaatccgtaatgtgaaataatttgttttatcgtcgtgcatccatctatgaccaaaatgattttgtacttaggaactatttcaatgcaaactagattatactgacagataatgtttgataatttgtggctctcaaatccttgattataaagttaccaagcagcttcagggacattgcttttggttttaatctagtacctctgttgacttgagatgttcaattcaatattacttagttaatagctccaatggcttatccgactgttttattgtatagttaaaaaggtaaagtaaattggacatagacatgactctagggcttgtacatggcttcatgtcttcacctctattccaaagtaagaagggaagtccttctgcatttttgcatgaaatttctctatgttttaagggaggaatggggtgatttaaaattgagaggaacacatcagaaggagctgcaaaggaataaagtgtttcttatggttagatataaaatgcagggctatacattctgaagatatggcagaatttagagaagctgactatgccaggcatttggcacaggggactaaaggagacagatttaatgcttgccagaaggaaaccctatatcagtggatagaaatttgagtgccctgcaagcaagcaataacaaaagaaagaaagaaaaaaaaatgtaaataaggaagtagaggaatgactgtattgtggttggaagagatgtggtttcattctgcaaaggaaaattgtgagtgaatgaaatatatcaagtgtaaggacattgggactaattcaaaaatattttgcataggtattgctaagttactgtgaaataattaagacatttggatcagtgaagagatacagagaaaaaggagtgctgttggatttgactgtactggctgacacactttaacaatgtaattatcttaaatgaagtgggtattgtgacaccgtagtcagtctgtcttatttcagtgagtgtttctggagtagttaatggggatattccatctagttcagtagatattgataaatatgtatttatggaaactatatagcagtttttacaggctgccagtaaattaccttgatccttctaccaatgtctgtgtttctgatcccccactcctccctccaatgatctgtattaccccaaatagtcctaggagatggtgtgagaagactgagtttgaggaggttgattttattaaatcacttcaacctttcagagagtaaataagttcttacggtagggcgtaatgccatgcaatactgaatgacttcttgaaatcctttcacttcacttttcctttaccaagcactttgtccagagtaatatgtttaggtcttccaagcatttagataaataaccttgtctgctggacatggactcaatgagtcataccactaattaaacacggtcatttgcaagaactttgcctcctcgctggttagaattcattgtatatgtgtgtgcctttcagataggtaaagctgctcacacacaggcataatgcttgactccaggggtgaaaacaaccaccatctctcagaagagaacaaatcatgtgttcaaacatggtctctggcatctttttgatgtgtgtgttaagtgtgaatctggtaatttaaggtgtgtgactcctactcccatccagctgtctggctttgtgcttagagagaagaatagcaacagatttagactgacacaatccttccctagagtccccctcccctacctctccctgcaggaatccacaagggtattcggttgattgctgttgttaacctctcttgtagtattatatttcttgttgaaagtaccttttgtggcatgtgagtacatttaagagatgtgaaaggctttaaaaatggctttacttttaaactttcttacctaaattattaggaggaaaacagtttcttaggttaatatgtgtgtgtgtgtgtgtgtgcacacacgcacatgcacgcatctaggctaagatctttgcaaacctttaatgttcatcaagggctgtgtctaaatgatacgttgattataataggattttttttccaaatcattttcgtaatacatgaataatactcagaatgttcatgtaaagtgatagactgaactatttcacttgagaaacattcttgatgttgtacatgacagtcttcggtcgcaaaataatctagaaaattaggaacatgtctgcaagtctggttaaggctctgacagttcttctaatatatctgttttggtgaactttgagcatcacagagttttctcaaggtatgaaataaatacctctggtagaatgtttgataatctcagagtactcaggaatttttaatagatatgttaaagataaaaaatatataactagtaaataaaacatatagttttacagatagaattgtttagcccatggctaaatggataaacctaaaagttttgataagcaattttggaagcgattcttgaatgtagcagaacttgtgatgatgatgtggaagtatagggaaggtagaactttgcctgtgggcctgagacttaaatctacacaaaacagactaatagaagaaaatcatacagatttttcacatttacatgggagccgccacaggaaaatgaagacccaaagaagtggcaaaacctaagtgcttctatattaggttgaacaaagagaggcaattgtaggaaaataactaaaatatatggggcaactaaagaaaaatatgagttattttaacaagatctgtttgtacagaatacccttggttttgactccctgtctctagtgataagaatgtttcttttctcctggtttagggaagacatctttcacataggagttttatctcctgatgtgacaatgaaaagggaagatcggcttgccctccttgtaccaactgtgtttcaagtgtctttagctcaaaataatccttttgccaaagtggcatattctgataagggctcttctgccatccctcacaagtgaccttgccataagttatttcttgtgtgtctaaggatgacaccctagccaacaaggaaaatggtgacattcaattatggaattttaggcctggacatgatctacagattgtcttgtctgttcctctaccagtaggtccagaggcttatccaagacagaatggtcttcttgtagtctgtctagggatagaatctagaatttccagagccccatatgggttcccttctctggcaagaaagtcattcttgcatttcttttcacattctgtaccacgaagctagaactctattggcagccagataacccagaaccaaagacctgcagaaaccaggctgaacacacgaagtgtgaggtggaccagttgtcaggcaatagggagtccacagggtctgtaaagaacggtgcatcagggttcctcctaagtgttgtggccatgttggattgtggggccagtgttgctgtatctcaaaaattttaaatattgctgtttatttttaaaatgtgtgaaagctaaacgcatctatcgaattcataacatccagttttcaacttctatggtaagttatttgaggcatctctcattggttgcgggaaaaatatgcggattcacatcatgaagtggcatatactctacctaagagagggaacctgtgttaatgatccatcttgggtacttctagggaggaacctaagagaatgaggtaaagcatgtaaggattcctacaaggctttttttaaaccctaatatgtttcattcattgtcagtttataaggatcagatttaagaaatcatattacaggtatgagtctgaagttaatgacacagaattcaataaatatattttgctatgcctaagtaattcaggtcaatagactatattgtagttactgattttactaacatatttaatatttttatttctactggggtgctaaagttgccagtcatgatttacattaccatagaaaaagataggttggtgattgcttcctttttttttttttttttttttttttttttttgagattgagtttcactctgtagcccaggctggagtgcagtggcacaatcttggttcactgcaacattcaccatctgggctcaagtgattcttgtgcctcagcctcctgggtagctgggattataagcacctgctaccacacgctgctaattgttgtatttttagtagagacgggggtttcacaatgttggccaggctggtctcgaactcctgacctctggtgatccacctacctctgcctcccaaaatgctaagattacaggcatgagtcaccacatccagcccttttttccttttttaaaaaaacttttgatactcactgattaattgggcaaatagaggaaatctgcaaatgagagggatagaaaaatggtctaatttacacttttttttaaaccacaagatagagcctaaattccatttaattttccactagacattttagacattctatctgataaaggaacagagaacacagtgctgggctgtttaagcacagtcatttttcttgcgtacctgtgcagatgacagaatcaccaggtggtcccatcttgaggaccactggcctatatttattaattcatttaacttattattaattaaattcctgccatttacctcatactgtttgttctagagttcagagatagaaaatgaacaatatgaacaaacaaacaaaattactacccttacgaaagtacgtgcattctagtatggtgacaaaaaggaaaggcagtgttctccaagccaccctttggatctgaggcgccttgtccctattttcactacttcttcttgctctgttggctgttttgcccagctgaacatacttctgtggtatttaagttgatctcatataggccatatgaagtggatgaacaaaagtttttcagatatttttgtgaactcaaaattatgtgggcctagaatagctgagtaattgaggcaaactcttatttgtttgaagataggattttgtaatcaggccatccagctactgaagcaggcctctgcttcattttgtttctgtgaacaagggtggacctctacccatcccccccaccccccgcaataagtcactcatttctcaggtgtttttgtttctgcctgccttaaatggtggagttgaccaaattgactattttgaaacctatttataacttctagataagggtacagccatccctccctaggacatggttttaagtagagttgaatgaatatgtgaggaaggaagcattttgagcttttttgaacaagttttacaactgcaaagtgctattactattaaagataataatttagaagtaaatattatagcaactaagtgcaaaagagctcttagtgcactattttcatttcaccgtataaaaagaaaattggtagtaaaatatatagtgtttatctactttgtaatttctttcccccaagtctattgacttttctctcccttcggacttccctttggtaactcagaagcttacctaagttttgaagtagccagctagaaggagttacagagtagatgacagctttgtctttttttctactatcagagggctcaacactgtggagtgatttgtgggggcatctgacatcatcagaggcgcaaaagtaatcgtgcttatcactaaagagagttggctctaagctttggtaaagtggtcctgatcccgtgtgatcctaaaaaaagatgagaggaatgatcattactgtttggagcctacaggctcaataaccttctaactctgctttttaattaaacacagagcacttaggggtttatttatccattatcaggcaggcaaatcctctactgacatcattagattttatggcatgtggcctgcctaagcagtttgtgtgtgtgtgtgtgtgtgtgtgtgtgtgtgtgtgtgtgtgaataattaatatgaaagatattacattactaccagtacaatatgctttacttccatagtctagaaacatgcctttttatgcaaagttgcaacatgattcaaattgatgtagtattttaaagttaaagctctatactcagtattaacaaggtggttgcattttccacagagactctaacaaacgatgtagtcttaaatatcaattgatttacaatatctcttagcctgacatcaatattaaggctttaggatagctctcacatgagaaatctgatattttgaactttggatcataattaatttcacaatacagtattgttatcttgtattacatattttttctcatgttaatttgacttactggctattaataataagaaacgcactatttcaatgaccgaagagtgcaaacattaggtagtgatgctagtagaaaaacagtttggacagtgcttcttaaacattagtgtgtggaaatgcagattctgattcagttagactgactgggactcaagactctgaatttttaattagctcccatatgatgtcagtcttggtggtccacagataacacttgagtaataaggataaagaccatgtggaattccctgttcagcccacatgagatttcccaactgaggaattctttcttgagtgtctttttctttcatctttgtctcactgtattgttatttgaaatcagaaaataaaaagtactagattgatagctctgtccacctgtcaagtgaaaagtttgcatctcattttgtattacactattttatgccctaaatctttgctttctgtcctaaattgatctggtacatctttgcctgacatctgagtcttgtagatagttatttaaagatatgtgaagtaaaagattgtgaatgtcatggctagaatagatgctatctccagagtctaggaattgaggtatgtactggagacaaaacagacctgttctatatggaatgttctggagtattatgaaagacactcttgtttgtttctttatttttcaccctgtggcttatgaaagtgaaatgtgggcttttctaatatatgcattctctagtttcctatacactgttgatttccccttagtaacattgcatattatgttgctcctagtggtgacaaatctcaggaaagcaagagaccttaaaaaaaaaaaaaaaacaaaacttttttctatttgtgacatgatgacagctgtcatgggaatggggaaagatagaacagtttttcagaatccatcaagtgaaggtacattcaatgctgtaacttaatgaaagttgctttattgtgacatgagtcagagtctttggtgatgcaagtgtggaaggatcttttctgaaagatttatgcctcaagtctggatttgagctgaagggacatgaccttggctttgaacttgaaaaaggttaccctctgtaagaaagtccagagtcagtatgaagaggttttcagatcaggacggcaacagagagtaaacaacactgcagagtctctctgaaatgtgcaaatatcatgacaaggagaggtctccttagctttatttacccagaatcctcacgtaagaggtagtcatctgggtgcttagaaatcaaaatgaatgactcactttttcaattttcatcaaaataacccttgttttgtaaatatacacaaaaaaactacccatcatttgaaatttctattgtaaaccccattgtgaatgtattattgaaaagattggaaaaccttaagggaaattctcaaccaaatctttttctgaacagcttttttgagtggaataattatggtataattcttatgtcatacaactaacacatttaaattgtacaattcagtgtttttagtgtattcacagaattgtataaccatcagcattatcaattttagaatatatttgtcatcccaaaatgaaaccccacctgttcacagtcgcttcccatttctcctcaatccctccctagaccaacaataatctctttctctgtgcctcgtctggatgttttatataaatggaatcatacaatatgtggtctcttgtgactggcttatcttgcttggcatcctattttcaaagtttagccatattgtcgtgtgcatcagtacttcattcctttttatggccaaataatatttcatcattttagatatactacattttatttatccattctttagttgatggacatttaggttgtctaaatattttgactgttgtgaacagtgaccctatgaataatctggaatcgtttttgtgtggacatacacctaggagtggaattgatgagtcagaaccgaagattttaaccaatatgtttaaattttagcaacactgaaatacagtggatgtaactaaagagaatatggaaatggctataaacgaaaatgcttctcaatgaagagttttactcatttgaacaaaggaactatccctcttatttttttagtctctataaagtaaatgttcccaacactttttgtccatctcctctgtcttcagtagtggcacactgtccatgaattaaggatatgaatactaggcaggaagttaaattctgttctgcaaaaaaagagtatgtcatttctgcttattaagaccatgataaatgcaacttgaataagaagaataattgtttagttaacacaataggaaaaaaaagtttaatagaataccagctcagccttttggaggcttagcatatttgaatggcaacatagaacactgtagggaaactctcaacctgtctctaaaatccagagtttgaagatgcagtaaggttttgagcttgtattttctcatccctgaaagtgccaattaagataataaaatttagagcctatccaagttggaattagatcttcactgtgtgtgtcactgaatatgacgacctggatgagaacacctattagaggggaggctcatttaatgcactggagatagctatggtgttcatgcagcatgcactgtggaaggctgtttggattgcatttgattaccactgctgtgtgtttgatgttttgcaagtattctatggggactgccttttctttttccaattgaaaataggctagaaaagggatataaacatgttagtgctctgagaaaaaataaagatattaatatatttctgcaaaaattgtctttcttgacctgaatcataaaaggtattgtgaacataacaactgactggatattgtttatattgtcggtaaatttcagtcagttgaaaatattttaaagtccatatatatctgtgaaaggcatagatgtaagctgcatttaatgtgctccaaaatcaaacaagcaagtattttacttaaaatgtaggttattggcatacctttgtgtgtatgttacttcaatgttgaacacaaggtgtaaaaatacagtattttacatttctgcagaatcttgtcactacagttttctttcatttgaacttaacagatgccaagattttccatttagtaagtattattactagcaaatatattatctggaacacaatcagtatcaaattctggctttctaagaatattgaaaatgtatatgtagaggtgaatattgcagataaactgagtactgaaggaaatggttgattaaatattattcagtttgctttgtagtatgatgaaacattttatatatacatatgtgctagcacacacatgcacaaacacatgcttacattgtcacagggaaacaaatacacattatacctccacccccattgctactacaaataaaggtcttaacaaggtaggtttcttatcacacatcttacagtacatcagttaagactgaatcagggacagcacaagacaaaacagaatcaaaaaggtagtgtgactgcagtatatactgtacatttagtgagtttctatttataatcccgcccaccctcctaacacattttacccatccctggcactatggtcctccctatgactcagctcccaggcccttcatgcgccccacaatcttttttctctccaccttctcatttctctgtctagatttattcttagtaaaaactgagaatactctgtttcagaagttgttagaattatcaaagttaaaagaaggaaaagaagctggtatttctgcagtgtatcaggtagtttcacctacattttatggcatatttaaaggacaaattcttccctatgactaaaattctcctgcttggaaaacaaataccaaaatcatagccattcctagtatctgtaattgctaaaaatcaaagttgtcaaagttgaagtttatgaatgaaggaaatatagttgtataaaagcaaaaaatgtgaaaacttacatagtaactaggataaaataatccaagaataaatttattccagtctaagaaaaaacttgatttaccaaaatacgtatgggatttagggtaactattacatgtaaaccaatcatgtacttttttgaaatggtgactgttgcacactttacattctttctcttatattcatgaaatataccactaatattttgatataaaaatatcttccctgaggtttttttacttaatatttgcataaataggcatacatccatgcttgggaggcaggttgagaaagaagattatattttactgaaaaaaattgtgggaatcatagtcttacaagtttactggagctgctaacagagcagcatatgtgcaatgagaaccatccttgataactggtttgcttagccactgcccaaatctctagatctgaatcttgttttcattgctgactttctttatgaactcagacacataccattaacctctctggactttggatactttctcagaaaacgtagaagacagattgattcttcttaagccttgttcctgtcctggcattccttaagaatgaggttgcatccagctgcagtgtgggtgcacttgggcttagtgctttttctgagacactgtgttgagcagagatcttagccatgcactgttggtgtgaactctggattccttctggtcattacatgtcctctggcactgttttccagctgagggctgtgacctcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattgactctgggcatagcttatgtcccatcccctcttttcctgaggattactttaaatagaaatacctgtctattatttaaatataattttgtcctctttgtgtcttctgagagctagttgcccctagatgtctttcagccttgctcttcaacaaaaatagaacaagtttattggtagcccttatgacacatcccccacagttggatacttgatcctcccccttttaaatctgccctcaattctttctaaagccatctctttctaaagcaagagttctgctttccttttgttttcagatatatgtcccttcccgatgtctcccttcatttctaggtttcagttttcaatgttctttcatttggtcatagactttttctgtgttctttctaaaacaatcagtgtactttcaagttgtcacttttcattctcagctatggggtgaggtaagtaggtgttcagatttttattgatgtcaaggcctcctcttgtcgctgaattggttgcatcttgttcacagtactgagtaattattaatatatcaaatccaagctcatatgttgattggactgcctcctttccccatggatgttgtagtcttgattctttgttgtatttcagaaaggaaacctctaaaattttattattttacatttgaaattgttatttctattttattggaattggattttgattgtgtattatctcatatgtggagaaatcaggaatatcaaccatgttatgctacactgatgatcagtcaatgcattggcccataaaatgaacacagttatacaccagagatcaaatcattcccattaaaacaactagatgctaaaatagcactgatattaggaaaaccatgctatgacattaaaataattcaatccaaggtgaaaccgaaactgatttgtctgagattgtactactttactgacccattttattaaacgtaattttttaaaagcacttttaggaggtagatagtatagtgcattattgagattataggtggtggctaaagccctgtaagtatattactgaaacaaattttttcaattctctggtagaatatgaaccaaggtttttttcaatattagcctttaaaaaactcttaatactccataattagcctacaatataataatttgtttccacctttagtatgacaagctatttcttgatttttttcactgagacataattatatatatttatgaagtacatagtattgtctcaatgcatccaatatatagtgattaagttaggttaatgagcatatcctgtcacctcaacattcatcatttctttgtgttgagaacattcaaaatcctctcttctagctttctgaaaatatataataaattattgttagctatggtactcgtacagtgctatggaacagtacaactgatttatcctatctgcctagaattttgtatcctttaatgaatttctccctatctttgctctccccactcttcccagcctctaaaagccactactctactctctacttctaggagatcaacttttcttagcttctacacaggagtgagaagatgaaatatttatcattctgtgcctggcttatttgacttaacataaagtcctctggagtcatccatgttgccccacgtgagaggatattactattttttatggctgaatagtattccattatgtatatatacgtattttcttcatccattcatctgttgatggatacttacattgattccataccttggctattgtgaatattgctgcaacaaatatggtagtgcagacatctctttataatactgatttactttccttcagatatatacccagtcatggtattgctagataatgtttattgactttcatatttgtatggagtagaaaatgtataatatgtattatgatttgtaatacatgtattacttactatatacaaacaacagagccaataaaatgacatagcctatctgtcaagaaatcaacatgagaggagacattgttggtttcaagggatatgccttttttcacaggtaggttgatctttgcataggctaaactattcacactctgtttagctgccttgatcgtctttactcttgtttgagtaacttggtaatggtgaccaccatatgatgaggaggaggaggaggaggagaaggaagaggaggattatattattgaccaagatgatgacatcactgacaatagataataccagaatatcttgaaatcctaatcctttaacagctgctggtttgattccagttaggcttctattttcttggccctagtgcagtagatgagctccttgcacttgatatattttcatcaatgaaaataaaaaagtgaaaatgctgtgctttttagatttccctcatgtgatgcttgggctatatcatcacacttcctccctggcagtggaatcattaccttctgctgttactagtatagattttcagaaatcttgtaataaatccactgatttgagagcagtaggagcttttctttctaggttgcctctccaacattttcatcttgatatgcattacttagaattcagccaaaataaataaaatccagctctgtcactgcttgacaaatataatacattgtcagtgtacctgtttatttcactaatatactctattttcttcttctttctcctcttcttttttttttttttttttgtgactgagtctcactctgtcaccaggctggagtgcagtggcacgatctcagctcactgcaacctccacctcctgggttcaagcgattctcgtgccttaggctcccggatagctgggattacagatgcgcgccaccatgcccagctaatttttgtatttttagtagagacaggggtttcaccatgttggccaggatggtccccatctcctgacctcgtgatctgcctgcctcagcctcccaaagtgctgggattacaagcgtaagccaccgcacctggcctctattttcttcttaaaaccacgttgattgggactatggcctctaattttctcataatttagctgttgtatgttagcattgtcttttaggtgctatttgcattttccttttattatttagagaacacttatgtagccagatttttttaccttgagaaaatgttcttaaaagtgtaactcccgtgatctaagaaatgtcattcagccaagaagttactctaagctttattgtctgaaataatttggaaataattctctttaaatttcaggaaaaagaggacataaaccactgttatagtttcagttgtttttaactatgtgttgaagctttcccagtctcttaccttgtttattcagttgtgttaatttggcagttaaaagaattgtgccatcttcatagatgactcatgtggaagtatactatctctactaacagaagtgactacagacatccaaaaatgaatgctaagcctggggaaagaacctcctaaaaaagagtcaatatgtttgatgacattaaactgcacactatcatttgtgagtattttcacttgtcaactggaaaacaacggcaggtcttgagatctacctcatcctcctctgttagccaggaaaggagacaaggtgttgtcttcagggtgttttcccttcatcatgggccacttggagccaaaaacatcaagggaaaggaaggagcttgggcgggtaggcctgggtacgggagatacatttttgcttagttttcctcagggatagtcaggactctataattagcagtctagtcaaagagaagtttggaggaacaaatgagggaccttctccatctccattgtctctctatgccttcaaccagggaggcagtgagtctttagggatccaagctgttacccctagcttgttaacatttaataactacatgacctaaataatgttgttctcttttcacaattctcagttgcaaatgggagagtagtataatgattgccattggatgtccatttactctttcagccattgaccgcccttattccattaaacagaaagtagtgactctttcctgactctcttaacgagatttctgaccttttcccctgctttatattgtctttagaagtaaagattccatttgatgagtggaattatctcccccatattaatggtgatgaatgctcttgagaggctaatgcatgcaatttaacaaattcaaactcgagtcaaaatctgtcttaatattcataataagaacttatgtgatgtccctgacatccagcagaaataacctgtggcagtgttcgctctaatacttgatcttgtaagagaaaatttcaaccttatacacattttagaattacaactgagccagcattacagtgctaaagaatgagaaactgttgtgttgcctgtttttgaaatgtaacaaaagccatgttttgagagtaattgacttcttaactcacactggacttttcatgtcttgagttccctcaacctgtattcttgtggctgattttgctaaatatatgtacttataaatctcctgcttattggaagattatacatttcaagttcaaagatgtaaaatagactagtatttctctattttgtgagatagtttttcctaggtcttatggcaggatttggggttttgttttttgtttttttgagagacagcatctcaccctgtcaccctgggctggactgcagtggtgcaatcatggctaactacagccttaatctccctgggctcaggtggacctcctccctcagcctcctaagtagctgggaccacaggcatgcaccaccacatccatctaacttatgacaggttaaagggagaattctttcttttgaccaaaatgtttgtactaggaacaaaaaataaaaatagtagccatccctagactctgtatttttgaaaatcaaaattgtaagtagaagttgactaacgaaggaaatatagttctatgaaagcaaccactttttaaacttcctgctttgcacatagttaactggaagaaaaggaaaccaaaaacaaatatattctactctcaaaaagcttaatttaccaattattagtgaaaactattgtaaatattcatttaaaaacaagagttgtttacattcttaaaaaagtaactatagcagtcttcatactctttcgtgtcatacagtaataagattatattttgatagaaaaaagtcatatcttccctgaagtttttttatttaatatttacataaatagacatatatccatgcttgggaggcagggtgggaaaagagattatattttactgaaaaacactgtagaactcatagccttacgagtttactggggctgctaacagagcagcataagaaatgagaaccatccttgatcattggtttgcttagtcaccgcccaaatctctagatgtgaatcttgttttcattattgactttctttatgaattcagacatgtgacattaacctctctggactttggctactttctcggaaaatgtagaagacagattgattcttcttttttttttttttaattatactttaagttctagggtacatgtgcacaacaggcaggtttgtttcatatgtatacatgtgccatgttggtgtgctgcacccattaactcatcatttagcattaggtatatctcctaatgctttccctccccctccctccaccccacaacaggccctggtgtgtgatgttccttttcccgtgtccaagtgttctcattattcaattccgacctatgagtgagaacatgcagtgtttgattttttgtccttgcgatagtttgctgagaatgatggtttccagcatcatccatgtccctacaaaggacatgaactcatccttttttatggctgcatagtattccatagggtgtatatgtaccacattttcttaatccagtctatcattgatggacatttgggttggttccaagtctttgctattgtgaatagtgccacaataaacatatgtgtgcatgtatctttatagcagcatgatttataatcctttgggtatatacccagtaatgggatggctgggtcaaatggtatttctagttctagatccttgaggaatcaccacaatgtcttccacaatggttgaactagctgttcctatttctccacatcctctccagcacctgttgtttcctgactctttaatgattgccattctaactggtgtgagatggtgtctcattgtggttttgatttgcatttctttgatgaccagtgatgatgagcattttttcatgtgtctgttggctgcacaaatgtcttcttttgagaagtgtctgttcatatcctttgcccactttttgatggtttttttttttcttgtaaatttgtttgagttctttgtagattctggatattagccctttgtcagatgagtagattgcaaaaattttctcccatgctgtaggttgcctgttcactctgatggttgtttcttttgttgtgcagaagctctttagtttaattagatcccatttgccaattttggcttttgttgccattgcttttggtgttttaaacatgaagtccttgcccatgcctatgtcctgaatggtattgcctaggttttcttctagggtttttatggttttaggtctaacatgtaagtcttcaatccatcttgaattaatttttgtataagttgtaaggaagggatccagtttcagctttctacatatggctagccagttttcccagcaccatttattaaatagggaatcctttccccatttcttgtttttgtcaggtttgtcaaagatgtgtggtattatttctgagggctctgttctattccattagtctatatctttcttaagccttgttcctgtcctggcattccttaagaatggaggttgcatccagctgcagtgtgggtgcacttgggcttagtgctttttctgagacactgtgttgagcggagatcttagccatgtactgttggtgtgaactctggattccttctggtcattacgtgtcctctggcactgttttccagctgagggctgtgacttcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcagtgtaaaaggtcaaagccttgcttcagctctaaaggaccttctttacataatagcaagaattgactctgggcatagcttatgtcccattcccacttttcttgaggattactttaaataggaatacctgtctattatttaaaggtaattttgtcctctttgcgtcttctgagagctagttgcccgtaagatgcctttcaaccttgtacttcaacaaaaatagagcaagtttattggtagtctttatgacacatcccccatggttggatacttgatcctcccccttttaaatctgtcctcaattctttctaaagctatgactttctgatgcaagagttctgctttccctttgtttccaaatatgtatctcttactgatatctgtcttcacttctaagtttcagttttcaattctctttcatttgatcataggcttcttctgtgttttttctaatactatcagtgtactttcaaattttcacttttctccttcaaccatcatgtgaggtaggtagctgttgagattttcattgacgtcaaggccctccacttgcctctttagagacttgcttgctttttgttcacagtacttggtaattatatcacatcccagttcatatgctgcttggactagccctttcatgatagagattcctatgttctaatctattcctaagtgctaagaggacccctgtttctttatgttaaaccttaaaaagcatctctgttggatttggtagttgtatattttgatgttatttctactattatgtttttgaacattttaacaagaagagaaaacctttttttgtccatgcatgtttaagagaccccctcaaaatagactgagtcaaaaatatccctttcagtagtacactttcaaaatgtttgagatgtctctgtgaaagggctaatctggaagtctttgacagtttggaagcctgaagaaatcccccattttcccaaagctgtgtttttgaagactgttcttcaaagagcaagcccaccgttttgctattagtgccaagaaagaacaatgagtagattttctgtgtcacaaagaaaagtagtagacggaagatctgattgccaccatgttgcatttaaaacctcattttctttagagaactgtccacaggactctccaataggcagggatttaagggtgaaacagttcagaaccacatctcccaccatataactcaaagatgacgtttatatatctgggaaccttttaaaaaccatctagatctatgggtaaatttcaaatccacaaagttcaactggatggaaagtttactcaaatgcattctttcgtcccagtttttaagcctaatcctactgcttttaggctgactgaaatttatagaactgaaatcatcattgtatctccccagtgactggtggtgatatttgacttcatatactgagaccaatttttatttaattcacatttttggaagagcttgacctgaaagtcattgccctatgctgaaaagattgaattggttttctcaagtatatatcataaaaacagttgatcctatcgaggtgaggtcatatcaaagtagtacactgaaattgagccctgaagaaaatattttttaaataattttttttttttttttggtagagactggatcttactttatttcctaggctggtcttgaactcctggcttcaagtcatcctcctgctttggcctcccaaaatggtgggattacaggcatgagccacaagccacccctaaaaaatgaatatatttttcagatatcaaggcctagcaattttcctaggtcagcaaatatagtctcttctttctgtacttcacaatgcaacatttgatattgagtagatgttgtagaacattacgttgaagagcccaggttctagaataccaccatatagtttagatcttggctttggtgctcgatcattgtgactttgagaatattgcttaaaattttctttcctcagcttgtctcatttataaaataatataaaagccactctctaccatgtagtgtttttgtgcctaatatatgagtagtatggaattgaatcttaacccactagcatctgtagtatgtgctactgcagtatacgaaaagatgcagtagatttctaaattttggggggaatattgtgttttatgcacatgcgttctataagggaaatttaggaaaccatgtagtgcatgttttcatacactatatttgtactggtatgaagtcacacagacagttggaatactgtcccgaagatatataattgtttgagtcacagaggttcctacgactccattaagacagaaggtatagcctagagttggtgggtctgagacagtgtctccaaagtctgaaggataataactgaatatagactccaaaatttaaggcttcagcatcctcagagtccttgcatttgtgagagctatgtctgtgatgttgccgtttgtcaccaggatactttatgttgtcttttaagtgttaggtgtccagatgcagatcacctgcatcttgcctcatatgtctctctgaatgtaaagattttgcctacatctgatgaaaactgtccactgttcacattatttgtcatatgtatctgcttggagcagagtaagacacttctaagggaacttgacatttcatgacccaggatatcagattcatccttaccactagctactctctgaaatttgggaatttcgttggtcttatggaccacgatcatgagactttttagaaagatgaactaaaaaatcgctattcatgcatccatttattcattcatccacatatccacccatcataaacatttacttcagttacttatccttctgcagaagggagcaagctgaaaacaaagtaattgggggtacatctccaataaccctccttctggaagtggaatgaaactccctccttcccgtcaagtctctttacataagtaaattgtatagaatgaattgtgctcctccccctacccccaaaattcatctgttttgaaggcataacccccctgtacacctgattgtgaccttatttgtaaataaggatattgcagatgtaattacttaaggtgatatcatatagaagtatggtggatccctaatgtcatatgactggtgtccttataaaagggggaaatttggacacaaatagacacacagggaaaacaccatgtgaagactggagttattctgcacaagccaggaaaccaccagaagctaaatagaaggagaccttttcctagtgccttcagagggaacatggccccactgacactttgatctcagacttctagtcttcagaactttgacacaatacatttctcttgtttaactcagtttacgttactgtgttacagcagccctaacaaagtcatggagtaaactctgggattaatccctttccccaacatttcataaactattctttatctacttagcaatgcattttggatattcttctgtgtcagtaaatatgtttctatgttatttctaatagttttaatatatatagttatttcccaaattaaaaaaagttaatccgttcactttgatatacattaatatactaacttgtctctaatttgtattaatagttaaaaattctgcagagtggtggtgtaatctggtttacatttgaagctattgattgtacttgttaactttcataactgctattttatatacttatatttcatgttattataaagttcttaaattggctaatttttaaaaacaggaatgaataacaaagaaataaaatataatcattcctaatggcagttatttttcttatgtattcatgcctagttttcaccaatgtgcatgtattttatctatttctaatatacatatatatgcacacacagacacacacccacaatgttctttaatttgatttattacttaatatattataaatatatttgcttttatagtacctttatggaatatttggaatccccatacaattttccatcaaatatatatgctcaaaatattattgatgtaactactccccattattgaacatttagtttctttttagctttaagctattggaatttgtgctgtagaacctataactatcctaaccataagaaggataggtcaaaggttatgaaactttgttgatcttctgtaattattttcataaggattttccataagcaagatgatagtgaaattgactaatttaggttgacaatttattcttgaaattagcataaaccagcagtatacaaaacagtaatgtagggataagattcaatttaatgctacattttagtaatcagaattctgattttctgaatatattgtgtcctttatcaggtgaatgctttcgctgttgatatgaacctcatctttccccattcctgcaacctaatgctttgtctttaaattctctgtcaattggcactaatttcttttgagacgtgttttggaaacaaataagatttttcttagtttaccaacttaactattttttccttaatctccacttatgataataatcttgagaacaaaagtatttagaaatgccctaggtataaatcccgaagagattgagtataataagccgtccatggtatttacacttggaaagcaaactttgactctttgccctttaccacgtagacttgatgcaaaaatcaatgagatgttctaggtttatgaatttgatttctttttatctttttcacaatgaaggaaaacaaatcaaattaatgttacaagtaaacagatttccgagctttgctacctaatgctgaacatctacgtacttcaaagacaatatagaatctttgagataaaatggcatttttttcccttatgataactgatattcaggattggaaacagtttgcctcaagaaaatgctgctttgcatactataaaatgccggtgattactcaactcttgcagtgttagatctaggagggaactcaagagttattccaatttttttccatgcagactcaataatgacattgagagaataacttttaataatacaggtatctattattaaaatgaaaatggcagaggacaagataatatgccataatctgcttcatcagtgttgtgtgtgtgtgtgtgtgtgtgtgtgtatcagcaaatattttttcagctaactaataggtgatataaaaaattggggttgtaagacctatccatagaaacaatcataaattactagccatagaatttatttgcctccctttggaagtttatttccttttgtgattaataacaaacttgagggtaggtgtatgtggttgaatggtaacaggcacccaaggtttggttacgtgggattgcatcatgttgcttggcaccacccagctgagtctccaaacagctagtttggaggcatgtgtctcgtgggcatggagtgttaatttctcttgcagcaaaacagaaagcggccgactgagagagtggaggcatgggtgtggttgaagagcacacaggagaaaagacggtgggggaatatcatttttttggttctgcttctactccagtactggatgccataagatattgcctactgctatggacattttattttaaaaagtagtaggagtttcagtatgatttattcattgtctatagaaatcctaatgtggattatgttcatacacaatatacagaagtatagatattaaatagtcaatttcataaacataatctttaagtaattgtgagtcaaaaatattcagggtccaattacaaggaaaagtacaattttttaacaatgctttatgtattttatttgtcttgatccaaggtttataaagtagtttaaatcctgtgcttacttaacttttctgtttatttgccaattaatagagaggagataaatgaaaaggatcagataggaagaagggaagcagccaatattgtcaaactaacaatggaaccaattgtacctgtgatgttatattggcgagtacagaaatattgaaaaacatattaggatttcaaagcatctgttttgcatatgagtaaacggagggttatgagatttcttcactcattacatagctggaacttatacccaagtccttatctccaagtctaatctcctatctttcttcagctatcttctgggtcttggggccagatttagggtgtttgaagaattatttgtttgcacccttaaactcatttgaattttgtaaactcttaagtatagtaacttcacattaggtgttgcacttgcacagggcaactttggctaatggttattggaaatgtggagtatgggccttctagggcactttccttagtttttttctttttctggagtgaggtgaggctataaaaaatagacaatattaaagcatatagtcgtttatgtattcaatacttttctatgccaacagatcctctcagtgtactattatgcaccttattttgcaaataagtcaagagaaaaaccgttttttccatattaaggaatcatataggacaggcagggtttatataaaattctgatagcacttagtaaagcttcgttctccctaaagtgggtacaatagaaggtaagctttggaattttaagagtattcactgttcatgacactgtttatcctacatttgtcacatatcattttctcaggatatctgacataacctctccaagatatttggtttaaaattaattggcagtcaatggcaaagggtagagtcacttaaatttgctgaagcaagcacagtagcatctaccagagtatatgtcagattgttctcagaccgccaagggcaaaaatatgtgctgagggaggctgtactggtgccactgtgttggaggccttcttcaactcttaattagcttgctatgagtggagatgccatcttgactggctctctgggaaccattaggcagggccactgaccttggcaactctaatatttatctctgtggaactgagttgtgaaactaaaaggcactgcacaggtgtttccaaatattttaaaccagcaatggagagactattaatttaggccattaaaactaactaccaatgtatagagtgacctggtacaggacactctgcaggtatcaatctacctttgggtcagtagcacagtgccccttgccttctgccaccacattagaggcatcatttttatttttagcctggacataacagctggttaaattatgtgaggagtagctcttcttgataagatcagcaaagatgctagaagtaagactgactgtgaaatagctgcagccaactggcctctcagccatcattcttatctcctggataaataagaagcctgcaattacattttgaaaatctctaatagtcagataggcaaaacaggacttccatggactcaggttgaaaggtttgattgtgagttgtgatttaaggccaaaggaagagaaatagccaagagagaacagtatagataggagacagaatctcagtaatgaactagcaccagaaaatcttctgcaaagaatatacacaagaaataatctccaagacacaggatttaagcttctgcattttctttctattcctaacagtgtgcctagcaaccgctgatatagtacaaattttgctgaatgtcagatcgagagctctggaaggtttatatctgcaggagattaaggtacaaatatttccagattcgtttcagggtggcaagatcaactcacagcatgaggcttctgtcatcatagagatgctttgtggtactttctcttctttcgtaaatgaactggcaaaattgccacttgagtcaaatggaagaaggcaaaatgttgtgttagctgttctggggagtgagtggcatgtttcctgggccagatagtggatccatattcagtaaggggactgactcagtgctctttgtggaactagaagatcagaaaacaactgatcatgcttacgttgtattcatgatggccttgaaaagaaacatttccacccattatgttaccactatattgaacatgcactaatagaatagaagtggaaatcatcagcattaacacagattaattttatgaaaggtcacagccagattgtatacatggacatgccataggatggaccaagataaatctttaccatttatttagttcttcattgctctgggaaacctatattttgtcagttacaggaaatatatagctcaatggctaccattagtttgaaaaataacagaggatatattttggcctgaaaggaacagaggtctaatgttattgcagctgtaataaagaactaagcgcctgaccttatgcttgaaagagttaccaggtgaagacagagctgttcacttaaagcactcagattcagaagcaatccttaaaaacaaaacccagaggaaaaccatttaataaacaaataataaggcatgctggagaggcagttgtgggagtctaagtgtagtcaagtgtttccgtcttagtgcttgttccacttagccagagctctgggtcacctgggatttgggccctgggaggggataacagtgtgtacgggtttagcactggactctgctgtgcattcaacttggagataccataggccaactggagctcacaggcttcacagcttcatcgatttttagcttcagtgaggataatagggagccaaaacaagacaatttcattgctccatctctgctacctcatttctttttcctcagtatgcatttagacgttgcagagagttcatgggacagacaaagaaaaccctttgctgtgttcacaaatggtccaagactgaattaagaatcacaatgatattttctctattagttaatacattatttaactttatattatacattgagtatttaagttgttttaagtgctgttttacttgcatatattaagacaaatattacctggttgatttccacacagtggacttttaaaaaatcattcaatcaagagctatcttggtatgaaggtaaggaagcgacaagcctctgtggtagacattgaacttttcatattttggatatatctgtcctcttttttcctttgagaacacacaagagaatccttattattaatttgttaattcagaaacctttcttgagtaagctacatatttttataaattcacacttacaaatcaagaacctgatactacctgtaatcctaacaaataaaattaaatctttctcagaccccacgtgccaatattcatgattgtcccatgacagcgagtggtgcctttatcttttacaattattcacgcatcaagcttaagtattttggtaaatgatggagacacgctcctcagtgccttagtcctccttggagaacatgggaagaaagattgttcttctgcaatcataagcagactgtggccatccaagaatccaagtatattcttaaacaagcttggtctcaccaaaaatagttgaatagaatattgcccagtcatcaagaaatcagcaaacattttaagcacctttaaagtatgctgtgctaggcattctgatgggatacaaaaaatgtgaggatacattttaattaaataaaaacaatatgagtttctgtcctcaagaaacttataattgggaaaagaaaacaaagtacagtattcaatttcttcctggttcagttttgggagattgtgtgtccggggttttatccatttcttctagattttctagtttgtgtgcattgaagtgttcatggtagtccctgagggttttttgtatttctgtggggtcagtggtaatgtcccctttgtcgtttctaaatgtgtttacttggatctctgctctttttttttttaattagtctagccactagtctatttatcttcttaatattttcaaagaaccaattcctggattcattgatcttttgtgtggtttttcacatctcaatttccttcagttcagctctgattttggttatttcttgtcttctgctagctttgtggttagtttgttctttgttctctatttccagtggttgtgatgttaggttgttaatttgagatctttctgaatttttgatgtgggtgtttagtgctgtaaacttttctcttaacactctcttagctgtgtgccagagattgcgttatgttgtatctttgttcttattagtttcaaagaatttcttgatttctgccttaatttcattatctacccaaaagtcttttaagagcatgttgtttaatttgcaggtaattgtatgggtttgagagattttcttaggattgatttctatttttgttgtgctatagctgttgctacaattttgagttttttgcatttgcctgaggattgttttatgtccaattgtgtggtcaaatttagagtatgtgtcatgtggagatgggaatatgtactctgttgttttgggttggagagttctgtagatgtcttttgggtccatttggtcaagtgttgggatcaggtcctgaatatttttgttaattttctaccgcaattatctgtctaatgctgtcagtcgggtgttgaagtctcccactattattgtgtgtaaatataagtctcttcataggtctctgagaacttgctttatgaatctagctgcccttgtcttggttgcatatatatttagggtagttagcttcacttattgaattgaaccctttactgttatgtaatgcctttttttttttttatccttttcatctttgctggtataaagtctgttttgtctgaaatcacgatagcaacttctccttttttttctgttttccatttgcttggtagatattcttccattcctttatcttgagcctgtgagtgttatcgcatgtgaggtaggcctctcttgaagacagcatatcattgggtcttgctttgttatccaccttgccactctgtgccttttaattccaaggacatgaacagacacttttcaaaagaagacatacagtatgcagctaacaaccttatgaaaaaatgctcaacatcactaatcattagattaatgcaaatcaaaaccacaatgagataccatctcacaccactcaaaatagctattatgaaaaagtcaaaaaataacagatgctagcaaggttgcaggaaaaaagggaatgcttatacactgctggtgggaatgtaaagtagttcagccattatggaaagcaatgtggtgatttgtcaaagaacttaaaacagaattagcatttgactcagcagtcccattacaggttatatacccaaatgaatataaatcattctgccctaaatacacattcactgcagcactattcacaatagcaaagatgtagaatcaacctaaatgcctatcaacagtagactggataaagaaagtttggtacatatatacaatagaatactatgcagccaaaaaaaaaaaaagaacaagataatgtcctttgcagcaacatggatggagctggaggccatcatcctaatcaaactaattgcaggaacagaaaactgagtactgcatattgttacttataagtgaacacatggacacaaagaggggaagaataggcactggggcctccttgagggtggcgagtgtgacgaggtggaaaatcagaaaaaatatttggtactttcttattatatgcatgatgaaataatctgtacaccaaacctccatgacacacagtttacctatgtaacatgtttgttaacctgcacatgtactcctgaaccaaaaatgaaaatttaaaaaaaacaaaatatgaacaaagtcccaatgtaagagacaaatatcagttcaattaagtacagatattgattaaattggtagcaggaataataaatacttcagcagagtagaagaagaagaaatggccatgggctatcctggcctttaagataaatggaagaaaatgaatatgagcagtatcctgaaggattggtaagatttacaccaatttcattccgagcggatgttctagcatgcacaaaagtaaaagcaggaaaatgtaaaatcattaggtatgatgatgatagtagttaacttttattgagtacttgagagatcccacgtaatattgattaatctgcaccagaacatctaagacaaatttaagacatgccagtggaaaagcttagccacagattcgatgtaggtgataaaaataaagggaatgagaaagctaaacattgggagaaattagcaaaaactccaggtcttcaagactgggtagctggaagaacatggtatagatctactaatacgagtgtcttttgacagacctggtttacagagaagagatcagggttttgtatgatatttatttatttatttatttatttatttatttatttatttatttattttgagatgggatctcattcttgtctctcaggctggagtgcaatggcacgatctctgcacactgcaacctctgtcccctgcattcaagcgattctttggccacagcctccctctagtagctgggattataagtgctcaccaccatgcccagctaatttttgtatttttagtaaagatggggtttcgccatgttggccagtctggtctcaaactcctgacctcaggtgatctgcctacctcggccttccaaatactggaattgcaggcgtgagccatcatgcctggccatgagataatttttaatgaatttaatggaatgattcaagaagaaatattcagtaaacatttagaaagttgggaactgggattccagagaggctcaactggaaaaacacttaatagtcaaatgcctagggaaggtagcttcattcaccagaatgaaaccaaaaattgtgaacctcctttagaagttttacatctagagaaccatgaaacaaagtgaattttcatttatctttaagtccaaagagaacttaataaccctcatgtttctcatgatactgtccaaaatccacagatccccaggaaattatttcttgttttcacagagacatgcgtattaaagctaactgaagaaggcaaaaaggaaaacaaaatgactgtgaacagactaggtgtatctgttctgttcatatcctttgcccactttttgatgaggttgtttgttttattcttgtaaatttgtttaagttcctggtagattctggatattatccctttctcagatagattattagccctttgtcagatggatagattgcaaaaaattttctcccattctgtaggttgcctgttcaccttgatgatagtttcattgctgtgcggaagctctttactgtaattagatcccatttgtctattttggcttttgttgccattgcttttggtgttttagtcatgaagtgtttgcccatgcctatctcctcaatggtattgcctaggttttcttctagggtttttatggttttaggtcttacatttaagtctttaatttatctcaagttaatttttgtataaggtataaggaaagggtccagtttcagttttctgcatatggctagccagttttcccaataccatttattaaatagggaatcctttccccattggttgtttttgtcaggttcttcaaagatcacatggttgtagatgtgtggtattatttctgaggcctctgttccattccattggtctatatatcctttttgttaccagtaccatgctgttttgtttactgtagacttgtagtatactttgaagtcaggtagcatgatacctccagctttgttcattttgcttaggattgtcttggttatatgggctctttttttggttccatatgaaatttgaagtagttttttctaattttgtgaagaaagtcaatggtagcttgatggggatagcattgagtctataaattactttgggcagtatggccattttcatgatattgattcttcctatccatgagcatggaatgtttttccttttgtttgcgtcgtctcttatttctttgagcagcggtttgtagttctccttgaagaggtcctttgcatcccttgtaaggtgtattcctaggtattttattctcttcgtagccattgtgaatgggagttaactcatgatttggctctctgtttgtctatttttggtgtttaggaatgcttgtgattttgcacatcgattttgtatcctgtgactttgctgaagttgctgatcagcttaaggagatttggagctgagacgttggggtttctaaatatacaatcatgtcgggttttctaaatatacaatcatgtcatctgcaaacagagacaatttgacttcctgtcttcctatttgaatactctttatttctttctcttgcctgattgccctggccagaacttccaataccatgttgaataggagtggtaagagaggcatccttgtcttgtgctggttttcaaagggaatgcttccagcttttgcccattcagtatggtattgcctgtgggtttgtcataaatagctcttattattttgagatatgttccatcaatacctactttattgagagtttttagcatgaagaggtgttgaattttatcgagaacttttctgcatctattgagataatcaggtggtttttgtctttgcttctgtttaagtggtggattacattgattgattagcatatgttgaaccaaccttgcatcccaaggatgaagccgacttgatcatggtggataagctttttgatgtactgctgaattccttttgccagtattttattgaggattttcacatcggtgttcagcagggatattggcctgaaattttcttttttgtgtttgtctctgccaggttttggtatcaggatgatgcaggcctcataaaatgagttagggaggagtccttctttttctgttgtttggaatagtttcagaaagaatggtactagctcctctttgtacctctggtagaattcagctgtgaatccatctggtcctgggcttcttttggttggtaggctattaattactgcttcaatttcagaacttgttattggtctactcagggattcaacttcttcctggtttagtcttgggagggtgtatgtatccagcaattcatccatttcttctagattttccagtttatttgcgtagaggtgtttatactattctctaatggtagtttatatttctgcggtgtcagtgtttacatccccttggtcattttttattgtgcctatttgattcttctctcttttcttcttattagtctggctagtagtttatctattttgtcaatcttttcaaaaaaccagttcctggagtcattgattttttgaagggtttttcatgtatctatctttttcagttctgctctgatcttaggtataccttgtcttctgctagcttttgaatttgtttgctcttgcttctctagttcttttaattttgatattaggtgaacagacacttctcaaaaggagacatttatgcggccaacaaacatatgaaaaaaatctcatcatcactggtcattagagaaatgcaaatcaaaaccacagtgagataccatctcacaccagttagaatggtgatcattaaaaagtcaggaaacagcagatgctggagaggatgcagagaaataggaatgcttttacactgttggtgggagtgcaaactagttcaaccattgtggaagacagtgtggcgattcctcaaggatctagaactagaaataccatttgacccagcaaccccattactgggtatatacccaaaggattataaaccattctactataaagacacatccacatgtatgcttattgcagcactattcacaatagcaaagacttggaaccaacccaaatgtctatcattgatagactggataaagaaaatgtggcacatatataccatggaatactacgtagccataaaaaaggatgagcgtatgtcctttgcagggacatggatgaagctggaaaccatcattctcagccaactaacacaagaacagaaaaccaaacaccacatgttatctctcataagtgggagttgaacaatgagaacccatggacacagggaggggaacatcatacaccggggcctgtcgggggagtggggaagctagtggagggatagcattaggagaaatacctaatgtagatgacaggttgatgagtgcagcaaaccatcatggcacgtgtatacctatgtaacaaacctgcacgttctgcacatgtatcccagaacttaaaatataataaaaaaaaaatgccaggcgtaaagcaagcagaatctgtcagctccctttcattttagaggtctgtggagcatgttgtacaggtttgcattaattccttcagaaccagagaaaggtatcacttaatggaaaacattactgattgagaaatggtatggtttttttgaggtctaatgcaatattttgaatagagaagaatgtcagctcaaaatctaaaatgttatatgaatgtcaggagaagaaaagtggctgtatatgtttgtatatcatgtgtgtacttgagtgtatgtaggcctacacatgcacacacaaatacacacaagattttcttacgtttatccacatgataatggatcaagaccgtttgtgatggccaaagatgcacaaatttatatgaacacctaaattatgttaggatgggagtgaatggaatgattttcatcaccttaatactttgtaatgatcatgaaaggatttttgaaaaaaagaaaaagccctaatgatttttgaaaataataatagcagagggaatcccatgcaaaatcagtttgttaggcatgtgaagattttaagtaatgcagaaaagtaaaaaaaataccttccctaatggtgatgtacagaaacatgtttatcatcaatgcttttataacttttctctcatctcagtttctgttagagaattatgcataatggattgtgtatttaacaggaattcctcgattgcaatggctttttaaaggtttttttctttagttattaatagaatctttcatttacagcctaaatattgctgtcatcttagagaaacagtgaagtatcagagaggaaataaaatgggataaaatggatattcagaatgtcttgctacctgaccgttacttaaaacaagataccttttctttcttttcatgaaaacaaaactatttgtcttcactatccactctgttaaggaaaataattttctcaatatataaagtgaggcatagagcatacttaaggtaaactaaatcttaagataagtgaggccagagtaaaggagcaccaagcctcacttaaatgggttcatagatctaggctgcagtctgttactgttgaaacacatgatacttttacaaacataacaaaacaaaaaacaagaacattcaggtgtttcagtagaaaccgacagaaaagcgttttaggaatgctgtagattagggaaaattccagagagctcacagaacaacaacttcacttcttttgacttttaaagaaaaggtaaaagaataaattctggaaaatacagataccaccagaaacatttgtctgcccttgtaaattagggaatataggtttggtacctacagagtacaagacaaatgctcatcatgttgtgggggaagcaaaatttaaaaacatgtggactctacctaacctcagagagcttgcatgctaattaaggaattaatatgcaattataaattggcatttgacaagtagcactggaaaggcacagaaaaggtgatttattattcagagaagtggtaactttgatctgtggacatctagaaaagttatctctttggaaggtgagctgggtatcaaagagaggagactttattttaaaaggcaggtatggggtggagaaaactgtcaaaacaaagctatgcaggcagtataatattgcagcaagctgctgaatggaaaaaccaatttgatggaacatggttggatgtcagggaaattgggagatgtgttcagaagagtcagtgaaatttgactgcagatggtctatgaggaaggtgacgtgctacggcatggcgaagtgtgttgagtaggcacccggagactagagtttctgttagtctctgtcactcactcactgtgtgtacttgaggaccatttgacctccttggcaagtacacgtcttacctggaaaacgacggtgtctagttggagaccagtgtatcaactcacggtgattccatacagcaaatttttcttccaggtttggggtagatcaccaggttattgattaaacaccacacaaagtaattggcttgagtttaggaaccatgttttgaaaaaactgttatatctttaaagagaagaatcatcctcagcctggggagatactcacattatttcagagacacaagaactgaaacctcccatgagaatggtggactgggtttgtatgttccaactagcactcattccggggcatgtgctatctacagcgttctgtctctataggtatgttttgatgtgcttgtttttatcctttttcacagcacatatagtggaattcatttaaattaatatgtaagatgcatttgggcctttcatctcaagaacaagaatatggaaaccaaagttatttaaaactctagtcaaaggactgccttgaaataagtatcaaaactccaatatcaactttggcttcaaaaaggaacctaaaggcatttaacagtgtgtcctaagggatcaaatgtcaaatatgatggttactaacacacaggaagaaaaggaccagagctagaaaccagcagtaatatcttccagtatttttgggggagatggaagctgaaaaggatgaggaagagaaaaggatatgaacactgggtttcaaactaactttgctgaattatggaaagagaagaaatatttatttctgctgatatatcatgaaaagttactattaactgaattatttcttttcatttcactcttttctattaaactaatgatcaaacaggttggttctagccacttagaaaatgatgttgaatatgtcttgaaccaaaccagtagacgagttagtttaactgtatgaattaacaactaaagaaacacaaaatgctcatttttaccaggagttaaagctatgtgttttctgtaactaccaaactggaataaaaaagttatctcaataatcggtgtactgtatatgaattgatatctcatttaaattaatctacatcacaaaccttgttcagctttactcctgtctggccaaaattaatctttataatgaagtaccttaggtattttaggataccagtatgtattcaagtgagcgaataaaaattcagttgtctttgctaaaatttctggcatgtttagtgttttaataagttatctatccaaataggtattttaaggtattagtttcagacttccttttggtaaatgtgtttatatttgtaagttttaactggctagttttataacatatattaatttctaaacaggatttagagcaaaaaaaaacccaaacatactttgcttagtccacatttcactttacaaagtaccactggtcagctcagtgatactttctccagtttgtgggtcatttcatcctgcatttgtacaatgattttgagtaacacatcagtagtgaggccagctgattttgttatacccagagaagacttttaaattaaagcttgagaacagaaaaaaaaattactgaaaattgaggatcagcaaacttttcttgtaagtgggtaggtagtaaatatatatattttttattttataggcgatatgatttttgtcacactacttgcctctgctatagtatcacaaaagcagtcataggcaatgccaaaatgagcaagcattgatgtgttccaatattacttacaaaaatagatgttagactttcggcctttgggtctgggatttggcatttaggccataatttgtaaggaatttggccaaagctcatagtttcctagtcgttgctaaacatgacaggggccccaaatgaggtcccaaaatgagttctgaagaacgtttgtcccatgggattttcatggatgaaaaagtaaatctaggaaatgctgcacagaatgcctttcttcttacacactgaaattcaatgtcatcttattaaaggctataagacatcttacaataaagtgatctgtctctgttggctaactcagttccccagaacacatgtgaccttgaaattctttttgtcatagataatttgagtatctgtgattcagaaacaagtttccaaactgatcatttggatatctatatagattgtcatatgcatatctttattgaaatatctttttaaatccgagtcaacttcgtgagtcacttatccacaaaggtaaccaggaaaaatactaaccttcttaagtggttctggataatttcctgattagtcccttcttaggttctaacacattagctcctgctgacaatttgagccgttggccttattctgctttttcctcggtaattaaatccattgtagtttaaatcagttcaacatatatttaccatgtacgatattttccaagcacaccgattaatgaatgagagagaccgtgtctctccctttagggcatggatagtagcaaaggcataaagacaaaggttagaatattatgtgataacttctctaataagagaaatcctgaatgctgtcaaagcacatatgagaagtactaaactgttattatgaaatcagagaaagcttttagcctggagttcatctaagctacaaatttgaagctaatcacagaagggaagagagaggggaacagcaggtacaaaggtaaggagacaagattctctgatgtatcaaggcagtgcatagtacaactctaatatagatttatgctgcagagatgggtgagagttggattaagcaggtttttactgactttgtgaaagtatgtaaggtaggtggaaagttggaggcttgatcagagttgtactatggtaatatagctgtggctggaacgtggagaatggcctggaggggcacactgctcagaagtgagaatttctgaagctgttatgaagctttcccagggaatctgccatgggtaacctattaccccaggttcatcccttagacagataaggtgctgtcaagactcctaccttatgacaagaaaccaagagctacgtaatgtttttttccctgaaaccatctgtttgctagtgtaaacattaaactgtctttccatttgggggttactggaaatatcataaaaagggaataattttagactttttttaaaaacttgaaaggaggctttattatgtatttatagcaaaacaaaaattggcaccaagaggctagcctgagttttatacctgaaggaaatgtggaggcaaacctgggcattttccttgacaacagcaattaaccaagaagagcctcaccttaacgtctgttttaagacagcagaactggtcggcatatgaatatacaaacgtttaattacacaccctgcctgtccttgtgaacctctgtggtttacttacaaacgcatgagttatttcacgaagttatcctcaatcaggatgcagcatagtgttgtgtttactacatatgaaacatgcacaccttatccagtctgacacactgaagcacttaaaaggatgtgcagtaggtttttttataaacaagtagggtttttataaaccattttcttccacacaacaaattatactgttaacagctcggccctggtaagttttatatatgtgtgcatatataaattttatatatgtgtacctacaaacacacatacacacacaaacatataaaaatcacattttatatatgtgtgtgtatatgtatataatacatatattatttggaagtgtgatttctgtatttttcctgtattctaaccatatgaggaatgtctactcaacattgcttagaaacacaagttctaaggtccaaacttaagggtgtgtgtagtttagttagtggctgctatggttgttggtggagagtcagatgttgaaaagaaatggaacaaagttttttctaaacttgaaaatgctgtcttgaaatttgcagctaagatgtagtaaaagaggggctggtaggcaagaaaagaaaaactgtatgtaggcatggatcttaaacaaatcatgaaattgaattttcctaaagcaacttaaactatttatgattttctttgtcctttgccagatctctgaaatagcgtcagtctcaaaattcatgttatcactaattaggattctatcctcagattttttttgcagatgattcaactatttcttagtttccacagataactaaaattactacagtttctcctaccaacaataggcctagactgctaatccaaggaggaaatttgatgtcagaaaaagacacaaacaaagcaaaaatgcagtgttaacagttattcccacttttatctttctttacatagatctcacatcgcattgcaaggagcttacgctagtagtaaataagaaatttaggggaaacctgcatgctgcatttttagcatacaagaagtacaaaattctggctttatttttttcttcattaatatgcatggtaggccaggcatggtggctcacgcctgtaatcccagcactttgggaggccgaggcgggcagatcacgaggtcaggagatcgagaccatcctggctaacacggtgaaaccccatctctactaaaaatacaaaacaaattagctgggcgtggtggcgggcgcctgtagttccagctactcaggaagctgaggcaggagaatggcgtgaacctgggaggcggagcttgcagtgagctgagattccaccactgcactccagcctgggcaacactgcactccagcctgggcaacagagcaagattctgtctcaaaaaaaaaaaaaaaaatgcatggtaatcttggttcttttcatacctacgtttgaccgttcagcagtctaattttaattaaatcataacaaagtaacaacattgactatattgattgcatcttgggaattcagaatttattttttcacataatttttcctatgactagctggtcttctgtaggcaaacttttatgatccttgaactttttctggaaatgatgcagcaaactataaatataaaatctgcaatggtatactgtatgtacatatctttcaaggaggatagctccactgatgtaaaaacaaaaagatattaaaaactctgattttcaagctagaaaattatttatgcaccattggctttattttaaaatacatacttgcagaaaagttgcaaaaatgtcagcgtttccatacgcccatcactctgattctactaatgttaatattgtacgtaagtatagtatgatcaccaaaccagaaaactgacattggtataacactgttaactaaacaacagaccttattaggggtttaccagtttttccataatgtccaggctgcaatccacaatcttgcattgtttatagcattcatttcttcttactcttcttgagtctgtgccagttcctgagccttcgcctgccttttgtgatcctgacacttttgaaaactactagtcaatcttgttgtagaatattactcaattttctgatgttccctcctttttttttattgatgtcatgcattgttggcaaaataccatagaagagtattatgtccctctcagtgcaccctatcaaagggcacacgaggccagtatgtcttatcactagtgatactaattttgactatttggttaatatggagtctactgagttttcccagcatgatattagtgttttcccacattagctttagacaaagacacataaattcttaatttcctaaatatgatatactcactatactcttttatgcctcagtttccctgcctaaaaattattatactgcaaccctaaccctcatctcaaccagtgtagtaagaattaatgtgctgtcctttggagattcttggataaaactcactgtataactgcaaatgatcactctatctcattttaaagaagaacataaatagaatggttaaaagtagattggcagcatgtactcatttcacacccagaactacagagacatctgttatatatgtgacaggccaggcctgaaatctggttctctgagaaccagttagtgtttgcccgatttggcctaagtcagcctgattaaacaaagaacatatttatcacttgctacctaacaggctattacactaactagatggataaccacccattgataaggacaataaataactttttaaaaactgtcacattcagggtttctgctgttcatataagagggaaaaaagtcccttgacatactaaggattctggatccatgtgctgtaattctgtcatattagtttgtatctgataatgaagtaccccaccattgcagagaatggcaaacttcgcaaagtgatttactggctttctactctatttttatttttgaatgtcagtactatcagccctgacacaatacactgggaggaaattggccacttacaggtctagagggaagtaggtagggaaaggtatactaaagaaataagggactcacataatcctccaagccccgctttcctctttgacaaatggaaataatcatatacctgcctcctcaagttattgtaagcatttggtaatctgtccaaaacctttgtattgtaactgacccatagtaagtactcaagaaaaaaagaaaaaggttgtcatttttatcactttatcatctttcatacctgagacccagatttgggtgcaaaagacaagaaaatggaggtgaggctctcataaatagtgtggtttaatttgcagaaggcttctggaaaatgattttataccaaataagaattcaatagcatttgtcaaatggggtggaaatatcccaccatctgcatgtagtcatgaactaaagcatgatgatactgaggtgtacttctgctctttgagagtatgtgttcataggcaaataaacctagaaaatgaagaagaatgcaagctccatgatagcaggactgaactttaccgtgatacccagtgcttgctggtacagtgtctgacatattgcatgtgttcaacgaatattttcagatgaatgttctaatagttagctataaatacataatggcacaggatcttgaatacacagtttatttaccattacatgagatgggagatcccatattatagtttagctaaaaagtagggggatttcctgtcccaacctccacttatattgttattattattattctttttctttttcttttttttttttaagacagggtttcactcccatcacccaggctacagtgcagtggtgcaatcatggctcactgcagcctcgatttcccaggctcaggtgattctcccacctcagcctcctgagtagctgggactacaggagtgcaccatcacacccagctaactttttgtatttttagtagatatggggtttcaccatgttgctcaggctggtctcgaatttctgggctcaagtaatctgcctgccttggcttcccaaaatttggggattacaaatgtgagccaccatgcctggcccactccacttattttaagagaatgacttctgacttccttctaagtaaaacaacacttatattatgttccttttgcattatggtggtaaccattttacttgtgttatctcatatacttctctacaaacttctgaagtaggctcagtatctccgttttatggacacaaaactggaggatcagaaataacttgcctaaaacaatacaagtccaagacttgaacttaagtctatctacaaagaccatttatgttcttgactgatactgttgcatttgtgcactgttgcagccctcttagagtattatattatcttcccccagtagagtaaaataatctccatgagggaagaccctgtcttattcattgctgtatcgtactgcacgtcagttactagatgttcagtcactaatttgtaagtaaaggatagagtgccgtagtagattttatttaacaccctactttggtatagcctattacaacttcagtttttatgtttgaaatcttatttctgcttctgattaagcagacatagactcccttttaggctaccagttatctgattttctgatgtggctgtccgagcaatcagcaagctgtgcgtaatgatggacatactagtaagcttacttccccactaagtgtatccaagtaaaagccctgaaagtcacacggttcttgccacttttaatctgacacctaatatattaggtattagagtgttttgtgcttacctttagctcttctttagtttaggtgattaaaaaatgcctgttgctgtctgtatgtgcagcatgcttcattaacagtcatttatttgggaggttagcagaattggcactctgcagcacaccagcgagcagaaggaaaacaaacgtgagatgattgctaagaaatccttctttcctgctctggtgatagaagctttaagagtttgcaaagtttacttcccagtacccagaaagcatgggaaagagcagggtttctggggattgcaatttcccccaagtcccttgcatccgctctcctccagtgctcagtgggaaatccaaggggtcatggatttccccctttggcacggtgtgctccctgtatttgtggtctcccagaaccagatccttccactgcttgcccctcttgttttttccagcaagtttgccgactcaaactttttctagcagaatccaattatatggattttctctcatattcctttcaacaaccctgtattttcactgtcactttatgaaagaggaaagtgaggctaacagaggttaaatgacttgcccaagaacaacagctaaatggtagagctgggatttaaacctggcttgtgtgattctaaagccaatgatctcattgccatagggaagcaaaggaatttttattttacttgaaacctgtattgattttgtcatgtgtacttgaaatgccatgctgagaggattctggggctgcccttgggctaagcagcaaagagtgccataatcaattagcattgctttccataggagtgggacagaggagtggaggtgccatgtattttcctgtcttgaactatgatctacttttgttcttgattttattgtaataagactgtaataacacgggaatgacattctaaaggaaggatgaagtatctgaggggcaatctaaatgcaagatgaaaataccacatattttatatataaactacaattgcctgctgttctaataataaggctacatatacctatttgggagaaattcaacagagtgtttaaatatccacaatcttaagtcaaacttcataatctcaacttttattttaaattcagggggtacttgtgtgggtttgttacataggtatattgtgtgatgctgaaattaggaggacaaatgaccctatcacccaagcagtgagcatagtacccaataagcagttttcagcccttcctcccctccttctctctttgttctactagtccccagggtctactgttcccatctttatgtccctggatatgcaatatttagctcccacttgtaagtgagatcacccagtatttgtttcctgttcctgcattaatttgtttagtataatggcctccagctgcatccatcttcctgcaaagaacatcatttcattcattttcattgttgcatagtattccgtggtgtgtatgcaccaaattttctttaatccaccatcgatgggcacgtaggttgattctatgaccatgaatagtgctgtgacaaacatacaagtgcatgtgtctttttttttttaattatttcttttcttttttttccttttcttgtttttgagacagggtcttacactgtcacccatgctggagtgcagtggcacgatcttggctcactgcagactccaaatattgagctcaaacaatcctcccacctcagcctcacaagtaactggggctaaaggcaggagccaccacggctggctaacttttaaattttttttttgtagagatggtatccccctgtgttgccctggctggtctcgaagtcctggactgaaacagtcctcctgcctcagcttcccaaagtgctgggattataggtgtgagccactgtgcccagcccaatttatttttctctgggtatatacccagtaatggaatttctgggtcaaatggtagttctgttttaaattctttaagaaatctccaaactgctttccacagtggctgaactaatttacattcccaccaaaggtttatgagcattctcaggattcattttgggagtgatagaaatattctacatcatgatggtgatggtggttgtatgactgtataagtttttgaaatctcatcaaactatacataaaaagaacgcatgtcagtgcataaaatatacaataaacagggaaaatcagagaaagttctatctattacttattaatttcaacttagttaacccataaaattaaaatcatattgttgtttaccttcaaggtttttttaaagattatatgagttaacaaataatacagaaactactatatagtaaatgctgtttaaatggtatctattatttatcatttcaccagttgttttgtactatattctaccattacgttatctccaacattgtttgccagtttaatcacatacccttttatgttgctgatttactacattgtactgtatactctcacaaatacataagcttcatatgtatggataattgtgagaaaaatcatagctttgaatacatggctcttctgtgtttaactaaacaatgttagaagactagaaccattcatgtctgtttttcaactgaattgctgaagtgttaagtatctatatgtccaaataaataatacttattaaaaatgatggactgtaaggtgtgtttaaaaatattgaaagcattagctatgatagaatgtttaggatgaatttgtggtatatacttagaaacctgttattaaagaggaaataacagtaactcagaaaaaacaagtactataaaaaaaaaaagaaaagcagtatactctcaagctcagctaacaaattaccaaattatgtgctataactaagtttagacaacagtgaagcaaggtatgtttgtatttgtgtattcctgtctgtcattgggaatgattaagagagttgaatatcatcattcataaaagaacttagtacatatgacaaaaaaatcaagaaatagtagtataagcatgttattttttcaaattatcattgttgaactacttaacagaaaagcagtttgttgcccctggacaatatttacctatggggactaacagctagtatttaagctatgttcaagcattcctttaataaaagtaaaagttaaataaaactttaaaaaattacaataagtgattacttagtgaaggctgtggatagtgaatgtggacttgtggcttggagttaaattttcagtaacagtttaatacatagaatttaaaagcaatatatctaaaacaattttaatggatgggaagatgatataatccgaaaaattgttacaagcctcaaatggctctagggatgacaaagacatagtctttacttcatttaactaattaaatatttttggcatatataaccttcttcttatagaataatgtaattcaaagtttcaagaatccttaaaaacaatctggcccagtcccgtcttctattcatgaggaaacttgtccagcaagcaaataacagcactgagcctggaacgcagttattctgaatcttatcccagtgatcttttgaaatatcactgtgattattgaggttacttccgttttttgaagagggtcttctcggtagcaaaatataaaggtccaacatcaaaggtagaataaggttttctataaggggaaagtatattttgagaaatccgtagtgggtttatactttaagaaatttcaatgaaagacttttccaaattaatccgtataactgtggactctcgggctatggaagacatccttcagtaagtgaaatgatgatacattagctacctggcttttatttcagaggatttctgcctaatgtactcatatttatggttagaatcttcacaagtggaaagtcttttaaaatggggagcaactgtgtaccttagctgaccctccatcattcctcaaggtcctctttaatgtggtattatgatattatgatggaaacggtgtctaaatcaaccattgggtaggtgagtatggtctaaataagggattccatcctatacatgtctgcctcttgtttaatagatgtagcttcccgaatatatcatccaggtcccttatgtcttcccctcttttgcactgttctattcatattttcagatgcttgggacaaataatctaatgataaaaaccaattaacacatattttctcatcattcctagcagactacttactgcaatctccagtcaagtttgaaagacatcacctataggaatgaaaatctgtttttactggtagatagagtataaagctggttaaaggagaaaatccagcaagttatttgattgactgatgtgataggaattttcattatccaagaagaacctataggctagctactgtaatcacaggacatacagatgacctgaactactcatttgacatataaactatatcttgtatggtcaataatctttcctatccaattgagctgtagtgtccttgtgggcggagaccttgacccaaaactcttcatattttgcattttaccaattgaatcatggacattcaacaaatatctattgactgattgaacattaagattttactgtatgccattttcctttaaaattattggcatattgctttctgaggaagcctatttaatctcttgctttcatttctgtttcccgcttcctcgccattgtgattgactgcacccctcattagctaattgtagagttaggaaactctcaactctacagatgggaactgtggatgatcctttttaaaaatctctgccttcagaatggtagcactctaaataataactagcaagaaagcaaatgtttatgttgttcttacacttaggaggaaagaaacttattcacagttatgctatcacaaaagacttctgaattaacactagtgaaacgtagccttccgacaaagtctcagctctgaaacctgtgctatcctttacattatgagtattacagattctgcaccttggcttactggcacctggcttcacttctgcagaaggacaacatgaaaagccaagttagagagaaaggagtcaccatcaggatgttatctcacacttgaaaagacacaatacttttagaagagttcattacctttagaaactagttcagtatttgaagtatgaagacatagatttaaatactggctctattgatttctagatatttaaccttggacgagtttcatagcctctcatattctaattgccaaagctctaattttatagaggatgatgatgcctgactcccagccatgttataaggattaaatgagaagtgaatgtaagatcacgtggcaggtccacaagagatgttagctgcctttattctttcatttacatactagctgttgattggctgcctgctctggtggttcactattctatgtgcctctaaaatgtcaatcaagaatacaaagattcctaccttcataaagttaaaaatctatttggtgggggccaggaggcagaatttgaatccaagtttaaataaacgatgatagttaatgctcacatacaaaacaagccagtggaccttcacagcacacttgtaagaaagatagggcttctggcatgatccctaacctacaagcaagcaaacatgtttacagagattaagtgtctttcccaaagtgaggtaatttgtagtaaatccaggaagaactcagtgtgcgtgaatccgtgttttcccactctgtcttgctgctatgaggctttgaaaaacatactctgttggaagtattcttagtaattagagatgtagtcaacttgctaaccagaggagaaaagcaaaaaaggtaaaatagatattatgtccttcaggggattgcattttaagcagatcttcatacaggaaaataaaatctttttaggtctttcccttcttgaaagtcattctcaccctcctcgtagacttcagaatcaagtccagaattttttttttttttctttttttcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccgtgcctggcctcaagtccagaatctttaatatacgttcaaagatgattggagaccaggctcttgatttaccttccagcctctttccccctcagcctataactcccaaactcaggctgcgctgtgctgtctttaacaaagatagctatgacgtttcaactttgtgccagtacctaagctcagtgctttccatgcattctcactaatccttaccataagtttggcagatagatatcttgctgctcttttatagatggaccacacagctggagagtgggaagtctaggaatagagcacaagttagattctgcagtctacgcttttcattttcttgcactgctgtaacttaaaggttctcacagcttcttgccagtttgttttccttgtcacttggctcagaatggccttcctccctcttatttatcctttaagaatcagttcaaaatggtagcccctttgaggagctttcttgaaactcctgccctaccctacctcccagctcagttcagtgataatcttttgcttccttaacatcttgttcttaataaacttactgcacacattgcaccgaattataatgactggtttattagcacctcctgctaagtaaactgtgagctccttgaggacaagacccgcacctccctaacctctgcacacccagcacctagcaccgtgcctgccacatggtaaacacgattactttttttgttgagctgaattagtactgtttggataccagcaacattttaattcagcagagtgttcaaaacaaataaatacatgaccaggccctgcatgtagattcttggaaaccaggactcttaagggaaaactgattcatgcttttgttttcagcactttgtactgaggtcttcagtgtcactgttagtatgagaattgtttgaagggttgagggaagttttgttctgtgcaagaatgtgaaaaaaaaaaaaaaaaaaaaaaaccaccctgtacaattctcagttattcatctcctcctggctcaatgagagaaagcaatcgaggcctgttttattgtgtagcttccttcttaggatttacgagtctcattcttgggcaggatctcaaaatgagtgctgagtacactacctttgctacagccactgttggataagccagagagagctcacagctgcaggggagatctattgccaccataactcttggctcatcctgcagctttctttctgactctgacagaaaaattgaaattatgaaacttcgtatcctgcaccagagtcccacgtgagattcatgaatcttcagctcccttcagaaaaccggatgctttggttaccactgcccactgacaaattactgtccacgaccccattatttctgattagcaaaggtgaaccttacctacctgaatgtaaataaatgccaataggattcgtgaaattcttcatccttaaaaatctacagcccttaatagaacatgcactgtaaatactatcatatcatgaactaaatctttatcaggtaattggatacatttcctaagctaattttaattgcttccagaaactgcttaacattgtagatcaatcccgaggtccgagatgacatttctctcacaaaattaattattaataccctgatcatttgcttaagacattaatagttttcattgatcagcacgtcctgttgatctaaaatggcctaatcaccatgcatgtcagaagagtatctgaacatatccaattagagatacggccagctttctgccacatcagcagatccgaagttaagagtcccttttgtcttcacaatatattaagtccagctctatcagaaactaagctatttaagggcacaaaagaaaggcgagttctctaatgatgcttgttcattttctgttagctccctggtaaacatacaggctttgcagtgatcacatggtgtaaattaacgctaagagcccattattaagtagcttgtgttggcccatgttttcatgtaagcctgtgtttgctcacagtgtttttcttataagtgggagtaagatgagaaacttcaggttattttcagcttaaaaatattggggctcccacagtgtgtacatatatcaaaatatcacattgtataccataaatatatacaattattatttgtcaatttaaaaataatataaatgtaatatatttttttacatgaaagctaaaataacaagttgagaccacagtaacatctggcaatgtagggtgctgcagagttttcaaagaagtttcatttacttaaccaggagttttcccttgaaacaagattcaaagagaggctaggtggagtggtctacctaggaccacataacaagttcctgccagagttgtaaatagaatgagatctcccggttccataaatttctggtttatttgattgactgatgaataggtagcactctgctcatctttcagaccccaagggaagctcacctcctttgtgaagattgccaaacaaaaagtttcctccttccttgataacgggatatcatattgcaattatatgaaattctcagtaacagcccctactggataaagagactctagaggatagagactgtgccttgttcctcttgatgggcccagtgcttcaccttgtgtctggcaagcagaagatgcttcacatatacattcacacatggcgggctggcaggatgggtgggagaagggatgagtggatgagaggaaccacagttgagagttctgttttactaacttcatgttgcaatccttcagcaccagagggaaatttggctttacttgagtcatacagtgtttaatttttttttttctctgagacagggtctccctctgttgcccaggctggaatgcagtggagtgattatggctcactgcagcctcgaactcctgggttgaagcaatcctcctgtcttagcctcctgagtagcagggactataggcgtgcaccaccatgccaggctgatttttaaaaattttccgtaaaggtgggggtctcgctatgttgcccaggctggtcttgaactcctggcctcaagagatcctcccatcttggccttccaaagttctgggattacaggtgtgaactactgcacctggccttaaaaagtattttgaactaattttcaatacttaaaacttaggagattttcaaaatacagttatattttcaacttttctttgaaaagtcgtagatgcccctgcaaccctggatctgtgttccacattacccatctgcttgagctgaggggcacctgttcccttaagcaaggacatgcctccattcctcagaataacagtgtctgcccacagcttcactcagttactcactttgtagcttttggtaaaggtaatgagtggcctctcttcactgcagaattctcctaattcagtattcttggctaacagaagtattagtgttcctaatcatgttctggatatatccaaatgaacctagtaggcagctactgatagctgtttggatttctctcattagacactggagctgcatacttctgtggcatgttagaagtgaaacacggggcagaggggaaaaattgtttgagttaatggggtagtcaccattttcccacacgatataactccattggaaaaattgggaatttctacctgaggtccaccagtgttaagcctatcttgttctgtggcagttctgtatttgctttttttttaactaattggaaaataaataagaacaggatctggacaaagagagaccttgcaaagcatagtgcattcccctgccttcaggttggttcatgcctaatcagaaactgttcttgtcttcactcagaagccacagggacacttcagctccaatccctgcccaattattatctgcaagaaaaaaataggagtcttattagctttatattcataatttaacatgtccctttcttcccctccaatggtactttcccacaagtgagttttattgatatttgagtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcaggtagagtgtcattttaaaactttttgatttagaaatgccactgtatttcacactaattcaaaagtgggccttcactttagacggcaatgataaaatcgcaagagtatatgctgctatgactagcatttgctgacactgttgaatataccttcctgatggtcttttagtgactcttttcatggtgttgtatccagagatagacaccgatgtttcacctgtctatctggtccttttagagtcgtttgagccattatttagtttgaaagttgttatttttgctcatcccagtgcccagttgcacagagatattgggcaataaaactgataatatagtctggagtgttgcctactttcatttcagtggatggacgtttatctggatagctctttcagtgtctttgttgataccactccatcttctgatactgactctctttttcatttcaatgtactacagtttagtaggaactagaaagcaaaacacaggaggtttttaccatatactcatggccaactactagaaaagggatttggaaagttcaaacatggctgggcgcagtggctcacaccattaatcccagcactttgggaggctgaggtgggtggatcacccgaggtcagaagttcagaccagcctgagtaacatggcgaaagctcatctctactaaaaatacaaaattagccgggtgcagtggtgcatgcctgtaatcccagctactcggggagctgaggcaggagaattgcttgaacccagaaggcgaaggttgcagtgagccgagatcgcgccattgcactccagcctgggcaacagagtgaggctcggtctcaaaaaaataaaaaaagaaaagaaaagaaaacttcacacatactctctattgctttctccattttctggaagatatgagtctagcagttgacatacatcattcaagtgctggtgcatcagaagtccagcatgcagcgggaattggtttgcagcttgggctgctgtgtatcattccacgcccctttgaaattagtctagttgacttgttttgttattcagagtgtcaagtccaagagggacacctgaatatatttgcatttttacaacatgaagcaaaaatgacttttggatcaccattactttgatgtatgcattcactcaaataatgttactgagtaccgtgtcacaagccagccctgtactgggatctgggaatataatcctgatcaaaacagacatgctactgctctcttagagctctattaactgagtgctgtaacttctgacaacttgttgtagtagattatttgcaattgctataaaatcaaaaataataatggtagtactgacatgtatagatcactcattctatgctaggcaatatgctaagcacgtggtatcctttatccaatttctttcttccacgacccttaagaagtaagcatttatcatttatttcactgtattaactatgaatattaatattatgactgaagcatcaggaagttaagaaactcacccaaattcacaaagccagtaagtggtcgagctaagatgtaaaccgaagccgactatagtcttgcctgttcatagcgtatggtcttttagttgtcttgaggatttggcaagtttatggttgcaaatttagttctgagatttttgttttcattcttcctatgtttttctaaatgtaaaccctcatttacttatacatcttttaatagtctaccttcatgtttcaaacttcttgccttagttgagttcacgtcttccccgctgcatgattgtgaacatcttggcatccctcttagtgatattatttatttcccccatctggtcagagccttcatcttcctcccagcagtatgcccaggctctaatacctcagttgtttttctctgggaccttgaccctcctaagggattcgactgacactttagagttttaacttctcataatgactctggtataaacgtactctttaagccataaagcagtgaattgatttctcatatttggctacagcataatgtttatttaacccaatgtgctaagtaaatatcaagatatgaaagggttaaaaatcaagaaagccactactctcttcagtagtgttttgaaaaacttgggggaattctcacctaaggtgtgtgtgtaactgtatctattttattcacttagctttttatagagaatcagtgtattgattgtttttgtgaggcttttttgtgacctgttttacacggcattaatattctcttaccatatgccttcttcagtgtaggaaagtcaagctttaattaatgtttttgttttcttgctatttgtcttgatttcattaatttacatagcactccactcgctgaattttgattttttaaactgctttaggccaggcatggtgtctcatgcctgtaaccccaacagtttgggaggccgaggtgggtggataacctgaggtcaggagttagagaccagcctgaccaacatgaagaagccccgtctctactaaaaatgtaaaattagcaaggcatggtggtgtatgcctgtaatcccagctacttgggaggctaaggcaggagaatcgcctgaacctgggaggcggaggttgcggtgagccgagatcacgccactgcactccagcctgggcaacaagagtgaaactccatctcaccaaaaacgaaaaacaaaaacaaaacaaaaaactgctcattcttttccttttgtgtatcatccataacttttctatacatcttcaggctgaggtttcttggtgagtttttggtaagggatatgtttacagctgttatgtttaccataattagtgactctcacatatgccttttcctgatctttttcttccccaagtaagacaggatccaaatatacaagcaggctcatcctgcaagggatgcaactgataagatctgttaattatttgagggcatttattagtactttatggtacaatgggaatgttctttttcgccagatgactcagtgtctggcaataattttcaaataaaccaaaactattgatgccagtaatctaaaagttcagccacaatgaaaattggcttcattattcttcttcttcaccaatttaaactcaagatcataaaaccctgctacctaaaaaagcaaggaagctaacaaatgagtaaaatgttcttacagaagtaaaagtgtacagtgcaacagggaatgttagtgactatggaaaactagaaaacaacatgccccactaaaatattaatctgtgcccggctctactcctttgtgacaagtctcccagtctttttttttcaatctacaaactcctaattctctaggatttccataatgttaatgaataaaatttaaattggttttaaaagtaaaaataaagggcctgtataaagcaaaccaaaatggtctgcaggctagatgcagttcctagtccaccactttgtgacactttatttcaaatgtttgctttacaataaactattagtatattttaaaataggtagaagagaagaagtctaatatttctaccataaagataaacaaacatttaaggttctggatatcccaattatacagatttgatcttttcaaattatatgaatatgttaaattatcatatgtatccccaaaatatgtacatctattgtataaaaataaaaagtaattaaaaaaaataaggccaggcacagtggctcatgcctgtaatcccagcactttgggaggcaaagcgggcggaccacttaaggccaggagttcaacagcagtgtggccaacatggcgaaacccagtctctactaaaatacaaaaagtagctgggcatggtggtgcacgtctataatgtcagctgctcgggaggctgaggcatgagaatcacttgaacccggaaggcagaggttgcagtgagccgagatcgtactactgcactccagcctgggtgacagagccagactcaggaaggaaggaaggcaaggaagaaagaaatgataccgcatacacttagaccttagggcttttatactaactttcttttgtcaagaatgctcttgccttaaatgtccccaggacccaccgtctaaccttctttaaatctgtgctcaaatgtcacctaattggtgaggcttttcctgaacacagtaaatacattaaaatggcaatatttattttgaccaatatcttctatgctttttattgcttgatttctcctcaaagctctcatcaatatctgaataatgatatattttgctttcttcttcttcttttttttttttttttttttttttttttgtgagagagagtctggctctgctgcccaggctggagtgcaggggtgtgatctcggctcactgcaagctccacctatcgggtccacaccattctcctgcatcagcctcccgagtaagtcttccaagtagctgggactacaggcacatgccaccatgcctggctaatttttttgtatttttagtagagacggggtttcaccatgttagccaggatggtctcgatctcctgaccttgtgatctgcccacctcggcctcccagagtgctggaattacaggcgtgagccaccacgcccagccgctttcttctttttatacaaaataactttccctactagactgtaaggtttatttgggtagatatttctgtccttttagttcactgctgtattcccagcatccagaaaatgtctggcacatagtgcaattcaataaatatttttcaaatgaatgaatgctgcagcctggccagtcatgagagaaagagactagatctccagtttcaagctgtgctatagaccccgggtgctttgtagtcaccctgataccaactctatggactagcaatactatgatgctaatccatacatgtttttcaaaagtcgatgtaaatatctaaagtattaaaattggtctgtgtgccttgaagtctatatcttggtgcaacactgcctctcccatttcttattttattttatttttgttactgtttttttcttttttttttttttgagatggagtcttgctctgtcttccaggctgaagtgcagtggcacgatcttggctcactgcaacctccatctcccaggttcaagcgattctactgcctcagtctcctgaggatctgggattacaggtgcctaccaccacgcccagctagtttttgtatttctagtagagacggggttttgccatgtgggccaggctggtctcgaactcttaacctcaaatgatccacgtgccttgccttcccaaagtgctgggattataggcatgagccaccacaccaggtcacgcctcgcccatttctgactttaactatagctggggtagaactgttcccctgttgtatttttctgcctcaagtctttatctgagtcacaagcaaggagaactatgggaagttaaccccgtccttaggggcagccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatacatgctcacaaaccactgtgtagttatatctataaatattatctgggtcctgcaattagggagttttactctttttagtatttgcttgttttattattaaccagatgttgagcaagtcattgtacctaagattcagcttatacttctgtacaatgaaggagttgaacagatggttttagagtcctgttcaattccagtaatttacaattctatctgtacacatggtttgagaggaagatatgtatgccgatagggttagagctcagcctggaattctattcaactaatatgaaatttcacataggtcatatgctttaccatgtgctattgattctgttcacattggcagcatttgaaagaaagaagaaaatggctgctccatatgtttacgtgcagcaagaggcgtgaagacatttaaaactctctgtgaatgagcgcagaaatttatgcttgatacattctcagttgatcttggtttcaaggaggctaaatttattcccatctctgtggtgcagtttaccaacttcagcaattatctctttctgagaaagtgcatcctctccaaatgcaagcatttgttgatttgctcacaaaatctatgtcgttattatatctgcatctgggggcatgtagtggagaaagatcctgtataattcacaggagacatattctgaaatgggtgaatgttcacaaaaagtggagcaaggaagacccctggattgaatcatcaatcacaggatgtagcttgaatctatgatagacaaaaatatatacaaacctgcaatgagaacacatacaaagaatgctcattggtcttcagaaggcttttgaggctcaggaagtctcatcactaagactgaagtaggctgtctaaagtttgggcttattctagttctgagagcaaaaatacacaaaagaggaattcccagtatttgttaatgttgatgaaaggactccatgagcaccatttttctatctactcagaatatttcattaaagctcatgaccaacccagaaggatcctcccttttatccccaccaggatggagagcacacagtagttcatttcaaggcttgacctcactgcacagcaaggtataatatttcaattcccaagattctcacattttcccccagaataaacagagacacaggcaacagtcaaataattcacaattctacccatgtattaaacctagtactactctgttcttgcacaagtaacaaatattcaattaagaccaaaagagagctgagtgttagttttcatttagttactgcaaagcatagtcctgtattttattgtttctctttgtaagaaaatgacttgccggtgtatttacaatcatgctgaccgaagccaaagcctgggtttcctgtttgctctacgctctctcataactatggccataaaatgaagcccatgtggtagaaagacttagtcaagaagacagctaataactagattaaaaagcagtgactccattgatgaaagttaagaaaaaaaataggggaagtatacttagaaaataataaatagcaaatgcaaaacttcttttcaacataaatttaagtatttaagtccatagtgggaaaatgttaatcagtaatgaagatgttgaggtaaatagaggaactggcagcgattttatatccccataggcatggacatgtagtagcaagcacacaacccaaaagttattagaaatgttcaatttaagacctctcctgaagtaaaattgtgaatgggtccattagatatgctcagccatgctggatgtcttaactataagtaaaactcccttactgatagagtctagggcgtattgtatctagaaaaaaatggaagaactcttttgaatgaaacaatttaggaagacaggaaaaaaccagacaagtgaaaatccaattatgtgtacctaacgtcaacctgtgtgatcattctctgtttaaatgtgggatcagtgatgctgcctcaaagcttgaggatgacgggagcaggaacagtctggcagttggtatcatgccaaaaacaccagctggagacactgcagagctggcggttgagaatatggactccgaaattacatagataggtctgccacttatgagttgtgtgataaaggtacatcatctccctaggtcatgggtttctttttttttttatctgtaaaacaggcaaaataactgtatttacttctttaggctatctgtgaggattgagaacgtgcatatattctttgcacttagtgcagcatctgatactttgcaaacccactgattaatgagctattattcattgagtaatttaacatatgttgaaggttccaaatgtgggaactatgtttaacttagaactaagctatttaatatatatgttaaatgttaaatatatgttaatgtttatgttaaatgttaaatagcttagtttgaaggtaaacatagttcctgttatggcaatgataatgattatggtgacagtgatgttgacgatgatgttgccatattagtttcttagaacattagtttctggccattcttcagtggttgaaggtgttagaacagggtttacagcacatctggaccttatctatacaatggtgttacaataataaatacctatgcagaacaaatacctaaattggttaagcttgtatgtgtgtgtgtgtgtgtgtgtgtatgtacatacatgtgtatgtacatgtaattgtgggtagagcactcaggaaggtctgtcttagtacaggactaagtaacagttgttattaatatcagttaatatcaggactaagtatcagttgctattaatatcatcattagcagcagcaacaacagcaaaccagtggtgttggtgacagccagaacatttagggtctgtctcctggcagcaaggcagctaggacaagtgccaattagagacatccatctgggggcctggcagtggcagagagctgaggaggtgtctataatggtacttccagtagtttatcaagttgtaagaggatagggttccaaacagagtaggatccagtggttcaaaatgataactttgtaaatgcattttgcaacaacaactaacataaagaaaatagcacgtaaaagcccttaatgttactgtactggaatatgctgcagcacagactccattttccaccataatcttccattcctctccacacgcaaactccccttgctgattttaatcagatatttcacctgaatgaagaaactttgttggatgatgtagccccacttaataatgaccttaattcatttagtccttgtgagtctataaagtatttgcttaacagtctatttaagaaggctgttaggaattagagacaactgcaataataatagtaagagtaaaaagttattgggcatttatatgccagatacagcacctcagttttgtatgcactatcacccttaaactcaaaacaaccctctgggagaggtattatcctaagttcatagataaggggttacatgacctaccaataaaaccagagcttgtagaagtccaaggcagcatttaaatttaggtctgcccaggtccaaagcctgggcttttaattgtcatgctatgatgataactattgaaattgagtacctgtcttcataaagcttaccatcttgtaaaatactctgaaccaatggttaccaaaatttagttcatgaaccagcagcatcattgtcatctggcaacttattagaaatggggattttggggctcaggcccagacttacagaattggaatctctgcaggtggggttgtccttgttttaacaaggcctccaagggttgtgtttctcaatcttaccagcctgggtttctactccaagaagacaaggagagaggggaattatttctcagctaaagctataccttaagtactctgaggtcagaccagaatccatttagaatccactggtctgacctcagagactttaatatataaggggattctgatgcttaagaaaggttgagaaccacattaagcactcttgaaagacaagtaaggcagaaattatcagtatcccaattttacatatgagaatctgagagcacactaacatggtcaaggttatatggctgacataaacaaagctggactctagatgtattagtcatggttgactcaaagaataaggtaaatactgttttaacacatcccctttaagacaccttcatagaggagagaatgtcagagtcttgtatttagaaaaaacagtgaagaccagttttttttctcttgtaaagtttttccagagaacctgcaaattgcattgaccaaaacagaagtaatttgcacacaaatgttcataacagtattattcataatagccaaaaagtgggaacaatccaaatgtctatcaattgataaataagtaaaaaatgtggtagtcccatacagtggaatattattcagccataaaaaggaaggaagtactgatactacaacatggacaaactttgaagataccgtgctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagcggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcccaatctgtcttccactcctccgttatggagcttccctgttgtgtgttttatagtcatggaaggtggctgggattgggggcggcggggaggggcagtcactggtctcttaccaccaccctgcccagcaacaatgtgcaacttctttaattagagaaaaggaataaagcacaaaccttcctcagagagtgaactctctcatgttaattcacctgaggtgtgatattggattccaccccaagagcagggagacttaagacttctagagggcaaaggagggcagcctctgtggtgtgagagtgatcttgaagatgcaggataggcagtcacttcacctattttcaattttgtcctagattggcatccctaggaagcaggatatcttttcatttcctgccaaacctcctggtggccaaaattaaaaatccatattgagtcagtaattaaacttccccctacctgagggttatgtcccagaccaatgctttaaaaagagttctgatacaaaaaaaaaaaaaagcagtttaatggagaaagactatctgaagaaagaatgatgtcaaatagatttaaaacgtatgaatgcagcaatatatatgttgcttgggctgcataagtaaaaagagacaaaaatcaatctaaactccccagtttcaactatattgtttccacatgcgtgacatctataccagaaaaaaactaacaaaactagaaatgcattcctcttggaatggaaacaaatgtcaaaacaaacaactcaggataaacttgagctagagaagaaagctttgctctactcttttctaaggagctttgaagatctggccatggttgacataacaactcattgcagcagatatgttacttcaacagggagcatttcacagattgtcaaagttgtcttctcatcccatccaacctatcttgggggagggtgagaaaaccgaagagcaaaaagattaattcatttgcccaagttcacatggctaagtgctttcagatactgggaatgtttgatttacttgaatcaaaatagtgagaatgtcttcctgaattatacttgataatggttttctagttacattataacatgtctaagctctatataaatgaaaatgaattttattaagagtgttttagtatttgattggctttgtcaaaagatttcagatagtggttttggggaacttggtgaatgcccatgcagtttttgatacagtggcaaagaatatttgtagaagatatgactttttaaactctagaacttataattcctcagaaaatatttacgcattctttatttattaatttatgaatgaaataactgttcattcatttaataacaatttgttaaacacctatattattgggtactgatagatgttgggtgtaccgagatatctgtgatttagtccatgaatttaaggagtttataatcttgtgggctgacacaatttgtttcaaactctgttctgccagatttaagtgagaaatccaggcaaaatacaatgtttctgtcaatgaaccatattgttacagtatcagaagctactgccttggtacagcccacagtggataagatcatggtcctggggctgagaaaaatctgggttcaaaacctacctgtaattatagttgctcagtgtatgagcttgaggaaattgcttaattctctgagaaaacatttaaaatagcccagtaactgccctatagtcagcacttaataataatgtctattgtagtcatttattaataacaaaaggccatggcctcctctctttatcgctgagctccaatgcaagtaaaacacttccatctactttaccttcaatgggtcctaacttgcatagtaggaataaagaaaaaaggaaaattgtgggagtaggagggaaagagagaatgccatgagccgcatgccttctggcctttctgtcattttccaggtatctattcttccaagtaggagggtcaaaagtgattgtgtttagttttgttgtaaagttgaccaagaacggaataggtctgccgggcacagtggctcgtgcctgtaattccagcactttgtgaggctgaggcgggcggatcacctgaggccaggagatcgagaacagcctgaccaacatggcgaaaccccatctctactaaaaatacaaaaattagcaaggcatgatggcaggtgcttgtagtcccagctcctcaggaggctgagaatcacttgaattcaggaggtggaggttgcagtgagctgagatcgtgccactgtactccagcctggatgacaaaagcaaaactccgtctcaaaaaaaaaaaaaaaaaaaaaaaagaataaaaaaaagggaacaggtcacaatttccctcactatcaaataattgtttgcatttaaggggaaggaggaagaaaacaagcttgatgcctattttgtttaattatattattctcagggtaaaactgtatcttgttctctacagtggtaggtaggtaggtagatacgaagtaggaaggtaggtaggtaggtaggtagatagatagatagatagatagatagacagaaaaaaatgtatataagcacttttttctgtatttttaccaagtctgttgggcaatctgttgatatttgaactagataattttaaaaacagaggaaaatactacatcactcacctaatattttgtcattaactacaaataattattattttaactgatgtttttacatcaaaacatgacttaaaagtcctaagcaaatttttcactactgatgatggtaatgattaaaaagtcaggaaacaacaggtgctggagaggatgtggagaaatagaaacacttttacactgttggtgggactgtaaactagttcaaccattgtggaagtcagagtggcgattcctcagggatctagaactagaaataccatttgacccagccatccccttactgggcatatacccaagggattataaatcatgctgctataaagacacatgcacacgtatgtttattgcggcactattcacaatagcaaagacttggaaccaacccaaatgtccatcagtgatagactggattaagaaaacgtggcacatgtacaccatggaatactatgcagccataaaaaatgatgagttcatgtcctttgtagggacatggatgaagctggaaaccatcattctgagcaaactatcgcatggacaaaaaaccaaacactgcatgttcttactcataggtgggagttgaacaatgagaacacatggacacaggaaggggaacatcacacaccggggcctgttgtggggtggggggaggggtagggatagcattaggagatacacctaatgttaaatgacacgttaatgggtgcagcacaccaacatggcacacgtatacatatgtaacaaacctgcacattgtgcacacgtaccctaaaacttaaagtataataaaaaaaaaaaagaaaagtaacccaatacagagggggagaaaaaaaaaaaagctaatgaggctagctaggctcagtgtttctaggaatgatgtaactagaaccatgtgacttttatcatatatttcatcaatgaagataataaatgcttaaacaagataattaccatcctccttcctctctgttaaatgcttcaaatacattatataatttatactgggctcagagtagccctaatatggctaatattggtacctctgtacctctgtattatagatggggcaactaaattgggtcaagtaagtggctgaaggtcacacaagcatggcctccccagaaccagatacttcccacctactttgtcctagtcaaccttagcttccgaccttactgtgttccttccagtgcaacattctccatttttgttgttgttgtttgttgttgttgttttgtttgttcatttgtttgtttttgagacggagtcttgctcttattgcccaggctggggtaaaatggcacaatatcggctcactgcaacttctgcctcccacgttcaagcgattctcctgcctcagcctccagaggagctgggatgacaggcacccaccaccacacctggctagtttttgtatttttagtagagatgggatttcaccatgttggccaggcttgtctcgaacccctgatctcgtgatctgcccgcctcagcctcccaaagtgctgggattacaggcgtgagccaccgcctgcacccctccaccaacactcttctttttatagtccctgtgcggaaactcaaaccatttgtcccctgtcccagtgcctcttcagtctagtccttcaatagcttcctcctcagttactgatttgctacatgactatggagacaaccagattaaactgtgtagatgtcatttcccattgctttatttctgtaactgcaaccacactgtagtgatttctgctttccctcaagaagacaactgtcctccaacacccaacattttatctctgaattgttaccttatttactctgcagcccctacagtagcagtcattatgtctcctcctgacctactctggtatgttctttctcccttcctccttccctcctttgatttttcagtctaattatatcttagcttagaatataaacttttagctaatgaaattttcttcaaacatgccttcaaaccccagctgttcatttccctctgagttaaaatgagtaaagttttgattatgtttgtttaaaattcactaggctaatatatccatatattgaatgtattccatatacattatcttctgtacttctttaaaggcaaatgtgaaattctctaacaaagtctttcctataaaaaaatatgacacaccactctcaggggaattatgataattcaaagaacaaaccaaaccaaattaaactcacatcttttctgagcaaaagagtaaataataaaaatgcagaagtattgtttgttagggtcaacagcttttgctagaacctgatgtgatattctgtatagaattttgttgggaagttatgaagtactgataagacaggcaaatattatttgcacacaaatgatccttgcaaaataaaaattttcaagtggagataaattcttccttatcctctttagttcttcagcagggttcttggataccgtctttgggaatgctcttctctccaatgttgtgatatttacatgaaaactttggttttaatgtaatatttatctaactagatataaccagacttgaaggtgattctctagatttcttgtacctcccttatgatttcagctatgcgctcgattcagttgaatttaagaagattatcaatggcatttcataattgtttatggatttcatattatttaaacttgctctccagttcagtaaataaattttagaggaaatcaatattatgaattttttttcagttattagaaattgcttttgagttttagtctttttctttctttcttttttttcttggtgtaattgtaatagaaacccaaggagtctagaactgtacttgctaccttctggttttgtgactttgatcaaatcactctgcctctcaggatttcagactctgcacaagtaaagagtgagatggagcacaagtgagctttctaggtcagcgtttcccaaaattttatcatctatttttgtccaatctctacgctccctgtattattattctctttaattttttattaattatgttttttttttacttgaaggaactttatcacagcagtatcacttgttataagtaaaaagtagccgtaaagataaagacaacagaaacaaatgtattaaagcctggcacgtcctcagaagactctgctcctgagccttgatagttcaccacaagtataagactgtcatgtgtcagagagattttaaagacatgctggcaccaagtgagactttatttttagtttaatcagaagaactcaaagagaattaagtgaaagaggagtgacttattcttaagtgagttaggttttgtttgtttgtttgtttgttttttgagacagagcctcgcactattgtctgggctggagtgcagtggtgtgatctcggctcactgcaacctctgcctcccaggttcaagctattctcctgcctcagcctccaagtagctgggattataggctctcaccaccatgcccaactaattttttgtacttttagtagagacggggttttactatgttggccagactggtcttgaatgcttgacctcgtgatccactcgcctcggcctcccaaagtgctaggattacaggtgtgagccaccacgcctggccatgagttagtacttttttagtgcctgatctctgtacaatccaaaaattatctcccattccagtgttgtgcatcttgcgtttttagaaatgctaatgtaaagaggaagcatcttccagctctaaaaaaaaaaaaaaaaaaaaaagtggatgctgtaatgccccaatgtaataatatattctggcaacagtgatccagatgaatcatatttttgtgtgtgatcagtttttctttctacatttttcatataggtaaatatttgttgtgtattttaactcatgtactaggtaaaagttgatgtaaatcaatttggggctaagatgtaataatactgttgcctttatggtttaatttaatgatgttgaaaagctttctaagtagtaaaactatagctcattttattccttgcctctccccatccataatagcatgcaatgagtgacataaaggggccagattaacccctgaactgcagccctagaacagcgatggcctggcatagaaagttattgtgactggagatcctttaatcaccagagtattttgacagagtgctgagtagttgcggcattagtagtaggagatttgacacagaaaccattcttaaagtcttggggagcccagttggctcttaaaaacacaacttggaattcctttagtttcagtgccttatttttacctttctttgaagtgcctttttgttcactgatctgttaaaagtgcaatcttgtttctgtttttagccatccattgctattaccataataagcccagtgtttcaaacatgtgtgtcttagagtataattcttccttactcaagactactcaagccattccttccctcccacaaagatgatatctgaattgtgcaggcattggaagaatgcaagtgtcattctcaacttttttttcacctccataaaataaaaacaaacatttatgacctcatgcaaactttttgggtcaggaatttgggagcagcttagctggatggttctgattcaggaaattatactccagtatcagctggggctgcggttgctgaaggtttgactgcggctagagcacccactttcaagttggctcagtcacatatgtgactggcaggctcatgccaggtgttgacggtaggcctctcttctgtaccgcatggagctccctatggctgcttgagtgtcctcgtgacatggcctgtggcttccctcagcagatgatccagagagaaagcaagaggaagccaagtggcttgttgcagaagtcacagttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatcttggctcactgtaacctacgcctcctgggttcaagcaattctcatgcctcagcctccccagtagctgggattacagacacatgccatcacgtccagctaatttttgtattttgtgtagagacggggtttcaccatgttggccaggctggtctcaaactcctaacctcaagtgatctgcctgcctcgcacttttctgcttgggtggcttactgttacacataggataaaatttagagatcttttcaaggcatataatgtcttacatgagttggttcctgctgccttctctaacctcatctcatacaactccctctgagctcactagaaattctaatcttcttttccattactaaatcatgtcaaccgcttcctaactcagggccttcatacctgcgatttactttctcttttgaatggtctttccccttcctccttgcctgtctatgcctagctttatactgtagatttctgcttaaatacctctccagcagaaaaacttttcctgataaaacttagatagcactgtatcatttgttttctcttttattaaaaaaaaaagctgtattgaagtataattgacatgcaataaactataaaaattaaggtatacactttgatacattttgtcataggcatataactgtgaaatcatcatcaatattcgaaataatgcatcactccaggaggtccctttgtggaggatccttgttattttccaagttggaaacagtgcctagaccatcacaatatttcttacaatttataattgctaattgctttcatctcagtttgtagtaactcgcttgtgcatctcaccatctagactggagctccatttgaagagaaaatgtgtctgtagagttcattgctacatctccatgatcacattgtccagatgttcaataaatttttgaatatatgaataattgtttgtattataagctgataaagtcccttaaagaaatacaagtcaagtgcttagatacttttgatgtagtctgccctttgaagaactagtagatttgtgacttttttttttttttttttttttttttttttgagacggagtctcgctctgtcgcccaggctggagtgcagtggcgggatctcggctcactgcaagctccgcctcccgggttcacgccattctccggcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaatcattgaaaggtttttatttttttatttatttttattttttgaggcagggtctcgttctgtgagaccaggctggagtaagtagtgcaatcatagctcactgaaacctcaaactcctgggctcaaggcatccccctccctcagcctccctagtatgctgggactacaggtgcatgccaacacacctggctagttttttaaaattttttgtacagatgaggtttcactttgtttcccaggcgcatctcaaaatcctggcctcgagcagtcctccctccccagcctctgaaagtgttggacttagaggcatgagccactgtgcccggccttcattaaaggttttcagcttggccctgactttttattgtcttggctttgcctcaggacaattaatatggcactgatacataagaaaacatatgaatatcttcgagacctgtactttacctatctgcatgatttatatcattgcaaataaggaagaaaagttaggaaaagacaaatataattcaaagtgtttaagttttctgaaactagagggttggtgatatggtttggttctgtgtccccacccaaatctcatcttgtagctcccataattcccacatgttgtgggacgtaccgggtaagagatgattgaatcatggggatgggtctttcccattgctgttctcatgatagtgaatgggtctcatgagatctgatggttttaaaaacgggagtttctctgcacaaactctctctttttgcctgccaacatccatgtaagacagaactttgtgcctcctttccttccgccatgattgtgaggcctccccagacacgtagaactgtaagtccattaaacctctctcttttgtaaattgccccatcttgggcatgtcttcatcagcagtgtgaaaactgacaaatacagttagtttaaccactctctggagtgttctattcatgggttggtaacaaataaaccatttataatttaaagttttcacagccttagaaatgctcacatagatgttaggaaatagttttggtatacaacaaaacagaacctttgtgcacatttatttttgtattatattgtactgagggtttctaatcaggtgaagagaaaagcagtgtcagaatgggaagtctgaatttgaattggatatgtttaagcaaattgtctctttaccagccctacctaatttgagaatacataacacccactcagctctccctgaactcacatgttggattttcccaactaattttaatacacacagataaaaagaccagatatttggtctatacattttctgaatgtatggaaacatctatttatgtaacaagcataatattatagctgaaattgaaatcatttttgtattttggtggttgttgactggctaatagctaataagtcaatgtcaggatagcgaaatcccacatgtattcaaatatttaactccaataaataacatttgttcattcagcacctactaaatgaatctacctctgttaaccttcgcaattatcggataggtagatacattgagattatccctgcttagtagatgagaaaactggtggttaggtataattttcccatggtaatgccacttaccagtagcagagttgcaattgaaacttggatttgtggcctctgaaatgatcaagtaatagttattgatttttaagttcatgtaatgacaactatttgtttgatcttggaatcaggactgagtatttttgatagaaaggaataagtcatattttggatgggcagatgaagatcttataagaatgttactgccacagcttatacctaaacatgttgaaaatattttagggaagagaatgtatatgttgatggatttgtgttagctgcttttggattcaatgattaaagccagttttgccttatagctaaaagtatctgataaaaaactaatcacttgtcataaagaagagaagtggaggctatgtcatcattaccatcaccatctgaagtcgtcaaatatattgcatttcctgtgatgtcccagttagttccaagcagttatatttatataaaatcatatatttcagtaaatattggagctttgtaagaataacattattttaacataaataggtgttttcagacagtctcattatttgtgtattccaaatatgtagtaccttgaagaccttgacttatttgagaacagcatgaaaatttgcctgcctgaaaatctattggcgtatattcaagatacgttttacaagcaggagattattttgggagcataattcatcactttgcttacatagttgttggctctttgtctggcatttgattggagagctacattttcttggagtaatgttgaacacaattttggagaaactggtttttttttgacaatttgaaatgttactgattaagatcccttgaggccaattctatacacaaagtacatatttatccattgattccatgaaaacataaaaattctttccatttagtaaatagataatttggtacaggattatttgccctggagtaactggttaaccagggtataataaaatggatcttttttttttttttttttttgagacagagtcttgctttgtcagccaggctgtagtgcagtggcacgatctcggctcactgcaacctccctctcccaggctcaagcaattctcctgcctcagcctcccgagtagctgggtttacaggcatgtgccaccacacccggctaatatttatgttttttttggtagagacggggtttcaccatgttggccaggctggtcttgaactcctgacctcagaatcggccagccttggcctcccaaagtgctgggattacaggcatgagccaccgcactggccaacaaaatggatcttgaagagttccttcacattagatcagaagaaatgtgtatgtgtgtttgtttgtgtgtgtgtgtctgtacctcctgtaattgtcatgtgtatatgtttgcatttagagtagttttttcttattcattttcaaaaataaataatcaattttgcattatttcttgcctctgatcccaatctattagtggaaagaagtgagattcaaccataattggaaaagtcatcaccttttaaaagaagtaacattggtcacattagtcccaattccatctcacattgggtatgtgaccagccttgaaccaggtgaaatatagaaatacagaacttcagatatgatccaagctatacattagtgggaacagtacatcccttgatagtgacactattctatttgaatgtcttaaggttccattgacatgcttttattagctccttcaaaatgttggctaatattacacaattgactgagtatttctgatgcatcctttctgttaataccaaatgccaataaatttcatggtaaaataatttgatattggcattttaaagatattatccttagttttcatgccagttagatcccatctgagtctgcatgtattaatagacttcaggaaaaattccacaatgtcacatatcatgcatggcctagagaaaaggctttattgggaaatttacatatgtcaagatttaacaatgagaagagaagccaggggtcctataatcttccacatcccacctaaaggtgtggcaggacctggctgccttgatcctgcagtgtggctctgtgttcctagcaagggtccgttctcttcagtagcctaccttgtcaatgaaggataagtggaccccttggctccaggcccccagagaccctcaggcgctgtgggatactaaagtatcccttgtgtggaggtggaagcccctggttgtatgataagctgagcttgggtgtagcccctcctactgggagaaggtaggatatccctggctgtagttgtcatattgtccagagttcagagagtgagtatccagcgttattttgagtcagtcctgctcatttaaacttacaacagtagatctgcatgatccccaaacacgcaggtataaaaattttctcaaagttgaccacctgttagacaatctcatcatttagtggaaacctcactgtaatcgccatgaggattatgtatcatcatctgttgtatgtgggtggcattgcactagtactggataaaacaagtgaagctatcatggtttttctcttctaagagtttattagatgacatcattctcaaagtctaaattttgtgaataaaaaataacactatagcatgtgcctttacatgaaggtttaattaaaagcaatgaatgaatacatatgcttcaacattaatctcactgaatatatttttaagaatcctgcagtttgactgtagataggatgaaatgttaaaaatagaccctaaacccaccttgatttatgtatttacttggagagaaacaggtgagggaagcatattgaatcataacctaattcctacaaacattgatttacacacaaattaatttactaaacaaattatagtttatacatttatacattaagcatatttatttaatttaaacatactagtaaaatggacatcggttgtcctccaaattctttgtgttttcatttagataaagatgataatgttgacaataatctgaagcttaataacagaaatagcaatcatgtgttgaatatttattctggtggtagtaaggaatcaatccatatatatttacacatctataaccatacacatatgcatacatatataatagataatatatatttatgcacattttgtattttttttcatttaatctgcacaccatcccttaggagtaacttatttttatgaatgcttctcagataaatggagaattagggaagtgcaatcatttgcccctgttcactctactagtggaagcaggatttgaatctaggcgatttgactctaaaggtccatgctctttatcactattcaatactgcagatgtaaattataaggccattctatccatgtaattttaatacaataaatgctatgtgctgagtgttttttaaagattaaaatttgaatctgcagtaaactggctacttatcttattgtcaaccacatctttttcggtactgtgtccaggacacagttagatattaagtaaaaacatccctggtcattttttttttaaatttgagtttctctggcttctgcacatagcccatataaactcagaaacccgttatttggagatttcactgaatgaaataccataagctttgtagtgggaaggggttgtaagaccaggtcacccaaacttagtttgcaaatgctgcagcagctactcttagcagccactgtcctttccatagcatttccaaggcacctgcattcttttgcagctactactacccaccacacctcttccttagcagttccatagccaagatttcagagattgttatgaaaatcacattgaggccagtacttcgttagaaatttaataaggactacaacattgggttgcaaaggaaggggtaatgcctcttctactaccatttgtagtttgtcctctaggttcagcattaacaatttttatgaagtattaggagctttcaagggcctttggcagggagcaccttatgcctcaatgaaggagccttaagcaaagttaataaaaatgcgaaagtattgtgtcttgacataaggctcctgagtcgtaatgttgataatcttcagcatagagctctagcaacatgatgcatctggtgtctgtaacccagctgttccccaggaaaggtgcagaattgagaatcatcagcctgaaggcatgcataaaagacagcacctgagaagtggtgctgtgtgcctatggaagagcccagtcagaggagtacagacttcaactgaaccatcccccagtatagagatgcgcacacgtcaggggagcataaatgagaaaactggactttctcaagcctgaggtgttggataatgacctgacagcgttctcactagtcccataaaacagcctatgtttgttcccatctaatcatgtgactagaatgtaggagagtacttctaaaagtaaacacatttgaacaatctgtatgtaggaggaagaaagtactgtattaaaattgtcagtttttcttcttatttttccttacctaatgaactttttggcatctatcagtttctaaccaggcagctgctgaaatttttattcatgccttggtttcctcaagaattgatttttgtaattcttttttgcagccttcccttaccgggctattttgaggttgcagcacactgtgaattcagcaggtgcttcaagcctggcagcatcttattgcctttcttccgacttcctttagtgacctccagtatcaaacatgattgctcttccaattttaatttctacttgctgtggtaccgaacaacctcgttagtcctatcactgagcccagttggcaatgttgggaggtctgagtagttccacactccgtaaattgcagtggtattagcaagtacaattgcatactcttaatcatcttgcccttattatatgagaagtttctggtgtattttaagggagaaaatgctttagagagtaaagagggaaaaaatcaaagcaaactctccctctcaatattctaatcacgaaggactggaattttcaagaaccaatttcaatttgatgcttcaatatagaattgaatttagggtgtatgtgagtgagtgtgtatttttgcacacattcacatatatatatttttaatatggtacttgaactgcaataaagccagtactctttccttgattttatgtagaccacttttacatcataattcaaaaatataaggaaacttatgtagccgtaatagaaattcagtagaattagaaagtaaaagcaacaaaatataaagggctgccagcagctaagccttcgcaaatcagttcagttagttgatgtgtttatttgtgcatgtagagccattgtatttgtacaaatgtccctccaacatatatacatgaaaggggtattaaagatccactctcttggttttgtggctgaacaaattgcctcaagctcttactaatggtaataacttttcctatttaaagggcattttcaaatgggagaagattgttattttttacttttttaaaaataatttctgatctaaggaaaataagctaacatctatacaacagaatacattattggtaataactgacatatgttgagtattgtgtgctcaacatatatagcttggtgtataccttatagatcattaaaaatagcaacactgtaggtaagactgggaaaatgtatgttgtttatttcagagattagcgtgtatccacatgtagggaccatggagtgtagagttggaggttcggccaaagccctcctgggccactccttggcaatgttactagttgtaggttccattctatcacagttttaaggatgatgaaactgaggcttatagaatttaagtgatttctcaagatcatagagctggtaaatggtgaagaaagaatttaaaactagtatatctgaatccagaatctgagctgttgactaacatgtagcattgccatctccaatccttggggatttatttttcacagggcctaaatgtgtggaccttttattctgatgcctttttcttcattctttttgtttgcttaaactaaaccttcttttgaactataaaggtgatggtgagtaacaagtcccatgtgtgattttattgtacacagtcagaagacagaagacactcagacagcccatctgctcagagtgtggcttacatcagtttctgtattacggctatcttttgtagaatgatttgtagcctttatcaaacttctcttggttaaaagtttgtaatggcagagaatccctagctaaacagtcagagaaagtaattccttagaggaaattacatcagcattattcattattgcattagagagtgtatttttgtcaattctctagcagagatcaagttcctgagggaattagatggagaaagaagcattgggtatgaattggatgaggttttatgttgcctgaagcttgagttacttattagcaagagtccaaaacatcttctttattgaagtttggagctatctgttcctcaagtgacaaaaatgttcaaccttcatttggggattctaccccaactctattttggtttatggaattcttctttttttttttttttttttttttttttgccaaaacattctttatttggtcaataaagggcagaagttttggattcttaaacattcagtatttttttaaatttagtccagggtttattcaaataccattttgccccaaactactctctcctctctttctggggctctaattatatgattgttagaccttggagggcagcttagattttttttatactttaagttctagggtacatgtgtacaacctgcaggtttgttacatttgtatacacacgccatgttgtgtgctgcacccattaactcgtcatttacattaggtatgtctcctaatactgttccttcccctcccgcaccccacaacaggccccggtgtgtgatgtcccccttcctgtgtccaagtgttctcattgttcaattcccacctatgagtgagaacatgcggtgtttggttttctgtccttgtgatagtttgctcagaatgatggtttccagcttcatccatgtccctgcaaaggacatgaactcatcattttctatggctgcatagtattccatggtgtctatgtgccacattttcttaatccagtgtatcattgatggacatttgggttgattccaagtctttgctattgtgaatagtgccacaataaacatacgtgtgcatgtgtctttatagcagcatgatttatagtcctttgggtatatacccagtaatgggatggctgggtcaaacggtatttctagttctagatccttgaggaatctccacactgtcttccacaatggttgaactagtttacagtcccaccaacagtgtaaaagtgttcctatttctccacatcctctccagcacctgtcgtttcctggctttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatattcattgcccactttttgatggggttgttgtattttttcttgtaaatttgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtctattttggcttttgttgccattgcttttggtgttttagtcataaagtccttgcccatgcctatgttctgaatggtattgcctaggttttcttctagcatttttatggttttaggcctaaaatttaagtcgttaatccatcttgaattaatttttgtataaggtgtaaggaagggatccagtttcagctttctacatatgggtagccagttttctcagaacctttattaaatagggaatcctttcctcattccttgtttttgtcaggtttgtcaaagatcggatggttatagatgtgtggtattatttctgagggctctgttctgttctgttccattggtctatatctctgttttggtaccagtaccatgctgttttggttactgtagccttgaagtatagtttgaagtcaggtagcgtgatgcctcccgctttgttcttttggcttaggattgccttggcaatgcgggctctattttggttccatctgaactttaaagtagttttttccaattctgtgaagaaagtcagcatcatcctgataccaaagcctggcagagacacaacaaaaaaagagaattttagaccaaaatccctgatgaacattgatgcaaaaattctcaataaaatactggcaaactgaatccagcagcacatcaaaaagcttatccaccaagatcaagttggcttcatccctgggatgcaaggctgattcaacatacgcaaatcaataaacgtaatccatcatataaacagaaccaatgacaaaaaccacatgattatctcagtagatgcagaaaaggccttcaacaaaattcaacagctcttcatactgaaaactctcaataaactaggtattgatggaacgtatctcaaaataataagagctatttatgacaaacccacagccaatatcatactaagtgggcaaaaactggaagcattccctttgaaaactggcacaagacagggatgccctctctcaccactcctattcaacatagggttgaaagttctggccagggcaatcaggcaggagaaagaaataaagggtattcaattaggaaaagatgtagtcaaattgtccctgtttgcagatgacatgattgtatatttagaaaaccccatcatctcagccccaaatctctttaagctgatgaagaacttcagcaaaatctcaggatacaacatgaatgtgcaaaaatcacaagcattcctatacaccaataacagacagagagccaaatcatcagtgaactcccattcacaattgcttcaaagagaataaaatacctaggaatccaacttacaagggatgtgaaggacctcttcaaggagaactacaaaacactgctcaacaaaataaaagaggacacaaacaactggaagaacattccatgctcatggataggaagaatcaatatcatgaaaatggccatactgtccaaggtaatttatagattcaatgtcatccccatcaagctaccaatggtttatggaattcttatgtatagatagcttcagttcacccaaggattacaagcattatatggtaataatacatgaagaagcagagaaaactaaagtacaggttgtcttccttagcaagtacaacctttgcccactgaatgtgctttcttaagtctcagctttgagaaaaagcaaggcttaagtaaggggggttccagtgagcagacattagagtatttcctattgtattaaggcaactgaatgaactgtttgaaagtttaactctcagggtggcttaggtggcttagtaaatacaattatgagaggaaatgttttcttcacttacttgactgtaatttgttgttaagatatattttgaaattgttgagtattttctcatttttctgtgcctctcaattttctgccaaaaaaaaaaatttctgagaattttgtttttttcatttaggatggaacaaagttgctgttactctatgtgattagggaatgatgttttaggtgaattaaataataaatgatttttcccatatgccaaacatggaagactaatgagatttgaaatgcagcgtatttcttgatattgaaaatatacaacatgaaattttttctttgattcagaaggtactttaggatgtcctagtgtgggaaaatcattagaaattgtcagtctcttgtaacattatggaagtcctggtttatcggtatttttctgtggtgagagaagcaggtaatcaaatctttacagaaacaaaatcctacagaaaataatgctggcagtctgctgattaaagtgtctgaataaaatggattaggtaaataaaaagaatgagcatataagtagaagaaattgtagtttctaaatattaaattcagaaagttttgattaatgacttacgtttcatgtcatatggcttaaagattttttgccttatttcttatccttgaaaacaaagtgaagtgcatatgagagctccggtggaataaaaacagcccgttatgggctggtctattacttcttcaacaaagctctatctactgtcatggggcagcttagtatgacagaaagaaaacagatgtgtgtttcagctcttctgcttaatagctttgtgaatcagccaggatatacaacatggtgtagttgtgctacagtagaaaccctttctgaaatttccctggcacagtactgcacgtgtgtatgtttgactcacagcgcattatccaaggtgaattggcagagggcctctgcccacgggtcattcagagacctgggctgatggaggctttctgtcaatgcctgcttcaaacaccgtggagagtggaaagggaaatgtggcaaatcatacaggctcttaacatttctacttggaagtgagatgtaatttctgtcacatttcatctgccagagtaagacacatagtcaaagaaaaagaaagtaggattctaccatatatccagagagatatcactaatgacaaccacaccatgtgtttttgtataaatctcttagtgtgtctgagcttcattatgctaatctgttattttttttaaaaagtggaggatttccctgacttgatgcctcttcctgtgaccctcctctgaacttttgtgtatcctagtcaccagaggaaagatgttttttcatttattcaacaaataattttcagctccttctatgtaaggtaccagctaggctttggagacgttgcagaaaacaaaaataggtaaggctgatctcccagttcttatgttcagttggattgacaatcagcaaaatagatacatatctatgtaatatttcagttggtaaaaagtgctaagaggaagaataaagtagggcagatttgttccaaggaaaacttaagaaaaggggggaaataatatatgaatatcagtaggtgaaggtttctagatgatagaagaggaaatgcagagccctaagcaggattctgctaggcattttttaaactactttattgaggtatgatttacatataaaaagctgtacatatttaagagatacaacttgatgtgtctagagataagaatacacccatgaaaccatcatcacaatcaatgccataaacttattcatcacctccataagttttctcctgcccccttgttgttgtttttattttgttttgatttcctcttatagtaagagccaataaaggaaatataagatctaccctcttagtacctttttaagtaaatagtacagtattgttaatcatatgctctatattgtaggggagatctccagaacttattaatattttgcataactgttctgctaggctttttaaacatttatttagagacagaatcttactctgtcacccaggctagagttcagtagtgtcatcatagttcacggcagcctcgaactgctgagctcaagtgatccttccacctcagctcccaagtgctaggactccaggcatgcacaccatgcctgtctaatattttattttcttagggacaagttcttgctatgttgacaaggctggttttgaactcctggtctaaagtgttcccgagttgggattacaggcgtgagccaccatgcccagctctctgctaaacattttgagaagcagagagaccaggatatctggagtgcagtgagtgaagacagtgttaggaggtgggagaaggggatcagagagaaggcaacatggcagatcatgcagggagagccctgtagcaaggtaaagactttggattttttttctggatgagctgggaagcattgtagggttttagacaaaggggtgtcttgatatgatctaaattttctctggcttctctgtggagaataatctatagggtggcagtgatggaagcaggagcacagctgggcagctattgcagcaatcgatgtaagataaggatggcttagacccaagtggtggaggtagagattgggagacatgccagattctggatgcattttgaaggtggagctatcagatttgtgaatggattgaatgagagatatgagtttaccacagtaattattactatatagatgccattcatttataccacaaaaccaaccgatgtcctgtcaggtgctagtgctgttccacagttggggttacagcagttgggttttcatgatgttgaattctagttaaagaagacaaatgataaataattcgaataataattttaatatgataatagtcagtagttagtgctagaaagaaaatttaatcaaggggatgtgaatgatgtaagtggctacgttggacaggcaaggccttggggagctaaggcctgagccaagaggactgagatgtgaagtgatgggggaagcaggggaatttggtggggcagcactcgaggcagacacacatgtagtgcaaggatcctaaggcttgggtaataggggaagatatgtcattgcagtttaaatatcgaatggggggacaaagtggttctgtattgatagggaggtcagtatggaccagatcacactgggcttggcaggacagggaagaattttagattgtcgtgattccttggcaataagaagttattgtaaggtttcaaacggagaacaatataacctaatttgtctttgacacagggaggagaacaacatacactggggcctgtggtagggcaggggtcgagggggagggagagcatcaggaaaaacagctaacgcatgctcagcttaatactcaggtgataggttgataggtgcagcaaaccattatggcacacgtttacctatgtaacaaacctgcacatcctgcacatgtatcccggaacttaaaataaaataaaataactcacagtgactgatgggcggataatgggttttaagaggactttgacaacgaaaccatttaggaagctattgtgttatgactaattccatatgcttttcttatctgaacacaataagttgacattagttttgtttttaaagtgaaataaatatttgcccctccatgctcctacccctgcttgttcgtcagcattcttagggaatgaaatgatccacagaagacttcccaaatagctgtggtttccctctttaaggtctgtgtctttaaaagcacatggtccatttcagtgaaagtttttctgaatatttaatacatacttaccatttaaatggaagatagtaagtaaaacctaaacttttcctttgcctcatggcagtattggtgttggttaaaaatgataacttcagagacttcagatctccagacccatgagctttacagatgctagctctattctttttccattggctcctgactgtgatgtccttgtgcttcgcttccacagtctcctatccccaggtttttaggacacatttaatcttctttcttgatacagtgctacttctcttgttgagtatttgatggacttggtgactgttacattcttccaaggccacctttttttggcatctggttcaaactatgtctgtttttgctagaaactgtcacgtgaataaaggaaagagtagaaattattgtagtcatattgcagagcaatttgaacattccactgaagttgaatatgtgctacctacaatctagccatgataattctagatatatgccctagaaaagcaggtgcatatacacaagaagacacattactgggatgttcaccaaggcatcatttgtaatagcaaaatggtagaagcaacctaactgtccatacaaaaagggaatgaataaataatctgtttattcatataatggaatattgcataataaagtaactgaattaaagctgtatgtatcaataagaataactgcaaaaatgtaaagtgaaaataaaaaatttcaaaaggatataaaaacgtaatgtaatgctctttatatatattttagaaataccaaaataatacgtgtgtatatacatatgcatccacacacacacacacataactaatggctaatacagtataaaaacatggtaatgatacataaacctttcagaaaacttcagtgaataaaagcaggtagaagagagaaaggaggacctagttgaatctgccctttttaaatgctatgttaaaaaatagatacatatgtttttaaccaatctgtacaatgttcttacctattatgtctggcttttgattatgtagggtatcaatttatgattttttccatacgatagaaatatttaataatttaaaatatcatataataaaaacgtgtcttttatagttcttcctacaagctgtatttgatcacttctgtggttttatgggtggctcataacatctagtcacatcataaaattcttttttccttgtgattggctgaatcatctttaggcgtgatgcttaatttagacgtttaggttaactcttcaataaaatcacaggaatttattgtaagatctaaccaagggactgaaataaattgaatgtagtgaaatttgaggcattgtttcagccaccttaaagaccacatgatctactgatacagttgttaaatccactcagataaacatgtgtgctccaagttggagaaatctgaggcagagaaaaagaattgtcccaggtgcccaagtccacttatatgaacaacttgaattgaacactgttaatattaggctcttttgccaggagtggtggcatgcacctgcagccccagctactcaggaggctgaggtggggggatcactagagcccaggaatttgaagctgcagtgaactatgattattccactgcactacagcctgggcaacatagtgagacgctgtctgtttaaaaaagaaagaaagaaagaaaagaaaccctaggctcttcttcccctctccccagacaaagtctgctgcagtgatctcggcttactacaacctctgcctcatgggttctcatgggtttaagcaattttcctgcctcagcttcctgagtagctggtattacaggcacgtgccaccatgcctggctaattttttctctttttagtagacatggggtttcaccgtgttggccaggctgatctcgaactcctgacctcgtgatccaccagcctcggcctggcctcccagagtcctggaattacaggcatgagcaactgcactttgccccttggctctttttaaaaaatgcatttgtttgagagtaatgaatagaaaaggaagttgtggcatgaactatctgattcttcttttcttccactactgggagatttcataggccaaatattctctctagtcaggggcatgcctgatgatgcttacagtctataaagagtctggtcttgttctcctttcatcttctctggagaaaggataatcaacaacagaaattttttaaaaaccctcatactttagacaagtcacattcagccactctgtggaaacactgatttttctacgaggctttcttagagaataaatattaacacatatgcttcatgggctgatagatattgctgtggtttcaatgtgtcctctacagaatttgtgttgaaatgtaatctgcattgtggagatattaagcagtgtggccttttggaaagttattaagtcacgaaggatgtgccctcgtgaatggattagcaccttagaaaggggctggaggaaactagcttaggaccctttgcccttctgccttcaccatgtgaggacacggtattcaaggtgccaccttggaagcagtgagtgggccctcaccagacctcaaatttgccggcacctttatcctggacttcccagcctccataactgtgagaaataaattcatgttgtttataaattacccagcttcaggtattttgttatagcagcaggaatggactaagagagatttaatatggaatcccaaacaatgaaacaactatttgtacttctaaaatataggtagttctcaaaagcattatgttcagtaggatagctctctaacttatctctaaagttaattaaacattatggctgaaaaatgagttttagtttcctctctttgaacttctataaagaaaatatacctttgagacttgaaaagttcagtgctatgaaacgtctttctagggtagtttgggtagcaccaaagtcacctataattaaaattacatattttccattttaaaaattccattttataattttcaaataaattttttactatcaataaagaggtattttttgatttgtgcaactttatatgtagcacttggtttcattaaacaaatgtcattgatttcattagcataaaactttattttcttcaccttaattttgaatacaattaccaaataaaagtagcttttatctttgtccctttgaggttagagatgatatcttcttgatttctctgtctctcccgagcacagtgcccgcacatggtaggtaattaactgtctgttgactggttaaattatctgtattacaagtaaatacaaaatgccaggttttacaaaacactcattccatattgtctatcactcccactctattttatttttcaccatagtataagttaagatattattaaaatattattaagatcatctggggaagtttgctcacttccattcttgaaattattataatctcctcttaagaaaaaactcaaaatgtgtaagagcatctctgatagcttggttcttatttgtataatgggataattttatttcttcagttgccatcctgcaaacactttttctaagtctttaggaacctctgtttttaaattgcttttgcttcatgtgataaactttaagcccgtggccttctaaaatgattcagtcagtcagttctgacatctcttcatctcttcttggtagcaccctcgccatttctgcaacgatttccactgagtcgcatttcagcctgtgtagaaactcatgatgacgtgttgttttataatactttacactttgtgtattttgccattatgggggtgggttaatgtgttataaatgtacaaatgcttgttatcacagtaaattctaggtagagaacagaccatggaaatgttgttttaatttgtgttagtttgagaaaattaataggtatctcatatgacttataccagaaaatttaaaaactataaacatacagccaagcaagaaggcagtcattatgagtattttcagagtgtattgtctgagaatacggtggcgttttccattgctaaaaagaaatgcacagttttccactagtaacttgggagaaatattttttcaggtatacaatgcagggagttacttgacctaaaatgggtacttaaatttcattgattgtttaaagataagtaaataattttcccttttttgccagagttgttttcatgtaacgatacgatacatcttataacaatacttccattataacatgctttatatgtattatctcatttgattcaggtgatgactattttcaatagatattgttgctgtctccattttacagatgttataggcaaagttaaaggtgtgtaggcaagttacattgattcaaagtgatggacttcaaactctttgcctctattttgttggaacattcattaaatcatatagcacctgctatgagtggagactttcaactcataaagaccagaacatttaggggacaaaagtactcacagcacctggaaccaaaaaaaaaaaaaaagaaagaaagaaagaaacaaaaacaaaaaacctgttaaaaatttcttcatcacagacaagactctttcaagggtactgatagccatgggacagagggaaggacaggtaaagttgatgggccaaggagagtaacatcaccttcctcagcctaagctgcaggattataggaaaagctaagtagcctctgggtgatagtacctgcttgggagagccgttgtgtgaattcactttgtaaggtccaaaaataaatgtgacttagatacgttcacaccattcctctctttcccttttttcctgggttacctgctgtccacctagctttgactattgccaatacccaatgcatggatggaatacagtgagaaggaacctgcaagtgtcaatggaggcagaggcagagaacaaggatgagaacaacaaattttaaagaagctgtcttgaacatttggggaatagaggttggtgaggagactagccaagatgttttgtctctctgttgtataacagagtgccctgtggcatctcttatacaggtggctatacagtttttaatcacttttttaaatgttggatgagtatttcttttgattgcaataaacttatggtgagacacactactaggtggcccagttttattcaggatatgtaggagatggagctttataaagctgcattcatgaagattcttacaaaatattctcaggtggtaacattttaatgggtaaaaataacacatgctttcaaagaaaaatctattattcaacttaatataaccagttttatatatacatataatacacacacacacacacacacacacacacacacaacagacagagatactttttgacttacaatagggttacatcccgataaacccatcataagttaaaaatatagtaagtcaaaaattacatttaatacagctaacgaaaccaaatgtcgcagcttagcccagcctaacttaaacataatgagatcacttacctagcctacattggtcaaaatcatctaacataaagcctattttataataaagtgctgaatacctcatgtagtttattgaatactgtacagaaacttaaaaacaaaatggttgtatgggtatttgaagtacaatttttactgaatgtgtattgttttgggggaccgtgtgtatatgtgtgtgtgcgtgtgaattggaacacacacagttgcttttgcagcagttttgaagtcaagatacaacatatactaatattggtttcacaaggtaaaggccattattatccctatgagaattcagtgaggaagatactgcttttagctgggtagaatgaggtagataaaatatattttgattatttgaattaggagtttcatgtgatgagctgcattgctacatatcttatttcttactctttaaagaaaccaacaagcttttcatgtctctattacagaataaaatagagtaatatgccaacatatagacatttaattttgtcaaatccaactatgcaaacttaaaatgaaaggaaataggaggatataacaacttaaatggcatcagcaatttctcacactgtttcaccccaagagtgttagccttagtgaccttgagacagaagaagtgaatcacttagtagatctctttttattgtatgcatgactagaggaagcatcttagggtgctgcatgtgagcattacgtttaagaacacaatgttgtagaagtatttcttgtatattgtgccaggggctttgtctgcttatcagtggtgcaatacatcatccgtgaactaagattttcattttatcattaatttgttatcctgagagtggcaacttagttttacttaagatagcttccgtagttctaagcacacgtggagactccctgttcagaagaaaaagttctatgtatttccatgtattttattaatgatgacaccttttcctaaagtctcccccaaactgtttcttctcgcttctcattagcaaaaatgacatcacatagccaaaccaattcctggcaaggaaaaggatatcatgatcatttacttagatcaaccgtgattcaaccatagacttgtggatgggcccatcttctatgatgcacatggccagtcaaaggaaaattttggattccagtagaaaaaaaagaaaagagattaaatattgattaggtaggtgctgcaacatatttgttcattaatgtactgtaaagcactatttgtatttcacatttatacattcatattactttataagatggtatacataagaccatgtatattgtactttttgggcaatataaggactttttgtagggctaattttgactccaatttttgctatatgatcagagttacactataattcatgaaaaagacaagactcaactctaatatcaatattagccttagtttaccagttatcactatcggatgtgtcataagcatttgtttttaaggttgaatagagaacctgattgggtgctataaaagtctgatcaacagcttaaatgtttgtttgtttgtctttcttaaggaaaatgagcattgagtttctttctgttccacattgaataaacctcaccaaatctatccctacattcagatactcagtccacaaatactgagtaccttctatgtgctgaccgctgttctaaccctcgtggatacagtaatgaatgagatagataaagtactttttctcaaagagctaacattctattgtgagaaaaaaatagaataatcagagaagtcaacaaaaacaaaaaatgtgagatactgaagagcatgtgagagcaggccagtgggtaactactttaggggtcaaggaagtcctctctgaggaagcagagtttaagctgaaatctaaatgacaacaaggagccaccatggaaacaccagagaagtatattctaagcattggaaatagctggtgcaaagaccctcaggtgggaataagcttgaaatgtagccagcaagtgggaaagaggaagatgaggtcagagaggtatgcgaagactagatcatgtgagattatgtaatccaggtgaaaaggattgattttgattctgaatataatggcaagtcattggaaagatccacttgatcaaaaagtgacaaggtaacatactggataaggtatgggaacagtatcatagggaaacaattgaagtacaattaggctgttgtccaggtgagaggtgacggtggggaagaccaaactggtgtagtgaaatgtacaaaaattgaacagattcaggatgtttgggagataggatggaagaagtgaggaaatgagagaacggggtgaactttcaaacttctggcttgagctacggcatagacgatgaatttttctcagagatgtgtaggaagcaggttcactgaggagagagagcaggcagaattgagagttttgttttggtcctattgaaatagagatgcctgtcagacatccttgtagagatgccagataaacagttggatacatcagcctggagttccaggaagagactaggcctggagataagagatttggtagtcatctgcatataaaaaagcaaagaagtgcccacacagttattttaattaattccacagagccttctaaagtataatttggagaactgaaaattgatgggtacttatttattgaaacatttgtcttgaaaatttgttgacaacacaattgctgagaaattaattgatagttcatgacaagcagtgacggctcatttcctcaaagtttccctaaaagacaaagaaagttttatgttattagctttggcttgctttgaaaatttgtttttgcacatcactgttttgggttagcaataaaattctctgcatttgcttcataaatcaaacaaggacacaattgttaaatagtctgtatcatattaattaggctctgaaacaaagcaagcattacagccatttataacagggtattgcataagttgctaatcaatgagaaaagcaactaattaacaagcaaccagtcagcattttgagcagaagttggtgactttcagcttaattaaaccttgcaggtgtcagtgatgatatgaaagaatctttaatctgtttgtgttgaaattcccccagatcattttcacatctgtacatgtttaaagcccctatctactttcatgtaggtaaagggaattcagtgtcttaaaacagttcacatttttaaaagccctattcttaattaaatcattaagatttctcctggattaagacagtggaatgaagttcatcatctatttcactctaaaaaaaaacttagagggctaagcagctttattgaagtataatttatataccctaaagtatacttgtttcaagggtaaaatttaatgattttaagtaaatgtatagagttgtgcaattatttccagagtataattagaataaaggaaattttaaagtttggacaaatttatccatgaggtatcaaaattagcttgtgagggaggctagatatacctagcctttaggaatgacctataaaagcactgatacatctttccttctagccttcaagtgtttccaaccatctgctacagctaccatcaaaaacaggattctaaatgggatgaatcaaggattaagagtaatctattccttaaataacttttaaaataccataaattcctctttaattacagtagattatttggcaaaattaagaatactagttcctcaggctgccttttttttttttttaacattaagttccggtatacatgtgcagaatgtgcagtttgttacataggtatatgtgtgccatggtgccttgctgcacctattgatccgtcatctagctgccctcccctaaccccccatccccccaacaggcccagtgtgtgttgttcccctccctgtgtccatgtgttctcattgttcaactcccacttatgagtgagaacatgcggtatttggttttctgttcttgtgtcagtttgctgaggatgatgctttccagcttcatccatgatctcattcctttttatggctgcatagtattccatggtgtatatgtaccacattttctttttccagtctatcattgttggtcattcaggttagtttcatgtctttgctgttgtgaatagtgctgaaataaacatacatgtgcatatgtctttatagtagaatgatttatattcctttgggtatatacccagtaatgggattgctgggtcaaatggcatttctagttctagatccttgaggaatcgccacactgtcttccacaatggttgaactcatttacatttccaccaacagtataaaagcattcctatttctccatagtgtcaccagcgtctattgtttcttgactttttaataatcgccattctgactgtcatgagatggtctaagaaaaaagaacaaagctggaggcatcgtgctccctgacttcgaactatactacaaagctacagtaacgaaaacagcatggtactggtagcaaaacagacatatagaccaatggaacagaacagagacctcagaaataacacccaacatctacaaccatttgatcttcaacaaacctgacaaaaacaagcaatggggaaaggatctcctattcaataaatggtgctgggaaaactggctagccatacgcagaaaactgaaactgaaccccctccttacaccttatacgaaaattaactcaagcgggattaaaggcttaagtgtaaaaaccaacaccatcaaagccctggaagaaaacctgggcaataccattcaggacacgggcacgggcaaagacttcatgacgtcaatgccaaaagcaacggcaacaaaagccaaaattgacaaatgggatctaattaaactaaagagcttctgcacagcaaaataaactatcatcagagtgaataggcaacctacagaacgggagaaaatttttgcaatctacccatgtgacaaaggcctaatattcagcatctacaaggaacttgaacaaattttcaagaaaaaaacaaccccatcaaaaagtgagcaaaggatatgaacagacacttctcaaaagaagacatttatgtagccaagaaacatatgaaaaacagctcaacatcactgatctttagagaaatgcctttttttttttttttttttgagacagagtcttgcactgttgcccaggctggagtgcagtgacatgatcttggctcactgcaacctccacctcccgggttcaagtgattctcctgcctcagcctcccaagtagctgggaatacaggcacacgccaccatgaccagctaatttttttgtacttttagtacagacggagtttcacaatgttggccatgatggtcttgatctcttgacctagtgatccgcctgtctcggcctcccaaagtgctgggattacaggtgtgagccactggtggccgacccgagaaatgccctttttttaaagggatagttctctcatggctaattcaaggaatacaaggattctttcataatgataatgtctctatttcttctcggttataatctctgtgcaagatgatgtcattttcaaaaagttggaaatgggcaaacacttgtatttgagatttaaataagtatgcatataaaaaatatttgtcatattgagcacattacaacaattatttcaaatttccaagagatggatgatgatttgttgaatggaagtagaaaatattaagtaaaatagcagccatcactttctatgtgccagaaactgttctgagcactatccacacacttaggacagtgccttaaacactgtatatgtagtagttagaacagatacatgtttacatgtaatatgggataggtatgggggaatggataatgcttagaaccatcctggcacatagaaagtgatggaaaacagttcttagaacaattcctgggacatagaaagtgttgtaaaaattaaatgtgggtatatatatatatggaatatgcatgtatatgtgtataaataatatatgtatatgtgtgtatgtatgtataatatgtgtatatgtgtaaatatgtgtgtatgtacatatatcattatacattttgtatatatacatgtttacgtatacacatattattacaaatgtttgctctatataaataagctatatgtgggatatccaatataaatatctattctataagattgttgtaaaaagtaaatgagcatccatatgtacatgtatatacacactcacttcatttttacaacaacctatgaaataggtatattgatcctattccagaaactaagaaactgagcctcataaattaaacagtttgctcaaggtgccccaaatagtagcacagcggggataattaacacagaaagtcaggctctggagtcattgctcttatttaatcagtatctcctactggaaattttgattatcaatattgttcatatcatatggcttcaattgtttatcattagtgaaacctacaatgtttcattcagtgttccaatctaataaaacaatttgtgtctgctctgacatacttctcttaaaaatgtcaggtattttcagacacattggcaacctggtattgtggaaggagtggtaagtttggaatctggagacttaggttagaagtgatagatcttccaacagatcattgcagagactgggaaattatttaggctcaccaaaccagttatctgtaaaatacaggatatgttccttgaccttatacctctctgttgtgccttcataataatgagacagtagcacttatattgcctgagagtttctgtttacttgagtatctcttcataaagtgtaagttctttaagggcagggaccctgtcttttttactttgtgtcttcagcatcctttaggctactccctgtcgtctcagaagcacatactaaataagtgcagaagcaaactataaaagaagagaaaatatcatgattcccaaaacagttttcatcaggatcaaatgtaaatgaaattccgttcctgggctcttgctaccagctggcctatgactaaaacaccaggctggtgctgcttctagtagcaatagacattgactgaaaggcatggaagcaacctagaaattgcattgattgtaaatattttcaaatgaatatcttgaagaatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtcttttcatttgcctgacgaagaacatgagggaacaagcactttttccttgaaatgttttttgtactgatcagatctgctaataacgcaacatagacagactaccaggaatgcaactgcttatatcctctctgttcacaaaacattgcagtgcatttgttgtgccttcattttcctcatcagaactcagagctcatgactttaacccttttcagttttggaatcagttgtttctaagataggggctatgctttgtttctgtacctggtacttttttcccctggcataaatgaaaatatctcttcaaatatgtacccaagtagtagtaatatactctgtcccagtccctggagagctgtacaaactggaggtaagccagtcattcatttgattatattaagattcaatgtttaaaagcaggacaatgccataccatatgaaatcatattttacttctcacttactttagctcagttactttggtgatgcagaaagtggttttgaatttaagataggcattcaggctggaggcaggggctcacacctgtaatctcagcacttgaggaagctgaggtaggtggattgcctgagcacacgagttcaagaccagcctgggcaacacagcaaaaccctgtatctatgaaaatacaaaaaataagccaggcatggtggcatgtgcctgtagtcccagctacatgggaggctaaggtaggaggatcacctgagcccagcaggttgaggctgcagtcagccatgatcgtgccactgtgctccagcctggggaacagagggagaccctgtatccaaaaatatatatatatatttattaagggtccatagaaatctaggttatagaataggttatatcataaaatattagcctcataccttcattctactcataaaagacttagctgtataaaataaatattgccacaggttgagtttaatgctttctaattgcttggctttcagtgaagaatctctttacacaagaatgtccttgtgtgcggaataaatcggactttagaaaatctgaaaacctcatttacacagaaatatgcacatccctggactctatacagcccccctcctgtgtaattattcttcctttgacacaaagcactctaattccagaatgcctgtgttaaaaattaaagttggttaggtgtgatttttcctttcggatcctcttctggacattgaacaaaaggagactatacatttaaaagacacaaacctaaacatgaagtaagaaagacttgaaatttggctctagaaagtacatatttgaggctgagtaggttattttaactcaccaaatcttaatttcatcctttgtaaaatgaaatgatgaaaataatacttgccttataagcttgtctggaaagttgacttagacaggtcctgcaaaaatcttggcatgttcgtggacacatagaaagttctcagttaacgttaagcaccccctgttctcgcgtcttcctcctcaccttctcatcgctgatgtatatgaaagtataacatgcagcaagggaactagactgagtctgcctcaacacattctggaaggaagtattctgttctgcctatgctcctttccacaagttttattctaatcgtcagatgtgttctacttcatctgagtaattgtttgtgataacacctggagaggtcttaacttttgtatcttataaaaacaccaaacaccacatgttctcactcataagtgggagttgaacaatgagaacacatggtcacaggtcacagtaaggggaatgtcacacaccggggcctgtcggggggtggggggctagtggagggatagcattaggagaaatacctaatgtagatgaccggttgatgggtgcagcaaaccaccatggcacgtgtatacctatgtaacaaacctgcacgttctgcacatgtaccccagaacttaaagtataataaaaaaattaaaaataaaacaccaaaatattaagtggggagtgacttaatgaaccccatggaatgagaacgaaatacaatgtatatgcatttaacttgtacagttgtaagcagcatttttcagtgggctgtgatattaattccatttcacaaaagaatttgtgagactctcaagcaggtatggccaagagaatgatcctcattctgatttagcttctcagaagattgatgttctctctgggatcttttgtgtgtccagcatggtacttgcagcagaccattatgtgctgtcatgctgcttcttgatatccagactcggtgtgctctgcagaactgcagcctcgctacatgtttcagtgcaggaaattcacattaagggatccttttccagagagattgctcaggcaatttcagttccatctctgttttaaatgttggaaaacaccccctttctctcagtctacccttgctctgcatgcctatcttttgctttgctgtttctagattctgcgtttggttatgtatcctgtactcactatggcagtaggaggagatttaatatttattaccttttggtgggaagaataacttccagatgaaagtccagctgaaaacatagtctcctttggacaagaatataaagacttcagtctgccagagtagcattactagacacctggctgcaggaaatgtgatgttacttttttgacatctctgctcactgcaacttctgccacccgggttccagtgattctcgtgcctcaactccccaagcagttgggattacaagtgtgtgccaccacgcccagctaattttttgtatttttagtagagatgggttggacaggctggtctcgaactcctgacctcagcccacctcggcctcccagagcttgctgggattacaggtgtgagccaccacgctcagctggacaagcaagttttgaagcagaggagttgtctgcaaaatctggaatatgggggcagttatggagaaataataattagtactgttcattgaatgttttaatgtttgccagaccttttgagttcttcatatacattatcttagcctacctaaagcaaccatgtaaggatgtgtgttaatatatccatttacagatgaagtaatggaaactcagataagtagatatttcatgcaagatcacgcagctggtgtggaaaagctgagatctgagactggtgcactctgactcaaaagccagcactcttagggattagatttccttgtgtgaaaaataggtcatatgagaatgatggaagcatatagctacttttctttttcaccaaatactaattctgcatatacacataataaagtagtttttctgtagctatcaaggacttacctgaaaaggaaagggtgacatcagaaatccatgctgtgttgtgggggcatatttactctcaccttaataaatgctgcaaagcattatagaaaactacttccctgctcatggtaatatgacaaaatcctttcatcttcacgtttttcaaaagtgatattctggtgggcctgcaaatagtaaatattagcttcttgaaagatcctttatggagactaatttttttttttttcatttttattctcatggtttttttccctgattttctaccctcttgttttgcccattcatggtccatatatttttgtcattttaactcctcatcctgaagcacagcaatcatttctgagttttatggatcaccgcacagatattctggtggtaggcgattaatccttatccaaccacacagcagttttacctaggctttgggatgatatttagctgttactgtggagcttcctactggaatctagagaacagaggggcaggggaggtcagaggataggtaaacataaatcaggtttgtgcaaacaagcatgatgaatgctagttcccaaagtgctctgccttttgtcaaacttatatattaggagagagggttgtgtggcatgaatgatgaatcataaaactgctctctctggtgaaagggcaagcatagaaaccactgtagtaacacggtagcttggatgcatcatagggcttgggaatacagagtggaaaacagtaatatgtgtatcagcctgaatgaaacagtaaggagaacagagcagagtgtcccctgactaggaaatccagatcagtcaaaaggaagtgagtttggagaagcaaaacaagatacagtacgtcagggtttcttaaccaggcctcacacatagaaaaaaacaaaacaaaacaaaaaaaccctgtctgttcatttaccatttactgaaatttagctgtttcttcaattattaatgagataatcatggaattttgatcagctacagtggctttaccactaccagaagtaactgattgatttcttcatatatatctcaaaatattgtttatgccattcactactttgaaatttcagtagctattacattcaccactagaaacatatattttattacaaaatttaaaaatacttttaaaattgttcttcagtataaattgttgtctttgtaattctgtgtatgttattttatgcactagaaaatactatcctgaaaaagcattcataggtttcaccagtacactaaaagggtccaggaaagaaacaaaaagtgtgaactcttatggtcgatatgctgtttttaatgttaggtgagattcagctttttaagaatttaatttttagaaagcttgagagagaaaaatttctactttgatatattcagtacaatatattttgccacaagtcagcatctaccatgaataaaaattaatttggggactaatgccttaccttctacttgtcaaccttgcaacctgcctgtcaacatgagaccatggcaagcttttcagattaatcagtgctaattcagctcccatttcctttacttgtattatacagataaagtttgcaatgagattaagagtcttggctcttaattggaatttctgattctttttttttttttttttttttcgaggctgagtctcaccctgtctcccaggctggagtgcagagaagtgatctcggcacactgcaacctccgcctcccgggttcaagcaattcccttgcctcagcttccccaatagctgggactataggcgcatactaccactcccagctaatttttgtatttttttagtagagacaggatttcaccccattggccaggctggtctcgaactcctggcctcaatgatccacccacctcggcctcctagagtgctgggattacaggcatgagccactgggcctggcctctgattcttaattttagctgtactacttaattatatatgtgaaactagatatattattttatctccctaagcctcagtttactcataatgtgagtaataatagtagctaccttatagggatgtggtgaaggctaaatgcaataaagagaacttaaaacagtaaaaatacatagtaagagcttaatccataattgccagtattgttttcagtacatactgtaatcgtgcttaataagaattgtaacccactgccatcttcatcctccaaaaaggtagtgggtctctaaaaatccatgcacacctcccacaacgccacaagagcagacttctgggaccctggacatcttgggacctcttcataggatggcttgtatattctattctaaaactatttgcattaaatattaggtcaatatacaagaatacttacaaagtatacctaaggtataaagaataactatgtaacagatacttaatgacagtttaagccaattatcatttaccattagctctgaaatttccagaatgctcctctgtgataccagtctcttccctcccaagtgtaaccatgatcctgaaatttgtgtttattattccactacttttatggttttgccacatgtatctcccaatataaactttgagtgaatagagttacgttgaaacttgtgacttgcttctttcactcagcttaagttcctgagattcatccatgctgctataactagatctgtttatcttattttcacttttccatcattatttgtgaattggtattctataatttgctatccacttactattgatatcctctctttttttgctattatcattaatttctgctatgaatattgttaaatatgtctcctgctgcgcctgattctaacaagtagagttgactcatgaggtatttatatcctcagcttcacgagataacactaaattgtttttcaaacaatttttgttgttacatttgttctaccagtatcgaattgttcctgttctttcacattctggacaacacttgacagtgtcagacttttgcctgtttgacaatttgttgagtttgaaatgatatctcaatattttaatttgcaattagacgtctccttatttggagaagttctgtgtattctgggcactatcttttgccagttctcttgagttgcacacgtattctcccagttgcttgctggccttttcactcttatttggagtcctttgatagagcagaagctcttaatattaacatagttgagcccattaagttttttctttatgattgtactttgtgtcttctatcttaaaaatccacaatctaaggccgaggtgggcggatcatgaggtcaggagatcgagaccatcctggctaacacggtgaaaccccatctctactaaaaatacgaaaaaaaaattagccaggcgtggtggtgggcacctgtagtcccagctactcgggaggctgaggcaggagaatggcgggaacccaggaggtggagcttgcagtgagccgagatcgcgccaccgcactccagcctgggcgacagagcaagactctatctcaaaaaaaaaacaacaaaaaacaaacaaaatccacaatctatttttcatatgggtaaaaaggactaaataaaatccccttatatcatttaagagggaaaataattacccaagaggagaggaaagaattggattggcttggaagtggttatttttacattttttcatctgtagctacactgtgggtagaaaaatagaaaaattacttgtgataacccagattacttagcatctttagataataaaagtttactcttactgtggcattcacctctaatttaacttcatgagtctgttttcttagtcaactgtactagatgctagagatacaaaaattgttacgaggaggaagcaagcgtctaggcctccacatctggatagccattctcacatttaccacatcacagggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagctgccatttttcttagacaagttgactcttttttcttgaatccactgaccttagggtagcagtaaactttgtttaccaacagggctctgtcatccacatgagggatgttgccattaagtgtctttttttttttttttttttttgagatggaatctcactctgtcgcccaggctggagtgtagtagcgcaatctcggctcactgcaagctccgcctcctgggttcaggccattctcctgcttcagcctcccgagtagttgggaatacaggtgcccgccaccacgcctggctaattttttgtatttttagtagagacggggtttcaccgtgttagccaggatggtctcgatctcctgaccttgtgatctgcccgcctcggcctcccaaagtgctgggattacaggcgtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtcaccccttccattgtaagccgtttttcctcccgcattaccttataaaccacaaatgcctggaggagcctcagcatattaagacagttttgatcggtaccccttttagcagaagttattttttcagctgctttccaaagtaacagatgagagggaatttgaccttgtgaaagcaattgtgaggcagccaggtaggaggtgccgcaggaacactgagcagcaggggcaggaggccgtagctgtgtgtgtgtgagctggagtaggacaccttaagggaaatggctttagggatcaactttgctgttccacagtgctgtgaccttgggcaagagaaaagtctttaacaggtttgatttatgagaatattttctactctcgatagaatgcagtggatatctgatgcagttttgtgccatctaagtgactactgagagaagatttccaaatttctctgattgccatcagtagggagtgatgaagtgggattttcttttctagttgcctttatccgtgtcggtgaaatgagaacaaagctctctattctctcaatttagaaagaaatcagatctgaatctccaaaatcagttgaacatccttcaaccagtagttccgtgtctgatgtgtagacagtggtaactgccatactgaaagaaatgtagtcttgtgataattcagaactggacgtaaccaaaaaagtggtttttaatcacaaaattattttctggattgtaacaatttggaactggatataacccaaaagggtttttttgtttgttttttactcatgatataatttgtctgagaaaagcttccccagttgtgtggcaaataggttaggaggcctatttgagtaaaaatccaactgctgttacagtggaccttcagaataatttaatttggtcaattgtccatagctgtagtgaaattttgtcttaagaagcggtatctgaaaggaacttatgttacagactgaatgtcccccctcaaattgaagccttaacccccaaatgtgactatgaggtcataagggtgtggcaccaatccaacaggattgccgtctttataataaggggaaggaacatcagggagacatacacagaaaaggccctgtggggacacaaagagaaggtggccatctgcaagccaagaagagagccctcaccagaaaccaatcctgttggcacctcagtcttggacttacagcctccagaactgtgagaaaataaatttctgttgtttcagcaacccactagctggaattgtgtcacggcagcctgagcagactaatgcagcatctaattttaaaaaaatacttttcaaatattcaattttcccaagtccggtgatcaccacttggtttctgaatttgattttctattttctagtgaagaattttaccctgttccttcccgttctaggttcacagactgacttctggtccttgctgggggtgctgccagccttggaggctggtgagttgactttataagaaaatagaaaagcctaagttacagcaccagctttcttagttttccacagttcatggttctcctgtaggccactaatattcctgatacatctctctagcttttgtcataatcaaaatcggttgactgtataatacgtggtgcctgcttgcactgatgctgtgttattctgtttgtttgtttgttttctaaaggggaatcttgtagattactagagagttcatgatactctggtatcagttatgccacaaactagtattaatccatggacatttcccgccagcccaacctgccgcagaaactcaatttgagggttttctctatgtttctcgttaatataactttcatcctctgctaagttatcatttctctttacctggagccagaaaagtaggaccctgagccgaatctgcctctctacctgcttttgtaaatgaagtttcattggaacacacaaccatattcattggtttatgtgttatctatgactgttatcacacaacaacagcagcattgagaagttgtaaaggagcaaaaaaagacacagaaccatctgaagtctttgtgcagtggctcatgcctgtaatctcagcactttgggaggccaaggctggcggatcacttgaggtcaggagttcaagaccagcctggccaacatggtgaaaccccatctgtgccaaaaaatacaacaaaaattagccaggcatgggggtacacaactgtagtcccaactactcgggaggctgaggtgggagaattgcttgaacctgggaggcagaggttgcagtgagccaagatcctgccactgcactccagcctgggcgacagattgagaccctgtctcaaaacaaagaatctgagcctaaaatatttacaatctgtatatctatcttactaaaacatatacttaaggaaaaagtttgctgactattgctttacgttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagtcagttgaccaagttataaaagttctctttcattcccatgagatctcaatctatattggtggaggtgggagtagtaatattataaggcaaaatctctcatctgttctccagaaattaagtcttaacaatgttttctaagagcaatagccctgatgcagtgcttaatgctttatttccatatttgttatttctgactgctagaaagcaaaggtcactaggtcaggaaattagcttaagggggaaaaaggaaagtagttactcttaaggttaaaatccatatagtatgatgggttattgtgatgaatatttagttttgaaagacttcatttattatgtaatagccatatgcagttaacagaatgcttctgttagtgaacctcacaaatgatttagtaacccccagagattagctggatgttcatatgtagtagaagaagaaagcaaatttgacattaaaaacaacacataatgcaatgaaaacaaaataccccttaagagttaccatgtactatacaagacccaccagtcatccccagtaccattcagagcatgagattgattcagtcatgtccaccatctggttctataccggttttcaagtcccaatgatcatagttttgataatgtaccaggtaccatattaagggcttcatatgtaaataattttaaagtttttttttttaatttgaagaaacagaagtcaggttaacaaatatgccttaggtaaagtaaaattcaaaccaagtaagtaagagttcaaagtttatgcagtattaaaaatcatttctggccaggcatgatgactcacacctgtaatcccagagcttcagaaggccaagatgggaaaatcacttaaacccaagagttcaagaccagcttgggcaacatagggagaccgtatctctacaaaaaaaaaaaaacaaaaaaaaacaacaactaaaaaattagctggacatggtggcgtgcacctgtaatcctacctacttagcaggctgagtgagaggatcgcttgagcaaaggagttcagggctgttgtgagccatgattgcactactgcacttcaccctgggggacagagcaagaccctgtctcaaaatacacatacgcacacacacacacacacacacgtgtgtgtatgtatgtatgtatatatatatataaactttgtttatgtctctcctgatctgtaatctcttaaaagacagagactgtatttttctaattgtttaattcccctagtgctcatctggtacattttctacctagtgcagtcgtatcttatttagagtctcatttctaaaaactgtgcatagacaaaattggttttcaaaaccttttaggtaaagcccatgttggagactgacatatgacatttcggtaaacccaacacttctgattttcttcataacactggaaaaatatggctgtttttcagttgagcattagataaaggacttttcctatcctcaggggtcatgttgtacgtaaaatatattctttcatacaccagaattacactcaacatgacattgagaggcatgaagagatcaagacttactcaaagagttgcacatttatgtctctcttctcatgctcactgtggggcatagtattgacattgagagaaccctgaacagtattatccttgagcctcttagggcgtgatttaactcacataagttaaattcaccaatggtgccaaaatattgtaccaaatagagataaagacctcacattcctttagcacttactatatgccagccacattgaatgaactctgcacttaataattctcatgacactgcacaaggtatatgtcatcactgtctttgtgttatgagtgatgaagctcaggtgtgcctcagaaaagctgagtaaattccccagggttgccctgccagtgaatgccaaaatcaggatttaaagacctcaaatgcttttaactatctagctttgcattttccttaagaaatgttgattgaaaaattacaagtaatagtatatataatttatattttgtatatataatttatatatacatttatataatatctatttataacatatataaattatatatacaatctaaggttgtacactatctgcctttcgcttcaagttgatttttataaatagtcttctccatgttgtttctatattccaaagaattatttaaggtagtaaaatcatcagccatttgtaaataggagtccagtcatgcaaaccttagctatagccccacgaaggctacaacagctgggagcactgttcacataaaacacaacataaatgatgcccccacccaggatgcagaacaatcactgcccttgcctgctagctaggcactggattcatcaagaacattttaggaacagataaactcctaaaactctttatcacacttcattagttacattcagtgctatgcgtccaaattctgctcctgtacatgtttaataaacagagatgtctacacattgtctgattgtaaattgtgaggatttcagcatggtggactttgggtccataaacacataggcttctcacgtttatacagaaagtcaagcttgatttggggcttaaatccattgtgaaaatgcagtagatcttttaattaggtgaggatatttctaaagacatctttaatgtctattttattagtgatgataatgtaatcacaaaaacagctaaatccaaaatatcctctccacactcatagtagtccaccgcctataaaggtctttaagaaagcagaagcacagtgttcataaccttgctggcatgaggttaattcagaaagtcacttggtctttgctcttgacctcaaaatctacctcctgttaagaaggagaaaaaggaagaaaagcatttgctcgtcacttgtcaggaaataaaaggaagaaatgggatactgagagtaaagtagtatagtggaaacacgcattttctattttctacttaaagttccattacctttcaacattgttgatattgtagatgaagaaatgcttgcctactctctacaaatgatatcctatcccttacaagaacagataaacatagtggttgggaaacaatttaaattgtttctgagttctttggaggatttcatgtaaattcattagtaactctggaactatctactatgcatttaaggaattaaaaatgtattagtttcactacacaaatgtattagcttccactctgtagttaaatgaaaaatgtattagcttatatgtataaatatcttaacattcagtctgtagtattttctcttagatattactccatttgaactagtctataatgcaaacactgcttaaagtctcaatgctggagaattacactttttaaaaaattttcttaagtagcagaaaatatttgtgtatgcggcaatatttgtttaatatagcaaataagtattccttcctaaaaatgctctttcagaacttattcaatgctataatagttttggaaactgaagaaggatattactttttgaaaaatttgaaaaaatgctttcagaacttactcaatgctataatagctttggaaactaaagaaggatattagtttttgaaaaattctagggccgggcacagtggctcaggcctgtaatcccagcacttggggaggccaaggcaggtgggtcatgaggtcaggagatcgagaccatcctggctaacacggtgaaaccccatctctactaaaaatacagaaaaaaaaaaaatatatatatatatatatgttagctgggcgtggtggcatgcacctgtagtcccacctactccggaggctgaggcaggagaatcgcttgaacccgggaggcagaggttgcactgagccaagatcacaccactgtactccagcctgggtgacagagtgagactccatctcaaaaaataacaataaaataaaaaattctataaatgattacatacattaaccacttgaaatctaaaaaaaagaaatccagtattggggtgaagattttattcttagtagaaagacctggtatgtgccactcagttattgaagggattcgtttcatgtagtaactaaatatagatcagcaagacagatatctcggaaccatctaggggaatttgtaagttttcatcgaattttttttttctagtgagcgatgttgctgtattacacttaaactgaaacctattcactctctacgcacctgttcaatgccaccactctggataactgttaaaattcctttccctctatatctccttgaaaaatagcctgttacatctgatgggtcaatctgacaatctccaaagaaagataaaagtaaagtcaaaaaaggacagtgtgagatattgagataccaaactgtaattggaaatgaaaatattttctcttcatttttctggttctcccacactttttcctctattaacaattttagccatgccttatctcccatttaactgtaatttgaaagtgaaaaatctgtgagtaaaaaaggtgctgtttgtgtatatctacataaacattcatgcatctctatcccccatgtccagtggctccttcaccatggaataactagatcccaattttctgttcctttgtctttcagttatttttggaagctttcacaagggcgccttgaatgtgcccacagcaggacttgttagttggaggcaccacccagcatctgccctgctcattgcctattgtggctttttctggccatgttcagagcttgctcttggatcttgatgaaattgaaactggccagattgtcccatagcactgatgtttatggtttctttagaataaacatagaaactgaccctcccagtcttaaaacttgagaaagttacgtttgttgagttcctttctcaggaaaccaaccatcaggtctcccagatagtttcaaggaactgaaacttaccagatcaccacctctggacaatgagacaccagacccctcacgcatcattattgcctaaccgagcacctgcttcctgtggaccaacttctcttccttactcctccctaattcctgttttcccacataaggttacatttcttccctgctatataaacccctaattttagttggtgagacagatgaatttgagactgatctcccatctccttggctgcagaacctgattaaagccttcttccctgacaatacttgttgtcccagtgattggctttctctgcagtgaaaagcagaacctagaccaaaccccaaaccttggcattttggtattggtaacaaaagcttccaccacctattaggaggaagaggacaatagagctaattccacatactctaaaaactttacgtcatcaggcatcagaatgtacttcatcccctctcttctttggcccctctgttactattgaggaacactaattatgcttatgtaaattagacatagaagatagaatatttattgcctataggggctgtgtaatcattttatagaagtcagacacctacaacctgctcacctggggaaaaaaacccaggaattatttatctctactctttaaattatctgagttaataaacacatctagaattgaagtgttttagaaaataaataaaagtcctccttaatgcatttttttattggataatctccaaacttcccaacccaaactcatatctgtttattactttataactgtatccccactcctaatatgaacagtgaagtccaaataagcttataaaacccaaacaaaattacaaacaccaattaccaatagaggtagataaatttttataagcatcaaattttatgaagagtgttttctagtcatttaaatgtatttgctgctgaaggacaaaacagtattaactatctcaaaggcagtggctttagaattgacaataccctttcatatacatctctatatcagtttttaattatttgtaattatagtgcatagtttccattttcttttcctctttctttctttctttgttttttttttttttggtttttttttttttttgagatagcgtctcactctgtcacctagtctggagtgcggtgagtggcatgatctcagctcactgcaaccttgactttgagggctcaggtaatcctcccaactcagcctccctagtagctggatctacaagtgtgcaccaccacgcctggctaatttttatatttttagtagagacagtgtttcaccatgttagccaggctgttcttgagctcctgggctcaagtgatctgcctgctttggcttttcaaagtgctaggattacagtcctgagccaccgtacctggcctccattttctttacatacacaaggtgcttaaaccatttttttaaataagctaattgtagaggtacaatttgtaagtgaatggattaacaatttgcccatagttacaagtttaaaagcaaaatggattctgattccaggtatggcttccaaattctggcttttttaaaactgcaaaccatgatcaaagttagattaggcattcgatgaagagtcctcctttcaaaaggagccctcctttgccttatctctgaaaccagcagagtacacacacttcagttgctgttcttcaggttgtgcaatacaggggcccaagtatgtcaccccgtgattggtccctgcctcaacaagaaacatcactgagctctgaaggtacctctgctgtctgtgtctcttgggatttgaattcatcctcttgattattactgccctgcttattcaactcctataaatcctataaagcctgtatgttttaccatagttgtcaccacgcatgtgacattgggttatctgcctaacctctgatgtccctctagatctgtcatctaatactcatgcctacccttgcctaaatgtattttctacatttctaacttccgattacagacgcttcccttgattgactcttcatcgaatgcctaatctaactttgatcatggtttgcagttttaaaaaagccagaatttggaacccatacctggaatcagaatctattttgcttttaaacttgtaactatgggcaaattgctaattccttcatttataaattgtacctctacaatagaggtagataaatgataggtctttaatgagttacatgtataaactgccaaccacagtggtggaatttataggaatttaacaagtgataattattgttctcctcttgcttgactttaacttccaccttattggaaaaatttttccattaacttctaccttaatgcccattctcacatggcttcagattcatgaccctgtgcagattctttaaacctgttagtgctcttttggatccttgataatagcctttctctgtttccagcctcaccttcaaactcctggtttcatgtgattcagtgttgtgcccctgtccccaacagagctgtagcaataaaaggtttccctttcaggaagatgtgaatatgccttaaacctctttaagcccttaaaatgtaaatcgaattttatttgtattataaagaaagttgcggtttacaaattgaagatttctgtaatgaagaaacatttatctttttttttttactttctgacacacattcagacatgtcattagcttttttaaaactgcaataatcaataaactttgatacttacctattttaattctattcacaactcaaaaactgtatcagagtgaatttctttatatgaaaactaatatcgttgatgaaaccatttagctagacatatacagtgtgatgactaacaggcatctcgaagtcaacttgttgacctgacctcctctttttctcccccaaacctgtgtcacctgcacatgtccccatttcagataatgacaacttcatctttttcattgctcagaccaaaaccttaaattcttttaaatttgtttgctttctctcatgtccctcagccaatatgtggctttacctttaacatatgttcagaacccaactattagttctcaccaccttccatgctaccattctggtctgagacaccagcaagcatctttcttctggaatattaaaataccctcctcattggtctgccttttactccctacaatctattttacaatttggtctcactgcttttcccctttcctcctacactgtattttcaacacagctatccgagtgattcttttaaaaagtaaaccagaacacaacattcttttttttcttcaaaaacttgcattgactctccattttactcagagcaaagccaaagtccttctcttactctgtcatgtataacctgcactgcatccctcctcaactatctaactcctctcctcctaattctattctatgatattttcttctattcctatttaattctgtcctagttccactggtgccctgccccacctgttaacatgccaggcttgcacctgccatcaggctatggtctactactccctcagatcagtgcttgcccaactccatctcttcctcaaaaatttgctcagacctcaccttcttaatgaagctattctaaacacctatttcctactgcatcttacgcacttccctccacattcatggagctcccttaccctgttccactttttctttttttggtaacatttataaacttctaacacactatgtattttgcttattatatgtttaataaattcttcaagggcatgcatctctgttttattccctgagaatagtgcctggcacacagcaggtactcgatgcatatttattaaatgaatgaatttttctttgtctgaaataaatttatttggaaaatatttaacacatttgtgttttgtttagttggggttttgttactactgctatttctataaaaggttgaaatacagaagggaaaagaaaatctcaccagctatctggccttgtacagataaagccaaatgattgaatgcttgactgaattgactggttgtttggacatattttttgtaatagcttaaggaacaactaagctatctgacttccaccccctttccccgtgctagggctagaactgtcaaaaaggcacataatacacatttgggttttaaagaatttagttaattgaattcaatgaaccaaaagtacagtgaaaatcatcaacatttatatgtaaaacaaattctgtttttgtctggcttaaaggggatgtagctgggggctaaaggattagaaatgagtaagagaataatctgacattgctttgcttttcatgcaagctttgtaagctctcaaatggcaatgttggagaattcattacattgtggtaaagtatgacaagttgaagagtctaaattgagtaacaaaagcaaacaccaacatattatacatgaaaactgctgttgaaacaacagatcaaaaactgtactctaacactgtagcactttttatatttttctttattcagagattttgtaaggctgtttatgggttagcatggaaggaataaggctttctaccaaaagcagacacacagtttttgtacagaaatatgtctaccagggattatatactgaggaaatggtgaattgatggaaagaatacgataaacaaggggggaaatgtagtaaagaatcagtggttacctgatgcagttctttaagaaaaggatgattgggtagtgggaacacttacaaagctaaacagtgactgtgagataataactggacacaagaacagctctttaatatctagtgagtgtgtgtatatgtgtgtgtgtatatatgcacacatatatctttcacacactgtgcacatacacacacactttgtatgaggaaggtctatgatcagaaatactaacatcactattcaagccttgatgacagattttccactcctgtgataattcctttgtagctgattgactttggaaccagagagtcccttctaacaatgcagctattcctaggattataggttctcatcaatacctctttttaaatgtgtcacatttgtcaggtcacttttctctctgaaggaggcagtatcagagtgctggacagaggataagaggggaagagaataaggatgattaacaggaagagaaaaaaattggagggaggtcataaagattttccttgatttctcaattgtgccttggcatggaactaagacaaattctgccagatcacccattaaaagtcagtgtacttaataccctcaaaattaatgctatatacaacttcaactgtatgtttttttaaaaaagaaatgcaccaaacgcattacattttaatgatggatagaattaaatgctgtcatatgcttggcctttgcaaattgctccattaattattataggtgcttccagtgtgacatgtgagtattaaaaaaaactgtattgaatttatctgtaaatagatttgaaatgattggtgtacattctgttgaaacttcccagggagtacatattattcacattttttgtagacgtgaaagcaggaaacacttaaattgtccagaaatcagcctttgcattaaaacatctgcattattttattcctcataactgtaggaaatatctcatttaagcaatcttataagtcaactaaatgcaaataaattctccagtggagaatgacaagttcatcaacttgattccctcccactcccaacattttctgtcttattgtcaactgcttcacatggtctgttcagtggatgtgtttgtgcaccatcttcacaatgaccctagtctacattcctggttatatatcattactctaaatatcccccccaaactgtggcaaagctttgcagcacaatgaattacaatgcaatttggtatcatggaggtgaattttttaaattttgttctttgctgttttgccagagctgattgatgccagaaaggaagattgcttagaaactaggattctatgatagcctgtattgacagatgcaacttttaaaaccagtcagattgcaagccatttttacatcatattgaatcatatacttaattatgtctgtacttctttcacaccttaactttggtgaatctcaaagtatttcatgaaaacttggggaagacatcctccgtattagtcagggttctctagagggacagaactaataggatagatgtgtgtataaatgagagtttattaaggagcactaactcacatgatcacaagataaggtcccgcaataggctgtctgcaagctgcggagcaaggaagccagtccaaatcccaaaacctcaaaagtagggaagccgacagtgcagccttcagtctatggttgaaggtccaagagtagaacttgcagtacaatgtttgaaggcaggaagcatgcagcatggaagaaagatgtagggtgggagattaagcccgttcagtcttgctacactctgcctgcttttattccggctgcactggcagctgattagatggtgcccacccagattgagggtgggtctgccgttcccagtccactgactcaaatgttaatctcctttggcaacaccctcacagacatacccaggaacaatactttgcatcattcagtccagtcaagttgacacccaatattaaccattaaactctccttcctctattaaaccacataaattatatagactatctcacatctttagtgccattgcctgcctgcctgaccatgttttttatatgtgtgtacacatatacaggtatgtgtatacagaaacaggtatatgtatacattcttgtgtatattggtattatagccaaatctaatatgtgtagcttccctgtatttgatgaatcccctccttaatgtctctccctctgctcactgatcacacacatatttatttctgcacttaaaagatagatacttacatttttctgtccttctgtctttgttcctgctattccttcctcactcatctccacttgttgaaactttgtctgcccctcaagacccagggggcatattttgttctgattgtttgggtctcaattcaaaatctaccaacagataggctgtgtgatttgatgcaagtgatctaaccattctaaaccacagtgtcctttacagggcagtggggatggtaataaaatatacctcatagggcagatgtaaggctatattgaaataatctttttaaaacattatacacaactcttgccacaaaggaagggcttaaacaatgcacgctaaactctatcatctctatggagccccttttatctctatgtattaatctcttctcaagtgatctcatagtgatttgctcttagaaagctttttgtttgtttatttgtttgtttgagatggagtctctctctgtctcccaaactagagtgcagtggtgctatctcagctcactgcaacctctgcctcccatgttcaagcaattttcatgcctcagcctccagactggctgcaactacaggtccccaccaccacacctggctaatttttgtatttttagtagaggtggagtttcatcatgttggccaggctggtcttgaactcctggcctcaatgatccacccgcctcagcctcccaaagtgctgggttacagtcctgagccacagtgcccagccggaaagctcttattgaacgacgttcactagtctagtgacttgtgtgcatgtccatcttctgcattactgagcatgtatagatctacaataacaaaactgtgcgagatgctgaggatatagcagtaaaaatacaggtaaggaatccctgattacctttcaggtggagaagacacataaacaagccaacatcagtggcatattttcagatagtgataggagctataaaggagataaaagtggtgatgcgatagtctccattctgctttgtatgttaggagctacattacaaagagtagactgagaccacactattgctttagtttctctttcaaaggctccctgactccctatatgtgaggtcacaggcaccctatataaagctgccagagctatgcttcatagcttctctggcagctgcttcctccctttcattcaaatttatttgctctcatcagatttaaacgcattttctccttgtatctgatcaccccaccgtgtcttccattttactcagattaaggccacagtctgactggtgttgatttcaggttcatgccaagacactgtaagtaactctcattcctccttatgattccatttactactgcctaagagcacaagcgcagagccagggcatctgtccccatgtcctgccccccagtgtgtgttcttccttaaataaccaggtagggaagggcagataaggaagcccctacaggcaagtcctaatggtcttccaaagggaaaggaacttggtcatagatgctctcaataatagtaccaactcccatcgccgagttttattttagagtctcagaatgggtctagtgacacttgctctcataataaagtagaagaaacatttcttttggataaattgcccataggcttcattatcagaagctccatacatctaggtttctaacacttttaccatctttcaccatgagctcctttcagaaactctcttgagtctcagagccaagaatgaatgctgagggaaaagggagatgatatctatcttgccatgctttaccctgtatctctctgcctgtctatccatcactcaattcagatgtatactttatccttccttttttctgcaaaatacctctatctaaacctgagagcacaagactatagaagaactggatttcctaagtgagtccatggattagactcaccatgccctatagggtctgtctatagaggagtcacagaaactaggacatttgggctctctgaccaagaatcactgaaaatgggcgcaggctttttgtggctaaccctgagcatactagattaatatatctgtttgaagtgtatgttagggttgcatctagagataaacgcagtgactctaactgatgtcaagaaaagcaactaaccccttgtcttgtattctgcaaacatctagtattattctgcttgttcccaagacacaggcttcatgaattaatgcctcctttcccagttaaatattcaaaactcatttgcctaaactaagtggcaaagaaaaaaaatttaaagatgggtgtggaggagcattgcttgattgtaccaaaagcatttgattaaattgattggagagctacagccaaattaacgaagactggcacaccttacctatctctttctcttatttttcagacatgaaaattgctcaggcttcaagtctagtctgtgtgaaagcattaagtgtttcagaaatcaacatgtcttatcaatctattgtgctctggggaaaaaaaaagccagttagtgacattatttccttatgttctagaaacctgataataccttattgtacatcaggagtataagcaaatttcattgtaaagaggttcttctgacaagatctgtgaagaacatgatgttattaacttagacgtctgcacttacaatatagcttttccaagacaatttttgctgggctacaggtggttatttaagacaatcaatttacatagaacaatttattcttttttcatgctgttaaagcaaattggtatgtaattagatttatatactgaataatctcatttgcatatccaattaattcttcctgttttaatttgctagggttgaattcacattagtagtaaaaataacacttaaattataaaggcctcaaaattttctttgctgtaatttgttcaagatgttgcatttaaaaattggtccccagcattctttacaaaatctactgggaatatgtgaaagattttacttaaaagtgcccttagccaaatatcacacttgaggttcactctttgttcatgatgaagaggttaatggatggtagaaagctagtccttgcctcaatacccaataatattcaaaacaaggaaaactcaggttctgttttcaccctctgacctttcatgctttgagtatgtttaaacactgagacatacatgcacagaaatgaaatctgttcccaaataatttatatttattcttcaactgtatcacttcaactattgttgtttaacacagtgggaatatatatactgtagacaaatattattctttttggattcagatacaccagagcttagtatttgtttgtttcttttgccacttctgatattgggaaaccgattttgtctatctaagagtcagtgtcctcatccttaaaaccaaaagagaaaaatatgtgcctttctagaatgactaatttcacatggcataacatataaaagtatctactagtgtggatccaacaatagaagatgttcagtcagacatggtatctggtctgtaataaacatatataaacactatcaatcaaaatgaatattcaatttctaggacttcatagtatttttattaagttcagtgaatgtttgttagtggccattttcattaccagactttagattcaaatattggctaagcattttgtgcaaattatttagtctctctatgccttagtttcttcgtgtgtaattcgggaataataaaaagtatttttacctcgtataatcgtggtcagaattgaaggggttaatacataccctcagactattccctggtgcatagtaagcactcaatgaatgttaaccatggctatcattgttaccatgttgaaagaataggcacccatatcagagtttctttattgttatctattagtaagtgtaagagtgttttaggactaccttaacaaagtaccactgactgtgtagcttaaacaacaggaattaattttttcatagttctaaaagctagaagtccaagatcaaggcttcagaagtttagattgttcctgaggactctctccctggttttcagatgatcaccttctccctgtatcctcacatggcctttcctctgactgtatccaaatttcctcttcttataaggacagcagtcagattgggttaaagaccaccctaaggtttcatttaacttaattacctcttaaaaggccctgtgtccaaatacagtcacattctaaggtaccaggggttagggcttcagcatgaaatttggggaaacataatttagctcataatgccaaggttgaatttcccttatatctggtagagaccctgaagctctgttttcagaactgatattaaatgtaagcatatctgtgtacttaaggtatttaaaaagcaaggccaggcacggtggctcacacctgtaaccccagcactttgggaagccagggtgggcggatcacccgaggtcaggagttcgagatcagcctggccaacatggtgagaccccgtccctactaaaaatacaaaaattagccaggcatggttgtggacgcctgtaatcccagctactcaggaggctgaggcaagagaatcgcttgaacctgggaggcagaggttgcagtgagccgagattacaccattgcactccagcctgggcaacgagagcgaaactcatctcataaataaataaataaataaataaataaataaataaatagcataagtaacctatgccttatctcaaggtcttggcccattttctgcagctacagccatgctttcaaagctatacttttattttctcccctcagatttttatagcctgtgcatcagattcatgtaatagaaatgtcataacatttatattaggtctctattccagagacctaggcttacacctcatatttgttgtttgttgtataaatatacacatacaaattacctaaactcaggcaagtgattttacctccatgagacctccttttacttatctgtaaaaggggacatatttcctcacaaacagatgcaaactaagacaggatagggaaaagaattttgtaaattctaaattgctgtagagataccagctgtctctgcttactgaaaaggcaatcttaattccattttctattttatggtcattgttagtttacagttactaatattaaatggctttagtggtcactttaggagagacatttactttgttgttaaaccaatatgtttacaattagatataagtttctttctggatttgaagataactgtaatttgcagttgacgcttatgcaaattgctatgttctgctgcatacccattttaaaatacaaatccttcccagtcatcactgagtgtatataacaactgcaaagaaaacgctctgaagatttttttttcctgtcaaaatgccactttgccttcagaaccaccatctaaacattatcttaatgacacttactttatttggaatgccagtatcctttgtgtaattttcagatagcctgcagatatttgaaaaactttaccagcttcttcatcatttcagtctgggaaatgagcatcctattactggcatgccttgtgttattgtgctttgctttattgcacttcacagattttgagttttttttgcaaactgaaggtttgtgccaacactgcatcgagcaagtctactgccaccattttcccaacagcatgtgcttactttgtatctcagtgtcacatttttgtaattgtcacaatagttcaaagtttattcttactattatatctgttatagtgatctgtgatcattgatgtgaccattgtaactgttttgggataccatgaaccgcacccatataagacgaagaacttaatcgatcaatgttgtactctggctgccccactggctggcctctcccccatctctctcccttctcctggggcctcccttttccctaagaaacaacaatattgaaattaggccaattactaaccccaccgtggcccctaagtgttcaaatgagaggaagaagcgtacatctttcactttgaataaaaaactagaaggaattgaccttaatgaggaaggcatggtgaaagccaagacaggctgaaagctatgcctcttgcgccaaatggttggctaagttatgaatgcaaaggaaaaattcttgaaggaaattaaaagtgcaacttcaggcaacgcatgaataagaaattaatacagtcttattgctgatatggcaaagtttgagtagtctggatagaagatcacaccagccgcaacattcaacattctcttaagcgaaagcctaatccaaagcaaggccctaattctcttcaattctgtgaaggctgaaagaggcctggaagctgcagaaaagaaggtggaagctagcagaggttgcttcatgagatttaaggaaagagatgccacctccttaacataaaagtgcaaggtgtagaaacaaatgctgatatagaaactgcagcaagttttccagatctagctaagataattaataaaggtggctaccctaaaaaacagattttaaatgtagataaacagccttatgttggaagaagatgccatccaggactttgataagtagagaggacaagtcaatgcctggcttcaaaacttcaaaggacgggcttactttcttgttaggggttaatacagctggtgactttaagttgaagacagtgttcattgaccatcctgaaagtcttaggacccttatgaatcatgccagatctactctgcctgtgttcttttatggaacaacaaagcctggataacagtacatctgtttacaacatggtttgctgaatattttctgcccactgttgagacctactgctcagaaaaaaagattcctttcaaaatattacttgtgtttgacaatgcaccttgtcacctaagagctctgatggagatatattaggagatgtatattgttacccttccagctaacacaacatcgaatctgcagccaatggatcaggagtcattttgactttcaagtcttatttaagaaatgcattttataaggttatagctgccatacatagtgacttctctgatggatctcggcaaagtaaattgaaactcttctagaaaggattcaccatcccagatgccattaagaaaatttgtggctgggcacggtggctcatacctgtaatactagcactttgagaggctgaggcaggcggatcacttgaggcaaggaatttgagaccagcctgaccaacatggtgaaaccctgtctactaaaaatacaaatatatctatctatagatagatattttacatataaatatatatatttataaatatatataatataaattcatattatatgtataaaatatgtatttttataaatatatatatatatataaaagggaagggaaaaggaaggaaggaaatttataattcatgaaaagaggtcaaaatatcaaccttaccaggattttggaaattgattccaaccctcacggatgactttgaggggcttaaagctttcaatggaggaagcaactgcagatgtggtggaaatagcaagagaacaagagttagaagtggagcccagagagagaagtgattgaatcgctgccatcatgataaaacttgaatggatgaggagttgcttcttatagataagcaaataacatggtttcttgagatggaatctattcttggtaaagattgtgcaaattgttgaaatgacaacaaaagagaatattatgtaaacttagtggataaagcagtggtggagtttgagaggattggcttcagtttgaaaagaattcctactgcggataaaatcccagcattacctgctgaggaagtctgtcatgaacggaagactcaatcaatgcagcaaacttcaatgttgtcttattttaagaaatggccacagccaccccagccttcagcaacatccaccctgatcagtcagcagccatcttaatcgagggaagactctcccccttcaaaaagataacaacttgctgaaggctcagataatcattagcatttttaacaataaattattttaagttatgtacattgtgttttttagacataatgctattgtacacttattaaactgcagtatagtgtaaacatgactcttgtatgcaatggaaaaccaaaaaacttgcgtggctcattttattgcagtatttgttttattgcactggtctggaactgagcttaagatatatctgtatagataagactatgaatgtatgaaatttcataggctggaggtatcttaaagaacatctaattcatttacaatcctgttataaaggttatagactctttactatggaacgcaaggatattaacatcttttactagcagacattgagtgaacaagtttatatgtcaaaaagactgttacggtcttttcctttctgatgccttctaagacatggtggacctaccagggtaaagattcaagagtggccattgcagtctatttaacagctccattctttcaccacctcctttgatctcatctttttgagcctctttccttgcagtgaagggacaagcagggtagaaaaaaatattcccttaggatcctcttgcttcctttgtgctcccgatgatccctttgtattttcaatctgtgggtctctttaatgcctttattctctccttctcccaaaaatagtgtcagttcaccaaggacaccacataggtagtcagtcatttggttcgatcagattctcatggaacctacaagacaagcacccttttcacttttctaggaatggcctcctcttagcatataatctgggtgttacactgaaaaaagtctagctcttcctttgattgagtagcattatcaaaattaccaagggccaggcacggtggctcatacctgtactcccagcactttgggagactgagccaggaagatcgcttgagcccaggagtttgaaaccagcctaggcaacgtagggagacctccatctctacaattttttttcttttttttcttttttttttttgagacggagtctcactctgttgcccaggctagagggcagtggtgctatcttggctcactgcaacctccacctccctggttcaagcaattttccctacttcttactctcgagtagctgggattacaggcacctgccaccactcctggctaacttttgcattttttttagtaaagatggggtttcaccatgttggccaggctgatctcaaactcctgacctcaggtgatccacccgccttggccttccaaagtgctgggattataggtgtgacccaccgcacctggccaaaaaaaaggtgttgtttttttttttttaaatagccaggtatggcggttcatgcatccagttctagcaacttggtaggaggattgcttgagctcctaccaacatttttcgattgctgaggcaggaggattgcttgagctcacaaggtcaaggttgtagtgaactatgattacaccactgcactgcagcctgggcaacagagcaagaccctgtctctgaaacagacaaacacaataacacaccaagaaatttgggaacagaagggaaataaaaacctcatcccaattacacattcacttacaaaacagatacttagaaagtgcctaaataagtactagtaatttatgtagtaccagtggaaagtggtctaatagtcttattatttcaactactatccttatggatctgctaatctaaacagacacctctctcccaaaatacagtaagtgttcagcagataatgaaaggggactgctgtgcagctgctgtggggcatggcattgaaactgaatccaaagcccactgggtctgtgaggtagatggaatgtgacagggagagaagagagaaaagacttcctagagaaggtgccaatgtttctaggcacacaggaataacaaagaaaactcagcaggggcccagagcacagggacttgtccaatgagatgagagaagcaaggaagtagtagtacaggtctcagtggaatccttgccttagtatggtatgtgattttttatagtgcagagtggatctcgtgtgtgaatgtattctccatcgtagacgtgtggtcgcttatcagtgtggtcacttatcaatcacatttaagctgttgtttaaaatacttatggatcttttcttttggaattttctttacggctcctattttattcctctgaatatttcaagtgcttgtaaatccttgtcctttgaagttagatttcatttttggcaacagctaagctttccatatttagaaacttgttcagagccatttcatggtaaatgttggtgttcatgctgggtaatactgttttttggtcaaaaatgaattgtgactataaattaatgaagctaatttttttgtgtggcttataaatcagttctctatcatttttaaagggggaattttaaaacatacgcgttaatacatgtgaaagcttttttaaaaattgtaaatctccacaatttttaaaaattgtaaaaaaagcaaggactttttttatttttattaatcattaagttatattacatttcaacatactgctttaaaactcaataaataagttttaaattctcttttaaactactagtttcttaagtaattgttcatttgatgttgtctaccagttgagcaactggtacattaaccagagctgtagattgagctcttttccaaatatttagattttgggttcatagagaaataccttaagagaattgtcaaatgaggaaactgacattcagaaaggagaaataagtaaggtatctaagatcacaagggtagtaattgacttaccaaataatatagtttcaaatccctgacattaagtcaactaaagattggtcttttcactgatgtagatctagtcattttagtcagaaatactcttctttctcctattttctctctaaaacctctgccttcaacctttgttagtctccccatctctttttgtattgcttctatctgtgtgagggtttggataacaagaagatagtcttctttcctttatatttcctttatttttcttcagtgactactcaaaaatcttacccagaatggacactaaatgaatgaatttctaattgttttgcagctttctcttctgttaggatcaagtgaccagttcgtctctaccaaacccaggatgtgtttttgatttatgtgatttgtggttttgagttataagtggttccataaggccaactagcagctagaaaacagtaagtttgggactgtaaacagttacagggaagtggaagtttttggttgttttattgttgttaattctttgttttgttgcccttggtagacaaaacttaagtgatgatagagcttacagttgctaatttacccaattccatgctttgctttttgaaagcaattgctgtgtttcccttcaggggatgagctttatttactccttctactccaaagctgagctataggaattcaagtggggtctggaaataccattgaaaaaaagagtttttttgaccaccttggcaatggccagttgtttctttccatggccagcctctttgttgtttgttgagaatactgtctaagaaaatcccctcaaaattagaagtctctgaaaactatacagatctcaagggcctaaaagggaatgttatcattttaattattgtgctactttcaaaattatactgtttgtaatcatgggtattgaaaaagcccagacatttgagtttaattatgtgctttgtaatcctaagatacaatccttttttctcatgcttttatataccgtgtttctctcttttctccaacacttaataaggccaacccaagggtattaattccgggaatgagtaaaaatggtgttattctttctcaaagcctagtcaggtcagtccacaagcattcagccctgctcacagtatgtatttgaagaatgtatctttgtttagaaaagaaaaggaaggtttgggaagagtgtggattaatattatatgctgcttccctttgggcctgttttttccccccagtcctttcttaccctagcaaatacagttaggagtcctggattgcacattgtaagaacaaataggaatctgcaggccttcctggaaggtctgggtcatagcagcttctttgcttcttcttcttatcttctgcgtggcactagctagtatgccccagataacacagggaaggaatttgactccttgacatcttacatgcagccaaacacttcagaatgtatagaactttctgaatccaggtagcatctcactctgaatgtcagatggatttttaaaaaatttattccccaaataattgtttatgaggaaattttttgtctctctaaggtgcagccacgtagagtcacttattctctgaagggtcccaccctataagtgatataaatcctgatatttcaaggaatttagaaaatatgtttgttttattcctcctccctccagtgtgatacagaatcttaataaggagcctatgttgccttttgaatcattaactctgaagaaagttcaggaatgttagacttgggagattaataactgtaactgcaaagagaagtcttgtctgttaaagaatttgtgtgcactattgcatcactcagtatgtatgtgaggctttctatttttaacatttttaatgacaagctgcctccttggttctgtatgcccttcacctttgtcagaatgagattgatagtgaaagtttctctgctgttctcataaaagttgaattaagggtcttgatttcggtttactgtactgcagcattatctctcattcatctagtggtctcttctctgtttctgtttcctgctctgcctgtattctagcatgcagggcagttggcagggactggccatgcaaaataatagctgtttccagaataagtcattgagtcatctgaaagtacaacattatagtgacatacctgacttctctataatgcagaaaagggagtcataataacttaaagcattgcacattgccagagctatttgaaatgacggaacatgaatattttgacatctagtagtagcctagtgcctctttgccagaagatgctaatgaaacaaacatggaaatcactgcgggattaccaagactgttttgactttctttcaggataatcccactgggtttttaacttgcaaatatctgaatgcccatcacatggaggaggaagctgatttgtttgcaatagaacttgaaaaaatggtgaaaactaaagatactttctaccttggatttcggatttgctttctgataattagagatatctcaaaaataaaatggactttctggaatggaaaagataagaatgttttattgtcctcgaggcattagaattgtaaccgtatttggcgagaatgttgaagagtagcaccatgcatcctagggaatttttaaaacaattaaaagagaataattataagtcaaagttatcaggaaggaaggacagatgtaatctcatttcgctgcatgatagtaaatgaaggtacatataatatttccaagagagaaaaatttactcaaagtccaagaaattcagagtaaattcaaatggataagaaggtaaaaatgtagtctaaggattataactacttctgcccatgcaaaaagcagttatgtttataatcccagattaaattgcccagaagtatcatcagatcccctatctggttctctttagagcatgtttcaccaactgtaatcaaagatttgtttttatgactgattgatgtctgttttctcccagtacattgtaaattccatgaagacagcaactatgtctgttctctgtttgaatcccaagctctagtacagtccctggagcataatgcggactaacttaacatttggtgagtgaattaatgaatgaatacattgtgacaattataatgtgacaataaattattgagaggtcaagtctcaaaagggaggtctaagctaattaattttctgaatgtgtatgcagtactagcttatgtacaaaaatctttcttcagatgtgtatgagtcagcagcaactggaacttggaggtggtctttagaccccaatgtcggtatctgttcaagtattctattcgtaccttatcagctgtcttccttttcctgtggtggaaggactgccagtttcatctaagtggtttgcctcagagttcaggagaatagctcattgggagttctggtcagatattttcaaactcaaatgagtaagctctctgaaaaacctatacataatgaaaaatagtttaagattacagtggtgttttgatgtgatctggaacagttcacccactcctacttggcaataaaaataaattatgcaatgggacagccaactgttacagcttggaaaactgttaaaaactcaaaataaatacgtaggttaatgtcatgaagtacttgaccggacaagcatatttttccaattctaagggtagaaagtgtctttgtaaacattcctacatgtcagaaaactaaataaaaatgacctctagcttcgaggcacttattggaaacctattttacattgaatacacaagccaagataatacagactgtttgataagaaacattagagaaatctgtaacatgaggctttttattataggtttattacatcaatctctccagtgggtaatggaacttgtaaatatactcttatgtaggagtctccttgtgggctttttattcatgctgaagtaagcacagcaaacttatttgctgtcagggtacattgaatttaagattagtatttattttggttctaaggaggttttgcgtttgtgaattgaaagttggatcagctgcatgaaaacaagatgggactacagggagcacaggaagtaaattagttttttctaaatatgcattctgtaaacctacgtatttagctagcatggggtgcgtatgcgcagtttctcagatgggtgagtcatgcatcggatgtgtatgtttatggctctgtggtttgggtagagatagatattcaaaatggcatattgcagttactgttttctaatgcaaatcgttctagagaaaaaatatatatgtttataagaaagatttcttaacctctttttgaccagtgactttcttaatttcagtgggggcatatgaaataaaaccctcaaaatcatcagccacactgtaccttccatatcattgacagataacactgacaaattattccggcttgttctgacacctgaatagaatgtatcaggtggtaactgaagccatgaggatgagttgcccatacagaggaaaggattataatagtaaatagctatgttttatgaatgacatactagatactgtgcgaagtgaactagatgtgttatttcatttaatgctgtgcttatgagacagccaggtcggagggggtacctggcaaaactccagccagcctgtgccctggggtggacccacaggaagttcgcaccttttgcagcggggaggagcctggctgctcctcttcctgtgtggaacctgggattcggcagggtgggaagtgctctgtcagggactctggcccagcaagagtccctgttttccttttttcttcctttcacccaataaaaccctgtcttactcacacttcaaaccgtctgtgagcctaaattttcatggccatgggacagacaaggaccccatcattagctgagctaaggaaaagtcctgcaatacttacatcacatgactatgaaggcaggtaccatggacactctcatttgtcaaagacggaaaagtaaagcacacagaggtaatacgatttactgaaattcacacaaataaatttaaagtctgttccatctatgttgtgttgttaccttaggatctcacttcatatttgtgaagaatcatccttcccatttccttaaatacccaaaccatgagcatttgtaccatcctttattccttttggacatttgcagcagaatgtctattttgtttaatattagctcataatctgggaagtgagtagtagtattcacattttatctgaagtaagtgagacttagagaggtggagtgacttgcccaggcctgatttactgggtcttagtttcaagcctttttttataatgaagctcactctatctccaatagagcatgttcaaggttctaggtccagaaagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggtttaaaaatacagtgagatcagaaagaatgctctgttcaaaaaaatcacatactttgtctcattagagacagaattgatactctttattgaagagtaaaattcagtaagaaccttcttaaaaataggagcaggccaggtggtggctcagacctgtaatcccagcaatcttaggaggccaaggcgagcagatcacttgaggtcagagttggagaccagcctggccaacatggtaaaaccccgtctctactaaaaatacaaaaattagccaggtgtaatggtacatgtctgtattcccagctactcgggaggctgaggcaggagaatcacttgaacccaggaggtggaggttgcggtgagccgagatcacatcactgcacttcaccctgggtgacagaggagactccatctcaaaaaaaaaaaaaaaaaaaaaagaagaagaagaagaagaaaaagaaggaagagagggcaaatgtgtattatcttataggtattaccctagtctgcagtgaggtttttgttctcttatgtcctataaagatcagtgaattctaacgacttttacactaatgttcaagttggtccttaattttattatttcccttttcacttatttgacttggctttctacataccagatggtcacctgagcccagagccacatcttttcatttgttatgctttacaatttgtcataatatctggtatatttgatatggacaaatatttgtttgattgttttcttttgatgtggtgatgtttgaactcatcctaaatgtacacaatagttttgagagacattttaaacccaataacatgtaaatttcttaaaacattgctcctgttcagatacatcgaactggaaacctggtcagggattgtgtgaacagcttcattttctcactataccttgtacatgaaatcctatttctgtttgtcttttattggcttttaaaatagcatgacgatctgatgcacagtcactgggctttggcaaatctctatttcctcccagccacagaaatttacatttcttcccaagctactctgactgtgaataatctatgtgaggagtgacctcagttcatttgaaagcatccaacatcctgaaaactgtaaagccacagcacgcactgatttctcaaggtctaagagatggtttataaatgattaaaaaaaaaactctaatagtatactcaaaacattttttaaaaaaagaaatagagttatgagtctgcaaggacttatttaagaaagacgtcctaatattgggggaggtggattcactggcactgttatatcaaccaagtatttcatgtgtgaggagataaagcagcaaactacgcaaaataaacagcgtgtgttcaccttagatatctaggacgcttcactttgaataaattttctctgcttttttgaatccagagcaatattgtctgttagacaagttctgggttttgtctgcttcaggcctgtcttaaccctgccattaattggcatatgtccaggcaattaaaactgtggtatggagcaaattaaaaaagagaatttaaagcaccagagtcatttgaaattccaaggtcaaatggaaataacattgaattatcttcttttggggattatacctgcctctatttgtctccaccagaggtgataatctagactttggttacctactctttgcatcctcaaaacgggaacacacaggaatgcttttttccgaaggccagaatgacagatataagattgaagttaaacacaactgatgcccagcacgtcagagcaggacaaagaatcagaggcaatttaatcccacctttatgcttttgaaagacaaaaggaactcaagcccagaatggcaaaatgatttactaaaggtcatcacaactaggcacccctctaattctggtaataattaaaatcaacaatatttattgaacactgacctttgccaagcactgtttcaagctcttcccatgattttttggtattatagttaaggagcggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgtttaaaaaaaaaaaatcctggccaggcgtggtggctcgtgcctgtaatcccagcactttggaaggccgaggtgggcggatcacctgagatcgggaattcaagaccagcctgaccaacatggagaaaccctgtctctactgaaagtacaaaattaaccaggcgtagtggcgggtgcttgtaatcccagctgctcaggaggctgaggcaggagaatcgcttcaacccaggaggcagaggttgcggtgaaccgagacgccattgcactgcagcctgggcaacaagagcaaaattccatctcaaaaaaaaaaaaaaaaaaaaaaaatcctgcatcatcctgatgatgttcattatcatatagaaattttaagaatacccgtaataaatgttttttaagtcagcatttcccaaattcagacaaacacagaacccaaccccctgccaccttttgttaaaaaattcatgttaaccttcctgcagagcagatatcaagaaagatgtgtgagaggaaatttcattcaaaaaacacttatcaagtgctgatattatagctgatgctgggttatagagatcaaagacccagttccagaattcatagagctcacaagctacagaaagagataagcttgtaaatcacagttataatacagtttagtaattagtgtcatgcacaaaaataggggatgtggagctagaaattaagatatttcccatcaccttgctgttgaagagtagtactgactgctatattatattatccctaaattcagaggcttaatttactagaaatttagatctcactcatataagattcaatggaggagagtggcagcaacaactatggttcatacagtcattcagggatgcagattaatcttcagtgtgtgactttccagatgtctttggacatcaacatccagctgctaaacaggaaaagagaaaagttaaaaggaacactgtgcaagatgcttttatgatctaggcctgagaggatacatttctttcacctgtggtccaatggttcattcatataactacaactaactgcgagagaggctaggaaatgtgggctacttctgggtcctgcaaggatggggaaagggtttggtaagcagctaactagtctcaacctcaatgggcaatatgaacttaggcaacagaaggtatagggaccttccaggcagaagtaatcaactatctgttgacataaaggaagggcaatcatggcactattgacaccctacgaaaagtatgatatggcaagagtagagaccacctgcggaagagtgtaggagacaggatggctgggaacagtggctcatgcctgtaatcccagcgctttgggaggctgaggtgggtggatcacttgagatcaggagttcgagaccagcctggccaacatggtgaagccccatcttcacatttgtattttagtatacaaaaattagctgggtgtgatggtgtgtgcctgtaatcccagctgctcaggaggctgaggcaggagaatcgcttgaacccaagaggcagaagttgcagtgagccgagatcacgccactgcactccatcctgggcaacagagtgagactctgtctcagaagaaaaaaaaaagaaaagggaaataaagacacaagatcatgtgagctttttgtactatgttaaggagcttgtattttactttttcaatgatggcgatttattaaagaatctaaaaatcattgaactagaatcaaaaaagtgagttaagagattaatggtatataataggaatagataatgagctaacaagtaattgatggcatagaatagggatggattcaagaagtactgtaggtaaaatatacatgacttggggacccagtgaatgtaaaaagtgaggaagagagaaggtacagtcaagaatatttcctgggcatgtctggctagttagatattgttctgatttattaaaaacaagagacattgggaaaggaatttggtaagtgggaggaactcataagggtctgaagtataggaaggaggttgaaacttgagggtggtcagcatgtaggtttccttgaagcatgtggaatgaatgcagtctaaaggagaaagaaaatcgaggcatgcagagagcttagaacaaaaccacacaccagaatttaaagggctcaaagaagaatttgtccatgaagaatctaaaatgataaagagaaccaagggaagaaagaattttttaaaacaaggtaggaaacaacccacatgtccatcagctggtgaatgcatgcatacaatgtgatatgtctgtaaaacaatactattcagcaataatagggaataaagtactgatgcatacatattacaacaaagatgaaccttgaaaacatactaagtaaaagagtcctgtccaaaaagaccacatattgtctgattctatttgtatgaaatgttcagaatatgcaaatctattgagatagaaagactagttgttttctggggcattgagaggtaggtgggggtggttgggtagtggggaaaagggaacaaatgctaatgagcacaggttttttgcaggaattaggaaaatattgtaaatttgattgtgatgatggctatacaactttgtgaatgtacttaaaactattgaattatagactttttaaataggtaaattgcatggtgtatgaactatatctcaaagctatcagttaagaaaaccaaaaaaggaaagtagaaccagtgaagtttggggtaatagaaatacatacgtcttctaagccagcttctggaggcaaaattcaatggcttctaaaccaatcctgtgattttcttttttggtccagaattgcatttgcatttttctgtgggaaacacttctactttatttgcagatggtcacattcttaaggcatttagatcatcacctatattttttttccttaagtaagtctagattttctgtaaattagcattgaattttatgataagtaagttggagaagttttatatagtaaatttctttcaatatcaaaattatcttgaagataatacacttagctataaacatgtaacctcccattatccagggttatatagtcaatatctagactttcagccatgcctgggacccaaagtgagcccagccacatcttatcagaggaaagcatttgtcattttacatttaaattcacatctgaggtattctccaggttttcttggaactgcagaaatatcaccgttatacattatttagtaaccagcttgctttgcaaaggtcaggttcgtgttattcaaagcgtgatgcttagtatgcgatgacacaaacagatttcttgctttaaagtaatagaatgcgatgagtgaaaccaactttctttggaagaaagatgtctcctttccacgacatttgatttgtaagtgggtttggcttcattaatatttaattgtctttttaatctgtatgtcagttcttattgcagactgcttctggggaggttttcctctgaaataccaataacaaccattcttcactctaacatcaaaacaagggctctctccgggacacctagttgtatttcatctctagggatataattattttgtcgttatccacagttcctcaagggactgatgatgtaggacaccctccttaaagacctttatatgtcaaaagaagaacctgatttgttaatgttgcaaatactaattcagatggtcttgcatcattcttgtgagttgccttttcttaaccaggctatacagaatttgtacttttttattagcacgttagtggagtttgaagctgttagttgatcttttcaggatattttcatgagctttactagtttaggaaacagtgctttttctgtgggatgcattttgaacatttaaattcattttcaaacacaaatcagaatagggaatgaaatgataaacaaccctttataaattttcaacttgatcacctatagcaataaagctacaaaaagaactcagaattagtatctctggagattgacatagagaaattgagattgacatctctgcagcaagttgagcctctttgtgaactggtcatttttatttcctggtcacttgggagaaacctgggtgaaaaaattggacatctgtttttgtttgtgatagcaaattccctatgggatgagcctcaccctaattaggggaccactcttggccctctcaggagagaatataagggtagataaggagacttaggttaccctctcaatcaatcacagtggggcaaaatggaataatttcacacattttcctttagctggatacttgatatatgagaaaaaatatggggtatccacatcctaaaattttaacacttccctgtgcttaccaacgtggcgtgtggtatcagtggaacggatgctttcatctgccttttttcgaaggttagttgtggcattgccttgattagtcaaagattttatctcttggtaaaggatattatcgatttagatagacacattttgaagttagaatacagcttgtaattatgaatgggcgaagatatctgacccttaaaaaattcagactccctaagttgtctacgcagcatgcaggttcacctgcactggtatcacacccaagctagcaatagaacaaattcatttgactttattttatgacttttcctagaagagacataacaatgaatcatcttgttatccaagccaataaatatgcttccttttagatttcttaattcagtttgccagctattttgggtattagaataacgggtttcatgtccttggggggtttaatttgcttccagagtcttgtttttgtagaatagcttaagtcttcatagtcatggtttatgattcttcaaataggtcattataagtaagatctgattttgaactggtattaagaaaatagacattgaaaaaaactgtttcagggaaaaaacattttcctttctagatcatagtgcaataagtggctcttttatgatcactgttgatttttccaaagtaagacattactgatttattttatctatgttagctttttcttccaaaacaattccttgatgtaattttatcataaggaataaaatgttctttttttatttttattttttattatactttaagttctagggtacatgtgcacaacgtgcaggttttttacatatgtatacatgtgccatgttggtgtgctgcacccattaattcctcctttacattaggtatatctcctaatgctatccctcccccctccccccaccccacaacaggccccagtgtgtgatgttccctttcctgtgtccatgtgttattgttcaattcccacctatgagtgcgaacacacggtgtttggttttttgtctttgtgatagtgtgctgagaatgatggtttccagcttcatccatgtccctacaaaggacatgaactcatcctttttcatggctgcgtagtattccatggtgtatatgtgccacattttcttaatccactctatcattgatggacatttgggttggttccaagtctttgctattgtgaatcatgtctcaataaacatatgtgtgcatgtgtctttatagcagcatggtttataatccttggggtatatacctagtaatgggatggctgggtcaaatggtatttctagttctagatccctgaggaatcgccacactaacttccacaatggttgaactagtttacagtcccactaacagtgtaaaagtgttcctatttctccacatcctctccagcacctgctgtttcctgactttttaatgattgccattctaactggtgtgagatggtatctcattgtggttttgatttgcatttctctgatggccagtgataatgagcattttttcatgtgtcttttggctgcataaatgtcttcttttgagaactgtctgttcatatcctttgcccacttgttaatggggttgtttgactttttcttgcaaatttgtttgagttccttgtagattctggatattagccctttgtcagatgagtagattacaaaaattttctcccattctgtaggttccctattcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctggccatttttcctagcaccatttattaaacagggaatcctttgcccatttcttgtttttatcaggtttgtcaaagatcagatagttatagatatgtggcattatttctgagggctctgttctgttccattggtctatatgtctgttttggtaccagtaccatgctgttttggttactgtagccttgtagtatagtttgaagtcaggtaacatgatgcctccagctttgttcttttgactcaggattgtcttggcgatgcgggctcttttttggttccatatgaactttaaagtagttttttccaattctgtgaagaaagtcattggtagcttgatggggatggcatggaatctataaattaccttgggcagtatgaccattttcacaatattgattcttcctaccctggagcatggaatgttcttccatttgtttgtgtcctcttttatttccttgagcagtggtttgtagttctcctggaagaggtccttcacatcctttgtaagttggattcctagctattttattctctttgaagcaattgtgaatgggagttcactcatgatttggctctctgtttgtctgttattggtatataagaatgcttgtgatttttgcacattgattttgtatcctgagactttactgaagttgcttatcaacttaaggagattttgggctgagacaatggggttttctagatatacaatcaggtcatctgcaaacagggacaatttgacttcctcttttcctaattgaataccctttatttccttctcctgcctgattgccttggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacatcccatcaatacctaatttattgagagtttttagcatgaagggctgttgaattttgtcacaggccttttctgcatctgttgagataaacgtggtttttgtcgttggttctgtttatatgctggattacgtttattgatttgcatatgttgaaccagccttgcatcatagggatgaagcccacttgatcatggtggataagctttttgatgtgctgctggattcggtttgccagtattttattgaggatttttgcatcgatgttcatcaggtatattggtctaaaattctctttttttgttgtgtctctgccaggctttggtatcaggatgatgctggcctcataaaacgagttagggaggattccctctttttctattgattggaatagtttcagaaggaatggtaccagctcctccttgtacctctggtagaattcggctgtgaatccatctggtcctggactttctttggttggtaagctattaattattgcctcaatttcagagcctgttattggtctattcagagattcaacttcttcctggtttagtcttgggagggtgtatgtgtcgaggaatttatccatttcttctagattttctagtgcatttgcatagaggtgtttatagtattctctgatggtagtttgtatttctgtgggatcagtggtgatatcccctttgtcattttttattgcatctatttgattcttctctcttttcttctttattagtcttgctagcagtctatcaattttgttgatcttttcaaaaaaccacctcctggattcattgatttttttgaacggttttttgtgtctctatctccttcagttctgctctgatcttagttatttcttgccttctgctaggttttgaatgtgtttgctcttgcttctccagttcttttaattgtgatgttagggtgtcaattttggatctttcctgctttctcttgtgggcatttagtgctataaatttccctctacacactcctttaaatgtgtcccagagattctggtatgttgtgtctttgttctccttggtttccaagaacatctttatttctgccttcatttcgttatgtacccagtagtcattcaggagcaggttgttcagtttccatgtagttgagcagttttgagtgagtttctcaatcctgagttctagtttgattgcactgtggtctgacagacaatttgttataatttctgttcttttacatttgctgaggagtgctttacttccacctatgtggtcaattttggaataagtgtgatgtggtgctgagaagaatgtatattctgttgatttgcggggagagttctgtagatgtctattaggtctgcttggtgcagagctgagttcaattcctggatatccttgttaactttctgtctcattgatctgtctaatgttgacagtggggtgttgaaatctcccattattattgtgtgggagtctaagtccctttgtaggtctctaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttactttgagcctatgtgtgtctctgcacgtgggatgggtttcctaaatatagcacactgatggatcttgactctttatccaatttgccagtctgtgtcttttaattggagcatttagcccatgtacatctaaggttaatattgttatgtgcgaatttgatcctgtcattatgatgttagctggttagtttgctcagtagttgatgcagtttcttcctagcctcgatggtctttacaatttggcatgtttttgcagtggctggtaccggttgttcctttccatgtttagtgcttccttcaggagctcttttaggacaggcctggtggtgacaaaatctctcagcatttgcttgtctgtaaaggattttatttctccttcacttatgaagcttagtttggctggatatgaaattctggtttgaaaattcttttctttaagaatgttgaatattggccccccactctcttctggcttgtagtttctgcggagagatcagctgttagtctgatgggcttccctttgtgggtaacccgacctttctctctgtctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctggataatatcctgcagagtgttttccaacttggttccattctccccgtcactttcaggtacaccaaacagacgtagatttggtcttttcacatagtcccatttttcttggaggctttgttcatttcattttattcttttttctctaaacttctcttctcacttcatttcactcatttgatcttccatcactgataccctttcttccagttgatcgaatcggctactgaagcttgtgcgttcgtcacatagttctcgtgccatggttttcagctccatcaggtcctttaaggacttcccttcattggttattctagttagccattcatgtaatcttttttcaaggtttttaacttctttgccatggtttcaaacttcctcctttagcttgaagaagtttgatcatctgaagccttcttctctcaactcatcaaagtcattttccatctgctttgttctgttgctggtgaggagctgcgttcctttggaggaggagaggcgcgctgatttttagaattttcagtttttctgctctgttttttccccatctttgtggggaaaggtctacctttggtctttgatgatggtgacatacgacatacagatggggttttggtgtggatgtcctttctgtttgttagttttcctcctaacagcaaggaccctcagctgcaggtctgttggagtttgccggaggtccactccagaccctgtttgcctgggtatcagcagcggaggctgcaaaacagcaaatattgctgaacagcaaatattgctgaacagcaaatgttgctgcctgatccttcctttggaagttttgtctcagaggagcaccggccatgtgaggtgtcagtctgcccctactggggggtgcctcccagttaggctactcaggggtcagggacccacttgaggaggcagtctgtctgttctcagatctcaagctgcgtgctgggagaaccaccactgtcttccaagctgtcagacagggacatttaagtctgaagaggtttctgctgccttttgtttggctatgccctgcccccagtggtggagtctacagaggcaggtaggcctccttgagctgtggtgggctccacccagttcgagcttccaggccaatttgtttacctactcaagcctcagcaatggtgggcgcccctcccccagcctcgctgctgccttgcagtttgatctcagactgccgtgctagcaataagggaggctccatggatgtaggaccctccgagccatgcgcgggatataatctcctggtttgctgttttctaagaccgtcagaaaagtgcagtattagggtgggagtgacccgattttccaggtgccgtctgtcacccctttccttggctaggaaagggaattccctgaccccttgcacttcccgggtgaggcaatgcgtcgccctgcttcggctcacacttggtgcgctgcacgtactgtctgacaatccccagtgagatgtacctggtacctcagttggaaatgcagaaatcattcgtcttctgtgttgctcacactgggagctgtagactggagctgttcctattcggccatctataaaatgttttaaatatgcaactttccattgctcaaggcagacaggacccttaattggttttttaacattgaaattcattaactagtttagtaatagttataagaaattttctatgaaccatccagctactggtttaaggccctggggattaagaatctgtccttgcccagtaggagcttacattcgagtgggctagagaatcacgtaaatagataattgcattgcaatttgataactacaataatagatattcaaagtacaatgacagtactacttaccggtttccaaaatatttttgtacttgtctaatggcaagtatgttattttgcaaagatttgtttttctctccggtcaatacaatatacagggcagtggtagaattcttagatggaaaatacgcaatctatggtcaaactatttgggtttaaatgcctggccttaataactggaaaacaatgagaaatcatttcatctccccaagctttatcccagaagcagtaaaataggtataaaagggagtgcttttgggtggctatgtacagtcgatttatgctatcaccttacatctgggtctaagccagcttctcctggcccaactagatcgctcttgcagagactgattgcaaaatataaccctgaattcctcctatacagaaatgcacactcctttgcaatgtggctttcctgctcttcccatcaataggtggactcttacttccctatccccttagtctgggctgggcttgtgacctgctttgatcagtagaatgtggcagaagtgatacttctgaggctcagttttttgttttttgttttgtttcgaggtggtgtctcattctgtcgcccaggctggagtgcagtggcgtgatctcggctcactgcaagctgcacctcacgggttcacgccattctcctgcctcagcctcccaagtagctgggactacaggtgcccaccaccacgcccggctaattttttttgcatttttagtagagacagggtttcaccatgttagccaggatggtcttgatttcccgacctcgtgatccgcctgcctcagcctcccaaagtgctgggattacaggtgcgagtcgctgcgcccggccggagggtcagttttaagaggccttgcagcttccacttttgtcatcttggaatgttgctttgagacctccatggcaggaggccagtcttgcctaccagaggatgagagcccatgtggaagaggacagaggcaacccagcagactgccagcaccaactgccagacatttcagtgaggccatctcagaccttccagcccagctgatgctccagctgaatgtagccacgtaagtgagcccagatgaaagaaccatgagaaataataaatcattattgttttaaccgctcagttttggagtagtttgtgaaagcaatagataattgaagtacttaccgcatacaatccatatgcctcataataaaagtagcctttttaaggtagcctttttaaacacaaactgatttcataaatctgaattcctcatcacgtttttttttatattttttaattgacacataattgcatatatttatggggttcagtgtgatatttctattgatatatataatgtacaatgatcaaatcagggtaattagcatctccatcagctcaaacatttactgtttctttgtgttgggaaaattttaagttctctcttgtagctatttgaaaatatgcaagaaattgttaactgtgtccaggcatgctggctcatgcctataatcccagcactttgggaggctgaggcaggtggatcacttgaggtcaggagttcgagaccagcctagccaacatggtgaaatctcgtctctattaaataatacaagaattagctgggtgtggtggtgcatgcctgtattcccagctactggggaggtggaggcaggacagtcacctgaacccgggaggcggaggttgctttgagctgagatcaggccacagcactccagtctgggtgacaggatgagacttcgtctcaaaaaacaaacaaacaaaaaaacaaaaaaaaaaaaaaccattaactgtgctatagagcactagagcttattcgtcttatgtagctgtgaatttggatctgttaaccaacctctccctatccccacctgcccctatagttcccagcctctagtagcctctattctactctctactttcatatgattaattgctttagtttccacatataagtgagaacacgtggtatttatctttcaaatattttatggataagacctcaaaagcacaggcaacaaaagcaaaaacagacaaatggaattatgtgaagtaaaaggcttctgtacagcaaagaaaacaatcagcagtggagagacagtcttaccacatatatatgtatttttttttttcagttagcttcctcaggttgaaaaacacccatattttttaaaagttgtcttccctacatgatctggcccttcctgcctctcctcaccttatctccttccatctcctctcttatctctattctagccacactcccagaacatgccaagccttttcaggctccgggacttttgttctctctcttttctctttctggaattattttccccagactttaacatgcctgactctgtctcacatataagttctcacctaaatgccactttctcagcaaggtctttgactttctaaaatagttccaccctctcagccagccaaaacttacccaatttccctattttgatagcgcttatcactatctacaattatcttgtttatttatgtttccatttattgtctgttttttccaccttcccaagaatgaaagctccacgaagaccaggaaaagactgatgggccactgtgtgtccagctcttagaaaaaggtctggcacatagtacatgcttagtaagtacacattgaatgggaggaaatagctgttctgaataatgactcaaaataacagagggaaagcatctaacaggggacccaggtcttgagagcagcaccagcaactcaaatacgaacacacgctgctcttcctactgttaccatgtctgaaatgctttctttgtgctggacactgctaagcctaatatgtctgttatctcatttgtttctcatatcaacctcaaagttctaggttctagatttattatcctccttctaccaacaagaaaactgagtcttagaaaagttaaacaactcagataaaatacccatgatttaaattcatgaagtttaactctaagttccattttaaaataatataatgatactctgatttcttttcagattgtataaatctttcaccttttaaaataatacactggactattactgcctgaacaaattactgtttatattattattccacttttatccctccctcctacatgatgataatattttacttatgtttagatcctgaacaccaaacatccagtgaatacagctgaagatgtaaccgactgagtggttttttttttgtggtggggggcacagagtcttgctctgtcacccaggttagagtgcagtggcatgcctttgggtcactgcgacctccgcctcctgggttcaagcaattatcctgcctcagcctcccgagtagctggaattacaggtgtgcaccaccaggcctgactaatttttgtatttttaatagagacagggtttctgtatgttggccagactggcgtcaaactcctgacctcaagtgatccggctgcctcggcctcccagattgctgggattacaggcgtgagccactgtgcctggccaagactgattattaatgaactaattctacctatacaatttggaggtatgggagacagcatcatggagaaacctcatttgaagtgcaccttgatgaatggatgagcaagagttggccaggtagaaaatagcaattctaggggaaagaaacgacatgggaattttttcagtgttgtttttgaaatttacagaatttggaagaaaatgtttcagtaaggaaaacttcctgatggtctttatactgttttcaagttctttggaaacttcagaaacatataaaaagacacagtttttgaaaaagtggaggggaaattattagagagcatgtatcatccagcgaagactaactggatgacattcttaagtagtacttggtgtttgtccttaattgaaagatgtttgtgtggactaggaacatctaaatagacttttcaatctgtaaatgaaatcttcagagcctgcagggttctggttttttaagtaagtatctgtccgaggaatactctgcacatcaaataacttaaatccagtaacatgtgataactgttcagggattagcacactggattctattctctctctctatagatagatagatagatcactcttttagatagatagatagatagatagatagatagatagatagatagatgtgtatatatatagatatatctctctctatatatgtatatatatatctatatagagagatctatatacctatatatctatacatctatgtatatagatatagatcctgaacaccagacatccagtgaatacagctgaagatgtaacccattgagattttttttttttgtggtggggggcacagagtcttgctctgtcacccaggttagagtgcagtgagatctatgtatctatacatagatatagagagagatctatgtatctatacatagatatagagatctatgtatctatccatctatccatctatatctatctatctatctatctatctatctatctatctatctgtagagagaaagagcacacacttacgactggtttatcttaacaggagctttaggatgtctggaaagtaatacagtcttcataaagagaggttgaacattatcaaacagcatggttcattgtgagtttttgttttaagcattttaaacagttgacttcaaattcccagcagatggtggtggcagcaggcaggcactctagtcaatgagaagtcaaagtgaacttttaaaatagttgattcttaaacttggaagaaaaaggagtgaatgttagaaaaaaaaaataacaggtttcctgcaatgcatcttatcatgcacaagtcaaaaaatgagaaacggtacaatttgcaataaacacaagagtgtgtattttacactacggaaatgtaaagcatttaatcagtctgttagcagaaaacttgaatattagctgtcaccaaatccctttagtgtataataacctcagaattgcggaccaatgtgttttcctcccagcaaagcttaccagaagtgttttcttaaagactggcattcctattaataatttaaggtaggaaaaaaagggggtacattttcttcttagtagtccaatccacaatataatgatgatgatgatcttactatacttaataccactcttattgtagtgatttttcttttaatgctatttttggataagaggtaattatttttaattgttaaactactttctatagattttttgagcacttcaaagtctagaattccaggattctgtgaagaaattctttttcagccctgtcgtaaaaaaatttttttgatccttggtcatgtttatatttatcctgtccttaataatattgattataacttctcttttcagtgaatatattatacatgttcgactttatcttactaggtagctgcttaataacagccaaactcattatttatgtcacttatcttccccttttagttatctttgtgtttaggctcctactctatggcggtgaaagcaatggttgtgggagggaaggggaagttgcttgatgtaagtgaccggaaccacaagaaatattcccagtataaagtgaccctgtttgcagattacctttctgctttatttcctatgctgtatcttccattttctaggattcctcaggccatctttgcatggttggtttatcagaatgaagtaaaatagctccggatagaatttggcccctccaaatgccaggcccatgagatagcaaggaaacttcatcaaatgccaatgacaggaaaagagctgtatgtcttacgaagcaggcccacattaagtctgtaggactgcatggcttttctcttgccctagaaagtcaacagatgaggtaactccccacccaactggttccttttctttacttggatgatcaaggggtaaaagtacagctgtcattttagctacaaaggtacctttttacattaaactgaaaaagtgcacatgtgttctgttgaaatgccccctatatatctgttttgaatttcagttcactgaatgttctgaaaattaaataaacacaaaacaggacatgctaatatcttcaatgaggtgcttaattccccatcttaatcagccgttttccatcctgtttctttttcctgcctatctgtcaaatgtttcttaattaagaattattcttaattacaaagtttatgtgtcattttattttagaggtagttaattaaatttaacactaatcattggagatattgccttttctgcacacacattgatgcttaattattggaataccttgaatctcttgactgagggggagtagggcatattgatttgtgtctggtatgtggcagctcgtactgaatagggcagagactcagcccatcaaccagacaaagaagtaggaagctcattttttcttagttgataaaggacagtgaacaaatgcactctggtcattcagcgcattatgtgatgtctctgaggggcatggaagtgtgatgattatggatgacattcgatcctaaaaagaatagccagaataaagctattctttaagagtccttggatacttgttagaatggatttgccaatttttgtatgtatgggattatactggggtcaccctgagcaggtcatctggttggatgagaagcgagatccagtggccagattagaaaaaggatgcattagctcttggttccttctacccaatctttcccctccaacattctcagaccttatctcctgggtcacttcttcagagaagtcttccacaactatatattgcatacctttccttgacatcattcattctcactataattgcaatttatgtggttggatttttattgtctgcctcacccaataaatgaagtatccttgagggtagttgtcatttctaattttgcttatcatttatttgtcatttgcttaactagtatttgacactaaatatattttggaatggattaatgaatgaattattaaatatttttagaagctataagttatttgactttttaaaaaagtattaaatgttcattacgtttgccagcactgtattattaggttctgggagtaagggatggttgggtgaaagtgaatccctgccttcagcaatttataatacaatacaaaagaaactcatccaactaaatataatataagctagactataatatgtggtgtaatagatacatgaacccatctctgtgaaaacacatagcaaatcagccaagcgaggcaaggcttcaaaaagagggagattatttgaaatctgccttgaaggtagttttggacaaataagaactggggaaagggcatgctgggaagaggtaacaagatgagcaagagtcagatgtataaatgaatatgatgttagcaaattgtcaaagattggaaaacatggtggtgctcagtcctggctcggatacagtgaggcaggctttctgtacactgttggcaggactgcaaatgggtagacacttttggcaaaacacgttagaagactcactatttcctcttctagaaatatatttcataaccggagatgtgtgcaattctttatattcaaaattgtttctcacagcatatttgacaaacttcattaacggtctacacacataattgtagtccaatgattacatgaattatgtaataactataggatgaaaaactatgcatccattaaaaattatgtttttgaagaatcatgacatggataggtgcttggattgcagtgtatataaacataatgaaaatctcaatataaagttggataccagttttatacatgtaaaaatacagaggaataaaggaaataacagtaacagtaatttactaatactaattctctttggtggtagattgacaagtacgttccattttcttctgtatgttttctgttttctagatgttctacagttgtaaatattggttgcataataagaaaaacagatttaaacttggatatgttatgaagaaaatgcaatatcatatctatggctaaaatacaaaatgtatagggaatgcttttagaaaatgagtcttgagttttaaaaattatttagactctaatgggggttgtgccttgtattaatcattctgggtaccaggaaaacctgcgagatacggcccgccacccaaggattttaaaacctggctgagaagacaatacataaatatctaatttaataacaatctcagataatagttctagtaataccatggggcaggatgctacagattgccaaaacatggcacataagctatggcctagaagtttagagtagagattagcctattgagtaattatacagaatttctaaatgttttttgtcatctccctgccacacccctggagcagcgtgtgatctcaccagcagtgcaagggcacatgggctctcaaatacctgccatagcaacaggatcaggagatgacttagagaaggtggagaggagggttaagagaccccagaacttatatggctagaggtccaaaaacaagtagatgccactcactggcctgcctgaattacgtatctttccaatggaccccaacctaaatacctagatatgtaggttgtaccttttctgtatatgatgaacttgatatatgtgcaccccttacgtatgtatacacatgtatgtatattctgtatatatttgtgtgtgtgtttgtgtgcataccccatatatattcatgtataaatatatatatatatgtagaaatattttctaataatcactcagtttctattgcaggtgattatataaactctcttaaatggatttgccattttcattatttgttgccataaatttgcttcatcctaaaatactgcttaattactagattggtcaacaacatgtatcttgctataattgaaaaatgacttacattttggaaaagaataagatgaatatttttccagataccttgggaacaaataaattcctccattttgagtgttactgtaaacataaaatactagaatgggatattttttggatattcacttaatgtttttgtgtttgatcttccaatatgaatcgttatccattcacagatatttataaatcctctactaggtgcaaagccattgataagtgttgcaagaaaataaagtacaagttaaagaacatgagtacctgttgtctacagatactgagaattctagaatatataaataacactccttgaccatgaaacatttatgatctcttggaggaatcttgtgaggaaaggtgttgattttgccctcaaggcggttctgtcaaccttttctacctgtgggctgaagagatcaaggacctcttcatggaaaaggtggctcgttcactaggctctaggttacaattgttcttaacttttttttactgaggatgtcagagacccctttagtcatgtgatgaaaataattgtttcttacctgcaaaatttacaagcccagcatcttgtatttaatttcagtaatttatggattctttctaaggtaatccacgtgcatttagtttacagacccccacttcaatgagtagttagaatttggacatgcactaggctaaaaacaaaggcaattttaggtaacaatacagaagcaaagtgtataaagtatatatagaaaatggagagtagctccatttgaatacctggaatgggttaattaaagatctagactgaaaggtaggaattggttaaataaagatctagacaaaaaggatcaaattcctaattactgaaaattgcaccctgtatcatatcatatcatgagtccatttccagtggcctgccttttagctattattagtcatcacttaatccaacaaaagtgcccaatcttcccagtttcatttcaggacaagcctttagcaacaacaaattttgcccttatccttcacggagtagattttctctgccgccagcatccaaatgtgcatttgacactctgaaactgaaggagagactgggacagaccataccaatcactgaccccatcattcagagtgattgagatctgtcttgtcactttcctgtgtggagacattttctctccttagattctctataagacaaaacaatccaccaccattatttttatagcatgcccatctcccagagtgtcacaaactctttacaacaagaaatggaatagaaagacgatgctttgcagacttgggtatagttattttcagacagaaagggaaaatgacaagaagagattgagtggaataaaagtaaagataaggctgctgacttgaaaaaacagtcatgacaagattgatagaccctgcccaaatccacatctctcacctgcacacatgtacacacacacacacacacacacacacgcaggtggatagtctcagcagcttttatcgaaagttttgttgatgatgtggtcttcctgatactagttttcaatgatagaattacatgcttattcttgaatataagtcagtttggtctctctgaacacatgtccacatgttgaagttgaaatgagttaatggatgtaaacatttagaccagtgccttacacaaatgaacacacttcgaatgtttttccattattattgatgttgataatggtgatgaagatgatgatgattaacagtagtatagtattaacttgtttatcagaaaaaaaaaattgtggaacagaacaagaacccagtaaggtaataagtctttttaattattttgacatttgagcaaaggtaaacacatataagaaatctaagacttgcattctgttccttccctaggagtgttccaatatcctttcaggtagtggttatttcttaaaacgtccttttatcaccacctgccatagaatcacttgtgttacttcttaaaaacatggattcctgggctctaccttaaacctaccaaaaaagagtctctggggacaggtcccaaagccagccttttaaagaaattccccatgatgagtcttaagcctacaaatttgagaaaggtgtttacctatcgtttaaagaatcaaccttacaggcagggtttaatctgattaggaatagtggaggggaacactggctctgaaacatctttcaccactttccctgcaattcacactattaaatatttattcctttggtttccagtgtatatataggagtctccatttaaaatttaaatacaaggggaagccattaacatccattagcacaccatgtgagttagggatttgaaagccaatcatttagcaaggcttcaaggggagagtaagatgaatgaatcccattgaggaaaaaagagctaagaaggcagggagcagaataggccagcctaactgaagcattgcagctgagaatcctggacagctaggggagtaaggaaacaatgaattctgcagaccagctgctggaaacaaaaaaaaggagaaattatacaaagtggtataaaatgcttttcaaatatgtttgtggtagaggtggaccccaatgaccagttttgtctgtttctctttaagtgtggcctacagtagagtctaatgctggacccatgcatttgaaggtctaatactgagttaaagatctcggcataaatcctggggctaataacattggaccctgagcaagtcagacaaaattgcacctagatttagctaaagagtatcagctaactttgttttaagaataaacgttttttctcttcacttataaatactagttctcctaaattatttttcaaagtacttacataagcttcaacattttttccttgtctatggtcatatttaaaatagtttaacaaaaatttgttgcccatgttgttttgttgtaatctgtatgaacatctcattgtacagattaaaatgataaaaggaatcgggagtgctcaagcaagaagatttagggggagacaaagaagagaatttacttaaaagtgtaattagccaggccagggccttgttcagggatcagtgtgataatttatacttatctgaacttgtgaaacgtaaagattacattcttgtgaaatgaaaactacatttacttagcgattagcttttttttacatggcaattagctttggtcatgtgtatacatatacattaagatcagtaatatttatctgtcatcttttccttgtgtctacattagctaccatctggtctttaacctaaaaatgtccacatcaggaatcatctttatcagggtcaagtaatgggaataaaaaggcaaggtaacttttattgcagaactgaagaggagatttgaagagaagtaactttggcatcaagaatagagaagtaatggggagtgaatacttgaggtgtcctaatccactttctattaccttcaattggtgataaaaatgttaatgatgatcttcaaattcaagaatacacgtaaatccccaaggaaaccaaagggagcagtataattctttacctgactttcttgcatctagttttatttcagtttaggagctagcactgtcccatacaatacaagagcatttggtcttgtactaagaaaagacttagaaaaattgaagggtccttccaaacaaatgtggctgttttgacaattatgcaaatagtgtgaagattaaaaacccaagtaatcttcataggtcatggtattgatttaaatgagaaaacctaactgctttttgttttttgagttgtgttgggatttttctttttcttagtgtgttttttttgttgttgttgttcttgttgaagcatgacacttatctgtttttccttgctagattaaagccttgctttccctttgttatttaaatcacatcagcaaggaattaaagagccttagagcaggtggctgtggtttgggtttacattagtggactttttgccattatgtttctattccaatttccagtttcagttagcaacattatactctgtgattttgggcaggagaaaacccaaaccacagactaaactgatttttgtttggagaaaatgcacaaccaattcccaattacccaagttgtatttcaatcccagagtgcatggaatgaaaataattgcaagtgtgaatacacacaaaaagaaatacatcctgtacagaaaactagctccctcactgttggtaggagaagaaggatatttgctctggagtggtcagggagtcctgttactgaataaggcccttaacttgagagtacctttattaagaaagcagatgagtgctgtaggggaagctagcaacatgcatgatgcatgcagcctgataatgagatgcccttctagcaatatttaacccttacattaatccaaatctacctccttataactcctgctttttggattaaaaagcaaagtaagcccagtgcttctaacagtatgagagatcacagcaaatgtttaaaggcagtgaccacgtcacccactccacccaaccctacccccgacacacaccccatctcctccaggatatagtttcccggttactgcaatcattcctcagctccaaatctctatgccctttttcctttttctcttttccttcttctcaataaacagttttattgagatataattaacatataaaattgtttgatgtttgcttttgtgcatacattatacaatgatcaccacaatcaagctaatgaacatattcatcacctctacatggttactatttgtgtgtgtgtctgtgtgtctgtgtgtgttacacccttttctcttgatggtctctgctttcacatttcactaaagctgtagtaccccaacttctaagtcctgtgctctgagcacatgcaaagtttgaccatgctatcctctgctgtggactttcttatcacttctataagccagttttagtttatactgacatctgcccactctgggttgaattcctacctgctgtgggagaaaacaaacagtgtacaaatcattgccaccaaaaagtgatggtgtccaagtggagatgctttggaggtcattaacaatatgacctgaggtttaggaatgagagccaagctaaagatttaggtttgagattccttagctcagaggtgttaatgaagccacaggtggccatgacttggtctgtgaaaagggcagactttaaatagggaacagtgatttttcttcagcctagtaatgtttgtccacacagagtttcaatcatttaaatatcaagagatctaacagaaatgtctgtgtttctgatttccgttggtgatataaaaagagtggagttacatgtctgcagtgcggcaatagcctaaagctgagcagacattgccttctataggcagggcacatgctctttggttccctgaagttcccaccacttgctgctcagcaacttcacccatttacatgccagcctgtcttctgtagacattttaatttgcaatatctgatagacaaggccaagcactgtggctcgtgcctgcaatctcagcactctgggagaccgagacaggtggatcacttgagcctggaagtttgagaccagcctgggcaacatggtaagactctatgtcttcaaaaaaaatacaaaaattatctgggcatggtggcatgcgcctgtagtcccagctacttgggaagattgcttgtcctcaagaggtggaggttgcaatgagccaagattgcactactgcactccactccgaacaagatcctgtctcaaaaaataatatctaatagacaatagtaaacatatatctatgcctttgatttcattctctcctgctgatcattcagtcaattttttgtaatcgaatgggaatttaaagtgtgcctttttgatagggttttcatcaagttattagagagatgaaagccatctaatgttagtgtaggaagaaatcttaccaattatttattcattttacaaatggagagaatgaaactcaaagaggccagggcagtgaaactcagagaggccttgttcagagttgacaataagttaatatcacagggaggatagaactcaggtcacactgttcttcctaagtcttagaatctttagctattaacataggtactgactggtatatttgctctcaattgaacagaaaagttgagtacttgtatctggaagggaatcaaaacaacaacaacaaaagataaaaaataaaaatctgtaactactttgataacttattaaaatatgaaaatacagtatacagttattgaaggaattataaacttctttattgcagttgtgtttgaacagtgccttttaaaaaataatctgcttatttctacctattgagagaaatagctattttttcagtattttcctttggaccacattgagttttttccccaaacacagtttgtcattcaaccaaatgaaaaggtcctcaggcaccaccctccacccaagaaccaaaggaatcatttgatgtgaaaggtacgagtcatgccaggctcggcaccagccaattaccgattacacaagctgtattttatcactccaaatacatggaattaaaataattgcaaatatgtgtatacacacaaacagaagtgtatcatatgcacacagctccttgatggtggtagaaggacagggatatttactctggaatgagatgtgattcctgttattggacaaggcccgtaacttgagcccacacttattaacacagcatatcagtgcagacagcttgataatgaggaaacatccagcaaggttaactcttcagcaaggttagaggcgtgaatagtctcatccagttaccagctgaatatttttcagagaatgcccatttccctagttaagtgtttctcaaacttagctccctacgtgggtctttgtaaccacactgggaatgcatggagccatctcctgaacccaggccagtgagctaaacatttctgtggcccagtcactagtgacggttgagcattaagaacattgcaaatggtgacaatctaggaaccattaagctacagaacaggtccaagatgaggagatacgtccttacagaggtctaatgtagcacctgagaattacagaggtctaatgtagcaccagtcatccacagttgagactggaatctagtctaacacgacagagagttcgaaaggttgcagacataagaaagtaacagcagtgtgtgaaacatcacttcctgatttccttgaaagcaacttagttctgactgccaacctccatccagttcttgccaggttgctacggaagttgctttgctattcttatgggagccaacccaacccctagcattgtacacagaaaatggggaaggagatctaaattccagtcaaagttgccactgacattcccattgtcacatcccaagtggttccttgaaatatggctgctctcagctatctgccactagaaaaagaatcctcactgaagttataacatcagtagcttggatagcacctccctaggcacatcatggagcaagcctatggtagagggagcattttggctccatgcaaatgcctgactcccacagaaccacattttcctcccagtccagaggaaacttgccattcttttttgtgacttgcctcaacccatttgtctgcatcttgccagagaccacctgcttttcaatgaccttttaccattccttacaggagaaagaaacagaggcagagagggaaggagggaatggataccagaaagcaattaatctgcaggagagtagtggttcagaaggtcagaatggagcaaactctctgaaatccactctagaattagcagtagagcagctgatataagagacctacatttttcatgtagtgctctggccccagtttcccccacctcctctctcctatacaccacaatacgaatccagggcttctgtaaggtcacagagcaatccttgcctatctccagcacatacataaaaattcttaccggttcactgtttcacatatattctttatgaaaacccagtcatatcctgtgaggtaggggcgtgtgtgtttgtgtctgtgtgtattttttcattatgcccaaaaactaagatcatatgtcttctcatcactttctatttttgttgctcaggggaaaactgaacacataaacttagaaaagcagtcataccagcctatgaggtccagatgagctaataaatgtcctcttgtctttataatctccaattcctgtgataagatattagggcaataggttttccaaagtaaatttatattctattagcaggtagtgtgtattctacagcttctggatattttgctacaagtaacatttcagttaaattatattctctgggacaggtaattagaggtaaaattgctccccttttgggtacatgcatccttccccacgaatattctcatcaagaggcaaaggtggctggagtaaagtcccaagtgtgttcgtttctaagagaagccgtttagcatatcagaatgagcatgatctttgaaattgtccagatacgtagccccacactagctatgggaccttaggtaggttatttaactctctaacccttattttatcatcaataagtgtggtaataatggcaacatcacaatttaggcaaataatcagtatcccatccatgaaagaggttgctgttgctgcctttaccatccttaacaatatcctctttatttatggggaagggtcattatccatcatcaagtgacaaagcttgtctgccttacctcctagagcaggttcagcagactatagcctatgggggcaaatcctgacagttgtctgtttttgtacagcacatggactaagaaagacttcagctgtaaaaaatcaaaaggagaatattaacatttcataacacatgaaaattctatgaaattcaaatttcagtgtccaccaataaagttttattgcaacacagccacactcattcctttgcatattgcctaaggcaactttcatgctataggtgcagagagttgaatagctgtaacaaaaacccttgccccacaaaacttaaaatatttactattgtgccctttacagaaagagcccgtcaatgccctagccctagagaatacagtatagggaagaccacgtgagaaactgcttcatcacaaataatcagctttgcccttgtgatctttggtgtaggtcttgcatttggaatcagtgtttagtttttatatgtgctattttttaatatgtatggcttgtctctgcattggcagttaccccggcatatctcagtttcagttctgagtgaacgtgttgatgtctttgaggcattcctcaagaacgtctcaaaattattagttatattcctttattcctcattgatcatattataaaccaccttacctataatatgccctcatcgtttgttgaaaatttacccagcatttctacagtggtgtaataacaaagagtctgaaacataattttatgtataatatatgatggttgtggtggtggttctgaagaagaaagaggaagaggagggtagagggaaagaagaggaaaaagattcagttttactcccaatgtggaataatagcaggaagtctgttgtgtggctccaggacattatctcagttccaagctgagtgaaatcaaggtgggagttttctccactaggatactgagaatgaggaactcacaggaaagtaatagaagctattaattgcaggatctagtccttgcacaataatatttcatcacgctatttacctggagccattgcctcaggggaatatagtaattagcataactatcaacaacaatagcatgtatgcataagttaaaacatatgtattttgactagcaaattgtctcactaacaaaagagggttagatgtagtttcttggtgctgcaaaaatgtgcaagcaaaataaacaattattagagcttttttctcctgctgtttataattgaactgagctacaacccatgctttttcccattacaaatatatttatgacctttgttcgttagcacagaaatatatgtcaacatatgagacaactggatacctacctgctagggacggtgacatttgttcttactgctttgcagagtatgcaggtgtgatgaatgtcaacaccctgcgtccttgttattgttaggcagcagtatgcaatccacttgattttcatttagtgtgttggataaattaaatctcagattcttaaacttaagtggcacacttggacccatgagaagtattaagtttcttgctatgcaactggcaattctatctgcttattcacaaatatttgaaaatgcgatcccttgactaagtatttttgcaaatagcaggaggaaaagttggcaagaagcagctttgcttctaagagagtttgatgttctcctttcggaaaagcgatgaaaacctacagtgcccggtgctttacctccgctacctatgccctccctgcaggcagttccaataattttccttttcctgccagcctactttctccttgatgaagttcagtgaatatttaagccttgaggattggggctggagagagggagcattgatttcatcagttgttttggaacacgtgggatcttttctatttttccttttgcatcttttttagtatgataaaaattaggattaaatttatctttctgaggcctgttgctgtttatttctttgactaaaatatccggcaacagtatatcatgaacagctctctttcttaaaattatttcgtaaatattttttgtcgcacacacactggcgcatgcaaacactatttcgtttaatcttgtggtgactctgtcaagaaagggaaatagctttatagaaaaattctgaactaaagtgtgtaaaattaagatctctgtgtttcattgtataaaaattttagctcaaatgaacaaaagacctctcatttttatttttattttagcatttctttaccataaggttagagtaactttttaaaaatatggtagcctaaaaaaactaatgactaaaccttaaagactaatttaaaatttttatcaaatttttttctattattttcttaggaaaattctcaaacctattaaattcaaaagaatgttatggtgaacacctgtatgcatgtcaatgagatgctaccttcatgattttattataaccagctatccattctccatccacccatcaattcacctttatttttgatacattgcaaagtaaaccgcaaatatccatatgtcttcctaaatacctagtctgcctatcattaattagtatttgatatttggtttacagctttttgtttctttgagctaaaatttatataacctgaaacacacagatcttaagtgtccatttcttgagatttgaccagtgcatatttctgtgtcaacgaaatccccagatatatcaagatatagaacagagttatcacaaaaatctcctccggtccctgttaagtcttagttgctttaaatcaaatatcagttcaggttgattttataaggttttctttaaaactgtttagatgcaggcagaatacaaaagatgaaaaagacatgatccctaccctctaaaagcatatagatggtgacaaaaaccaccaaaatagaaaatttcaattttcaatatgttttaaataataacatgtggtagatgctatggaagcacctagcagtgtctgttcatccatctggactctcaggaaagggttttggaggagaagtcagctttagtctggagagaaaaaatgaataaatgttagccaggagaaaagaatgataagagaaattgctccaagaaatagagtacgtattttaaatcagtttctgctgttctagtgtttgggagaatttatgaatcagagcacaccgaggaacttgcatcgtcctctcaagaatactaggaaacacatcacaagaattcattgataaactgagtctctgtaccccaagggtatttccactgccttccaccttccgagttgctgggccccaacttctaagaaggacacttctcaaaccttcagtggctcctgtttgctgctattattagacacattcttcttatcctagcatttctaggtgcctttcatcttcccagtatagtcctaatctgactttgccccacttccccgtttacttacatcttatactcaaattatattaaactctccagtcctcatactttcctgctaggatgcctttgcccaagtctttgcctgtttctggaatcctctctctttaatgtctacctttcataaccccgttcatctgccaagtctttccccctgcccatcagaagccatcttgtctaaaaactcccatagttccttgctcctaccattcccacttttaaagccaaacacagctgttttgttctgctgtagctgacaatgtctagcacagtgctcagcacaaagtaggaaattagtaagtatttgttgaataacagtgagttctatcttatgtcagtgtgtacttatagatctagagtttctctaaagcagagtctgtgttctatacttctttacattcccagaaatcataaaggacagtcaagaattgaacaacattggccaggtgcggtggctcgcacctgtaatttcaggactttaggtggatcactttaggtcaggagttcgagatcagcctggcaaacataacaaagccccgtctctaccaaaagtacaaaaattagctgggcatggtggcagatgcctgtaatcccagctacttaggaggcgaggcaagagaattgcttgaactcaggaggcagaggttgcagtgagctaaggtcgtgccaccgcactccagcctgggcaacagagtgagaccctgtctcaaaaaaagaaagaaagaaagaaattgaacaacattaaataaacctacaatgctattctaatatctgagctgtagcattacagttctatttatatttaatacaaatttaaagaacatgtagtttgaggagtagacctcacaacgtttgtttttgtattagtatacttcaacccctctcttactacccctgaaggcttataaatgaaccgtttggttttaaattttaaaaaggaatcttataaattaagtgcagaaagaaaatgggaaagtccttgatatggtaaatgtttagttttggagagaatatcaatgttatttatgtagtcagtgcatctgttgactgactacctattacatgccaggggctgggcaaaaagcacctgtcctggtgtagcactgtttccagtataggaatatcttacagcagaccccagagaaagagttggactttgtatatttgggccctttgatttgtgtatgagaaacgtattactgagtgaatggaagccttctgattgcagataaccccaattattggaaagttcttctttatagtaagctttgtactgcctctctctaacatcttccagccagccctatttctgtcactggagcctccagaaccaagtaaacccctcttatgcacagcaccttttcagtattgaagatttacattacacaccctacccccaagcctcacctttttcagaccaagtatatagaactcaaaatactttttcaaaggaattggtttccaaattgctgtttgttttttcttaaacattttatatcagttccaacatctgatgtcagtttgatgtcctcctcagtttattctgtaacaggttttgtgatagacaccagcagagggatattgggggttgtggggaagggatgttatagagaagacgaacagagcataatctttgttgtcctaaagtatatacatggcaggagaaaacaatcactttgtcagatcatttcaatatgatgctgcaagtcatgtcagagataagcaatgggtactgtgggagcactcgggtaatctagtccaatctgggttttagggaaagaattttagaagtgtcaccagagttgagtctgaaattatgagcaaatgttttccaagagaagaatgataggaagggagacaatagaagttaaggcactgaggtatgaaatcagtatagggtggtaggggtgggggtaatgacactatagttacttatgtgaagtattagctcgagaatggcagaaaatagggcttgtgaggtatgtatgtatatacacatgtatgcattatgtgtatatgtgtgtctatctctgtaagtgtgtatgtaaatacattctgattttctaattcttagattttgccccaattctcttgttagaaattagaattttggctctacggccaaggactttattcagcatattagcttttcaagagatcataaataatcatcgttgataactataatgacctgaagtgttataacaaataatttctgcgaagtggagttttaggtaatacatatcattaaaggcattgctatgagttgaatgtgtgttccctccaaagttcaggttgaaacttaatctccatcatggtggtatgaagagatgaagtcttttgggaagtgtttaaatcatgagggcatcacatttatgaatgaattaatgcacttataaaagaggcttcaaagaaagtttgctgctttttgctgtttggctcttctgccatgtgaggacatagcattcctccccttcagacgacacagcctcaaggcaccatcttggaagcagagcaaggcctcaccagacaccaaacttgctggctccttgatcttggattttccagcctccagaactgtgaaaataaatttatattatttgttaatgacccagtcttaggtcttatttatagaatcccaaagggactgagacagtatagttataaatcaatgtcaagtttcttccagtttcttaatatggaggtttgccatttgaggatgcttcattgcttctctgacctgaataaagtagcatatatgattctcattatactattgatatttaagggaacggcttacatccatttcataagagttgtgtctcatgaattatttgtattccagaaaccaaactttgtctggagcatcccaatttaagatagccatttgttaagttaattgccatgaatgggtgacatttaataaagtatgtgaatacttaggaacggaaggttgcgaattaaaaaataaaattattctcctctttattcagtttcgtatatcacttaccaaagctcaccctgcctattctatggtgtttgagttcatgcatccagacttgtgttaagaagaagggtgacaaatttagaattcacagtgtgtgttgccatgggaaatacaacaagctattaagaaattgtcttttcaataactttttagtgtaattaaggagatcatgcatatgctcctggaaagagagcctgtagtattgagtactagctaagtgctgtgggctgtgtagacaatgtctgtggtatgcctgcccagtgactgtttctcctgcttttgcaatagcattttaatttttctttggagaactatacctgtcctattttcagcagtccatttgtttttttctgagcatccgtctctgtctcccagacttaaagagatccaggttggaatactcaaaatccaccctcaaacttgtgctgaatctatgtggaaaggagatgtgcctactcattaccatgtttgtggtggcagaatgtcaggttggggttgccagtgaccatgtttgtccccacaaagaagagcctacctgaaaatacagacagcaaaagacaatggatcttaagtctttgcaattatatcagacaatatatattttttcttaggctagttaaagttctccatcacttgaattagtcatggtttattcagagaagcaaccgatacgatgcatagagagagagaaaaaaaaagatacttattttaaggaactggctcatgcagttgtgagggctgtcaagtctgaattgcacagggcaggctggcagtctggagattcagggaagagttgatgttacagtcttggagtccaaaggcagtctggagggagaattccttcttcagggatctcagtcttttaagactttaaactgattggatgaggcccacccacaggttccagggcaatttgctttatactactgatttaaatgttactcacacccaaaaaacaccttgtaacattcatccggactgatgtttgactaaatgggtacgatagccaagccaagttaacacatgaaattaatcatctcactcctaaatgaaaacgccgtggctaatctatgcagtaactactatagttgctcagatgttgcagaaattatcacaggactgatgtagtcaggagaggttgtcaagagaacatactatttcatggtaagttataaaatccatacttttactattttgtaaataaggaatatcttttatggctatgagaaaattgaataagctgatacacatgggaggcacctaaatatttaattttctctcccttttcccttccatttatatatttgagtttctgattaagcctgtgttgtacctgagtctggaactttgcaaggcactttatgttgaggatttatgttttagagattaaatgacttcatgcggaccacgccgtaatctaagggtctagagctcagagtgaccacagcgaaggcactgagccttgtacttattttacaaataggaagctgttctctgtggtgattaattttttaaaaattaagtttcagtgctagtgttctttgccagtcagatgtctacatatgtttctaagtccgtacagctagaaagtgtgtgtcaaataaaagagttgaagttacttagctcctggcctcatatctatttcatcatgctatttaggcattcttttaagatataaaaagcaaaaatatgtaaaaatagccatttctacatggcagagtctgttttaagagcctggccaacactttgggaggccaaggcgggcggatcacctgaggtcaggagttcgagatcagcctggccaacttcgtgaaactctgtctctactaaaaatacaaaacaaaaattagccaggtgtggtggcaggctcctgtaatcccagctacttgggaggctgaggccggagaattgctggaacccgggaggtggaggttgcagtgagccgagatagtgccattgcactccagtgtgggcgacaagagcgagactctgtcttaaaaaaaaaaaagaacctgggattgttagattgttagtatacctgtcccaggtattttatttctaattgggagactagcttaatgcttggaagaatttgatgatgatcttttaaaatgtcaccaaatctaatcactcagccctaaaatacaccctcagggtataacttcagattaatgaggactaagacttgttgggagggctttggagtggaaatttccaccattgttaatttgcaggaggacatgtctgatgtgtttttgtgatggtttcacatctgacagtctgtctcctaggcacctggctgttctccactcggttccttcctgaatgttgcgctagattgtcaaatgccacttcagactagatctgtgcccccgaaagtcatgtgcaacttcatgaaaaaaatctacctgacattttcaaatgcaactcacttgaacttgtaaaagtcaggtgtaaattgagaatagatttgcacctaagtcttctttggttgatttcagtatttgcttggaactgacatttggagaataactcagttgccctcagaattggtcccctgctcactccaaagtgttgtcagggagcgcttagtgtccgaatggctagtacagtatgcttcaggtgaatttcaggcacttttatttactgggtttggaccagtttggaatggaaattaacaatatgtgaattcagtggtttcaccagtgtagcctcttgagcaaaccttggacactgaatcatatttgttgcctaaagatattaatgattatctggcttagcctcatgggcctgattcttcttcaacagtaatgtgttgattattggcattttagacatggttggtattatacagctgaatctctgcacaaattcagagcagctatgcaggcttctgccactgggtgagttgatgaaggagatgatgtctcctctcataatgctgcaccaaacagatggaatggcaagctgtctatgactctgagtatctctgaacatgaacctgtccttctgcctaccctaatcattccactttcacgaagtgcatgcactactgagccacagagaaattacacagcaagcagtagacatggtgcctgaaggcaatgcaactcttgaactggaaatttagcacacatgtgaaatccttcgcagatacaaagccgttcttagactattattttcaaaggtaaaattagagatgtaataaccttatgagatcatcatgtccagttctctcattctagagatagtaaaactgtgatccagaagttaagtcccttacttatggttatatatttagaggaagagatggggcaagaattccaggtccttgcacatcacagtattatccttctaatagagggtgaccaatgaatgcatgatttggtttgtaagcaaatgtgaaatccagagattttcatcatttccaacaatgcaaaaatgttgaatcttagactagaggctctttgacctcttcctggatttattctgtttctctttttacattcctgcaaggaaggactcttgatatatttttgccttgtagaaatattcatttctaagttggtttgaaattagcctgtcatctgattcactgagatagagttaaaataaattcccctggcaaaaaaaaaaagaaaggattttatcatctatatggatcaattccaagagttcgcttcagtttactgatccgttttccctacagtataggatattcaattaaaccttccctcaaattggccatgaattttgatgaaaatgaaagaagtttcgtttagcaaacagtttctatcagggactataataatagaatgcaataagaattattttcacctatgcacctgaacgaacatgttttgtctggtttttggtttgatttctatctgtatctttatttttctctttttgtttttcacccagattttgtgtagcttgtccaaagtggttgagatgtgggatcaggtgaaattgctcatagatacaataatgcttcacaccagtgttttcaccactgatttagtagtgtctttgataaactcttataatattccatacttacatctttctgttttaaatagaactgctgggatatgagttatgtctggtactcccttatttttattaaagcatatatagaaatttttcataccctttgcttcaggccttccttgccccacttagcatctgtagagtggacataggcaggaagagcccactctacaaaatgcatccagtatattttgagtagagactgattatggttactgatcttggtcctggaaatgagaaatgaattagatacagatggtacctctgtggaactttagagcaggagatgaagcaaaacgagggagaagacataagtgaggataacagcacacaaagtggtgagcattgccagtgaaaatgcagtggttttccccccagcgtggggtatcatagatgaaagggcgtttgagctgcaattcagaaggttctgaagatccacttatccaatttgtgttttgctttctctgtgaatggtttgagccagagctatacagggaggtgggcagtggggacagcgcatgcgtagcattttcacaaatgcttcatagggctagacagcagtggtaacatccttagccccaccccatgttttacagatgagataactggggctcaacaaggttaatgacttaggaagtcataaacactctgagctttaagccctcatcttgtgatttctctttcatggctgttttcaggaatccttaattattagattgctgcaaaagtaattgcagtttttgccatttaaaagtaatggcaaaatccacaattacttttgcaccaatgtaaacaggatttttatgatacaagtaactgaaactgactctagataatttaagtgaaaaaggaattgattgaaaagttagcatgagttctccaaaattatggagatcttagccagattcagaggaaagaagccagggtagagtgaaaggtattaggcaacaataagatcaacagcattctcaggaaaacctggccagtagaatgaatgggctctaagctttgttgttttctatctctgtattattgctcaggatccaaaatcagagagaacaatgtctgattgacttactttgaagatgtgccagtggccacccgtttgttaggggagagctaggcatcttgatttacaccctactgtgacagcacccataagtgaagaggtaatgccaccaaaggaaaccagagtggatgaccagcaaagagcatatgtccactgtgggaatacaggcacatgtaggtaaaagaacaaacgaacactgcaagtatccgtatggataaagcaacaaatcattttgtaggcctgagttaacaaatgtgatgtagcatattttcattataatattaagtctatgacaaatatattctgtgctcagccaaagttggtgaggcataacggcacttcttccataagctatggctacttgttcctccttgtgccctctggcatgcagataattaggcaaaatttaaaacagcttgaatgtagtagatgctctctatcaaggtgtgagggttaggatagcatttacccccaggcttaaagtgttctaggacatcttttgggtgagctccctccagaaagaaaaagtgttcctgagaaagggcagtatgattaatcttacctagaggctgaagcacatggtgcatattcacgcaatcgttcatgtgcacgtgaactgtatggaaggatatagctaaggacaaaaaggagttttccagcacaaattgagcacattaggctattatgaaaccattagagatttcttttgtagtttgttccgtatacagcagtctcttgcctgacttttcaaaggaaatgtggtaccaaagtagattccaagggtaagacccagttatcttggttagagtgtcctttcttgatattctcaggaatgtgttcttctggtaatttctgtaagttttcaaatgaaatgggagttactattccaagggttttacaggtagtatctaattcaattatcacagcactaggcaatagttattcttattatcctaattctacagaggacgaaacggaggcacagagaaggtttagtaaattgcttaagatcatcccttgtgcatttcacaagagcagagcaggagtagtctccccttcatatttacgtcatgtatgcctaatatagtacctggtgcagagctaagattgaatgaatgagtacataaattagacatgttatggtacagtatgagtatatattgcaatgtttgtgcatcactgaatataatagcttacatgaaatggaaaaaaactacctagccttttaaaatgtgtttatagttttcatatccattagctcatttgatttttataagacatgtatttagttggagggtataattattattcttttttaacttaaaatcaaatctcagagaagatggaacttgcccatgtgaaacaatcataacagttcctcattataaatgatatagggtactatgggacaaagaaatcttcagtaactttcagtatctaggaatctagaaattccacatattagcatagaaggcccaaactagaaactatagataaaaaataaaaccataaagaagttattaacttaaataaacattaaatgaaagaagaaaacaaaattgtaatcatagttacttgtaaaccagtgataactgcacaatacatcaaaattggcagaaaatgcaaaagccattcttagggggaaaaaacatagccctatatgtgtttatttgaccaaaaaaaatgaaaataaaagagctaagtattacactacaaaatgtgtttaaaagatgatagtgtaaatataaagaaagcaggaaaaaggaaatttgagtctagaaaatctccatataattattagggaagaggagaagagatgagaaaaaagaactaggcttctttccaagattaagttgatctgggctaggcatggtggatcacgcctgtaatcccagaactttgggaggctgaggcaggcgggcggatcatttgaggtcaggagttcaagatcagcctgggcagcatggtgaaaccccgtctctactaaaaatacaaaaattagccaggtgtggtggcatacacctgtagtccccagtactcgggaggctgaggcaggagaattgctggaacctgggaggcggaggttgcagggagcctagattgtgccgctgctctccagcctgggtgacagagcgagacttcatttcaaaaaaaaaaaaaaaaaaaaaaaaagttgatctggaacacatgccctcttatacataataccatttcaagacccctttaaagtaaataacaataaaatagatactagaaattgaaagtacgatatggctctaaaagtaaaatcaatttaaaaaatacaacaaaaatgatttccaatggcagaagaaagaagagaaaataagagaaagaggacaaaacaaaggataaaatgggttatctaatgcagtgacaaaactggcatccttttctggaagaacttcatagggtacaggctggaagagtggttctcttgaacaggcatcagaatcacctgcaggacttgttcaaaaacagattactattcccactcccataaaatatggatttagatatagaccataagattgacttttaaaatacatgaataggttcacatttttataagacaggaacatttacagaaaatgaaatgagagatgttcaatacaatactttaagatgtaatgtatcttattaaaagtggccatagatgacagttgaagtttaagtcttgagaaaactatgtttcttacagaacattaatatacattttccttaaccatctcaacttacagtctaaacactgcgtgagtgatgataggatcaaagataactggagcattgtattaaacatatatttaatctgagtcctcaagaaagtgttgcaatttaaatatatatagacagacatacatatgtgtgtatatatatatatttattaattattaatttgttatttattaattccaaaggcatggtacagagagctgcataagaattctcagctggctttgggaggccgaggcaggcggatcacgaggtcaggagatcgagaccatcctggctaacatggtgaaaccccgtctctactaaaactacaaaaaattagctgggcgtagtggcgggcgcctgtagtcccagctactcgggaagctgaggcaggagaatggcgggaacctaggaggcagagcttgcagtgagccgagattgtgccactgcactccagcctgggcgacatagccagactccgtctcaaaaaaaaaaaaaaagaattctcagctggttaatagcacagccaggtgtacatttgattttcaatatatatatttatatctatatatataaatatatatatataaatatataaatatgtatataatatataaatatatataaatatataaatatatataaatatatataaatatatataaatatatataatttataaatttataaatttatttatatatataaaatttatataaattttatatatttatatataatatataaatatatatattatatataaaaagtatattatatatatttatatattgtatattatatataaataaatatataaaatatataatatatacaacatataaaatatatatgatatatatgatatataatatataatatatatttattatatataatacataatatatatttgttatatataatatatataatatataataaatatatataatatataatatataatatatgtgtttatatataatatatattttttatataatatataaaatatatattatatataaaatatatgtaatatataatttataaataaatatataatatataaatatataaaatatatattatataaaatataaaataaatatataaaaataaatatatataaatatacatatttatatagatagacacacaaacatatatatataggcttttaaaacactaagtgtaaagttctcatcttctttggtagagattagacatctattaatctagcagaatagccaaatgactacagaaaatcatttttaaaatacgctttatagaatagggggaaaacccagtgacataatgcataatgcctggacatcacaatagaatgtattttgtgttaatacattctgtggtttatgcccaacactatgatcagtgaaatctgcctggtttccatccactcagactacactccattgtcatttctgagaaaatagtagcatgattacataaggaaaaatgatgcatgaggatgtcttgttaactttaaggaaggtgctctaaaatatgaatcagcatatagaggtggttgtattgatttttagtattataatttgactctgaagtcacatttgcaatttgcgatttgcaaaagagagtgatatcttgcatcatcacatcagaccacatagtttgcacactttatgtaatattggggaggtagagtggggtggatatttcatcgcaaatgaaaaatgcaacagtttgtttctcgggtgagctacctatggttatttaatgtcacctgccatagcaaaatactgcttaatctatatgactgggtagatgggtgctaaagaacaattctcttttaactttgctgcatgtttaaaaattttgataacaaattgctagggtaagaactaaaagatcacgtagattccagagccaacctaccaaatttaaatttcatctttcctggtatgaccttggacaagtctcttaaggtctctgtgcctcagtttcctcacctgtaaaataaacactcattaaattgtaatgaaatttgagttaacattttcaaagtgcccagaagtgtaactggcatggggaagcactagattatgtgtatgtgtgtgtgtgtgtgtatgtaattataaaataaaacttcaagtcccacagagtggctcatgcttgtagtcccagcactttaggaggccgaggcaggtggatcgcttgagaccaggagttcaggaacactctgggtgacatggtgaaactccatctctatagaaaaaaaatacaaaaaaattagacgggcatggtgatgcatgcctgtagtcccagctactcaggagcctgaggtgggagagtcactggaacccaggaggttgaggctgcagtgagccgagatcacgccactgcactccagcctggatgacagagcaagaccatgtctcaaaaaaaaaaacccaaaaaaaacagaaaacttcacctacaatttggtaaatatccttgtggtttgtttttacttgaaattataggaatttaaattcaaaaatcttttaggactatttaattcaactcttaattccaaaggggtagtacagatagctgcataagaattctcagctggttgatagcagagccaggtgtacatctgcttttcaaattgaaagtcccctaatattgctaacacactagaatttatcttttggcagtggcagggaagagaagttagcagtttttgttattttaacttaattaaatattgtttgatgcttctttttcttttgttttatttgttttttgttttgaggcagggtcatgctctgttacccaggctggattgcagtggcttgatcatagctcactgtaacctcgaactcttgggctcaagtgatcctccccctttagcctccctaagtgctgcacataccaccacacctggctctgtttgatacatttaaataagttaaaatatgtttgaattttcacaactctgactagatgtcatgtgctgaagcatttgcgagtaaggtagcaaatatttagctataatttaagctaatgaaatgagtctgaaaagaatccaataaattataatatgttactattacttcccataagtcattttgatatatggtagaattttaaaaatgattacttgttttatataataccaattcattctattattggttcttttggatgctgagaaaacaaaatatgaatttaaccaattgccttcagggtaggaagctgatcaaatacattatctttaagattggcctgtattatatttcaaagtttcaatgggttaatctcatagttatttacttcaaaatgaaggctggtgacatgaagttaaaatatataattctgagctttactacttaccttgaaaaactaatgatgacaagatatcttcatttgctgatgatacaatggcattttaaaaagaaatggggtttccaacaaaaagtaatcatttacatccaaatacgacttaaaaggtaacccatatggaccacaagaaatgattataattatctggaaagataggaataaaggattaccgtaagagactctgtccattcttggaggggatacgttctctagattttagagaattaggttatctctagctgctgtgcggaagctctgggagataagcaatcacttcagtgacaaaactgtgaagttttaataaaggagcccattggtatgggactgaggctctaaaactgtggcctgatgtcccacatcatgaatattcaaaaccttaaatctggagaccttcatgtacttcctagagaggcaatccattccctcctacccagagagcacgtccatgcacgcaggcacgcgcacgcgcgcatcacacacacacacacacacacacacacacacacacacacactgcccagaagaaaatgataggattttttcctagcatgaaaacattattattctataataagtacacaaatgcagtttttatgttgaagataaatcttttttaaaaaggaaactctccattcctttgtaaaatattgtaataagagaacttttaagtgtatacccaatcatgtatggatgatctcctgtgtcgatatcgcattgcagaaatccatgtacgtattttaatgggcgttgctacttggatcttcagaatacatgatatatctcttctcagatatctcatagaccatcccccctctgctgccactgaatttcatttagacctcggtggctgagtttttaagctagatcgttacaaatgaagccttaccatttgatgaaaatccagcaaaaatgcatattgcatttacaacagacaaaaccaaattttattggtaaaaataactatttcttttagaataaagaatgtatttatagttttgttttgtttttaaatcttgaaagagacctgaatttataattagtacagtgtgattctcaaccttggctgcatattagaatcatctgggggtccttaaaaaatactgatgcgtaggtctcacgcctggttaggatttgattggtaagggtacaacctgtgcaccagggattttcaaagttccctcaggtgatcatcgtgtgcaatgggggatgggaactactgaaacctaatccccgcaattacagggttttatatcgtttgcctcaggctaaagatttatgccagacttctagaccagtctcctttccaattccataaaatgaacaatttcacatattgaaaaatgtttttaataattaatcatttaaattccacaatgtggctgggtgcggtggctctcacctgtaaccgcagcactttgggaggctgaggcaggtggatcacttgaggtcaggagttcaaaatcagcctggccaacatggtgaaaccctctctctactaaaaatacaaaaattagccaggcgtggtggtgcacacctgtagtcccagctacttgggaggctgagccaggagagcccgggagtccagcagtgagctgagactgcgccactgcactccagcctgggtgacagggcaagaccctgtctcaaacatataaatacaaaaaaaaaataagaataaactccaaagagcatgtttccacacttaatgcttattgctgaaaccctcctttgttaacattttaaattgtcgctctatagatgtcattagttttcctcttgaaaaggcactgattaaaaagtaaattattagcactaggtataatattagttcgaaccacagttagtaaatacagaacatgctatctaatgaaaatgtcttatgagcatttcggggcatcactttacatgtgagcaattttggtttttagttgtgcagtctgtgagagtgattttgttagttttgcaggcctcagaaaactccagataatttaatggcacccatcctgtataggatgtgtgtaaagcacttcacaggttgcctatcttggccaaatgtaagaagcaattggagaggcaaaggaaaaagcagtcaggaataatattaactgtgcattattgtggcagctttattctggcttttgttgtattttaatagtgacagctgcacccagaatttcttgtttccataactagtgcaatttccttttcctgaaagctctgtgtagttataacctggtcttttgttttcctgcattgactaaggaaactaattttttttgttactagacagataaaagacaagtgttaaaaggtgtcaattgcattttttttaatatggagaaagtgtccaatcttgtggtctgtcttcaactaattttagatatgattttatttttctggccacccgtggacttgtcacaaattaattaaatgcttcacttcttttatctaattgaggccatttctacctctgatgaataatttcataaagtttgttacaaaggaaaatgctttctgagtgatagtttatgcaaagtaaacacacagaacagctctatttgaacctttgcttgtggcaaaggctttccatacactccacaggaagttgttccctctcaaagaaggccagtgtcttccttttttaacgtacagcatgaaaatgtacttgaccccaagcttcaaagcagagaagtcagctttatctagcagggacaatgcgcattaaatcaataaaatggcaggggtatgaaaccagtggaattgggaattggattccagtcagggtcaatcagcccaaagtagagatctaatattttctgaatgaactgtttgaagcactggccttcagaatcattgtcagtttttgatgacttcctcaggcaacatagtgtcacacacagcaagagggtcacaaacccagatgcctacaggggccggatacagaaaagaaataagtgaagctggctaggtaggagatcatagacagtgatggagactcggtcaggactttggtcagtgcctgggtaatctcacacagtcagcacatagtgagttccagccagtttctgcctcctgggaatgctggagtgttacaaagcctcctgattttttaagagccgctatgaatcttttttcttttaaatgttagaaactcatttaaaatatatgaaagcagacaccagccacaaataggtatttttggagtcagagtttgcataagactttagatatgatatattccaaattccctacttttctgaaggaagaaggagggaagaagaacatcaagaattggaggacatttaggatgatggcaaggcctctgaacgtacaaaaagggggtttccatcagcaccactcttcaaaccagaaatgctaaacgcagagaggattaacatggcagaaggagaattactcatttagtatcacctctttataagcaaggagacttgtctagtcacccaactgctgagcatcagaactgggaccaggcaatactcatagtaaaattagaaaacttgtgaaaacctcagggagaatataaattccagttcattctataataaagtctcaaagaccaccaagggtaacttgtacaagtcctatcattagttagggacagagcctatctaccagttgtatatggtacaaatatttttgagcatatgaatatgcaacaatttttttaaaactcttccttcattatattaagactttttaaaaaatgttatttatgggatagtttatttatcagagggctgctgggttcatctactctggctgctaatgacagatgaatcaccattcagcatttactgaatatacattcattaaaaatgcagtctatggaggctctgtagaaatatggaaagttgttatcagtgcaaaacttgaaataaaattgtatgcacattgttataactatttttatagttgaattgcaaaaacttggaagggaaaacaccaaaagtatctgttaaagaggtgaaattagaagtgattttttaaaaagtcttctgcattattatatggtgatattaatttcaatttaaaaatatatagccacgaaaataaattattacttgaacaactattgaaagtccagcaatgtgctagttgccatagggagataaaattctattagctagtatagaggagaaaaggtaacatctttttctcacccattgcagggttcatgattaagatccctgtaacagaaaaccagattaacaacagaaaagcatacagatttatttaatataagttttatggaatactgaagcctacagaaatgaagacctaaataaacagggtgtaatgttgtaaaatatatatttggtcttcatgccatgtcctggcatatgatttctaaaatctttggaatctccaaagtgctgtttttctgtatgctaatgttgactgaccacttcaagatgggtctggtcaccagaaagacaaagtcatgcttagaggattggtactttcaaccccaacctttggggaaagaagagggactgaaggtcaagctgatcaccagtggtcactgtcttaaccaatcatgcctatgtaaagaagccttcataaaaacccaacaggacagggtgcaaagagcttccagaaagctgaacccatggaggatcctggagggtggctcacccaagcagggcgtggaagctccacgccccttccccaatacctcgccctatgcatgccttcatctgtatcctttgtgatatcctttatgataaccagcaaacattgcgttcccctgtgttatttgagccactctagcaaattaattgaacccacagtgggtcatgggaacctcaacttgaagccagtcaggcagaagttccagaggcccaaatttgcaactgatatctgaagtgggggagcagttttggggactgagtcttcagcctgtgagatctgaccaggtatattcaaaatgatatagaaggacccccaagtggtatctgctgcagaattcattgctcacttggtggtgggaagaaaccccctcccacgcacacacatttggtcacagaagtcttctgtgttgatgattgctgtggtgtgaaagcagagggaaaattgtttcagttttttctaaacacaaggaaaactatttttatgtttacatttgatgaagagtggaaagtcgtatagagatatgattgaacaaaaaggggcatgatctaaaggaaataaacgggggaacttagcacggcctgtttgttcagcttctccttagagtctctaccttcattcctttcctctggatatagggaggacccctctggaatgcaggtcttatgacctactttagatgaaggtcagaaaatcttttatgtcctgcttcaggggagaaccacaggaggagattagaaagaccttcctgcttctgctgtttgctgaagtgacaatatgccatattttggggtagcgtgtcctgaacctaatcaataggctcacttgtaaaatgagaatgttgagagataatgaaataattatagaaagaaagaaatctgaaatgaatgtacaaacaataggctttagattctcacagacctggatttttgttctcagctctgtcatttaggcatattgccttgggaaaggaacttaagtgttcacaaagtctcagatttgtgatccgtaaaatccagatgatgataataccttcatcatggttgaaatgagacaatgcatgtaaagcacttagtgagaagcctgtcatggagacatggccgttaaatgttagctattttcactaccattgtggattttatccttctacagaactagtaataataatcataatagcactagcaatctagtaattatagtagtgatcactcattattgaaatgggctccccctgttggccaggcagtgttgggacttttatctgattgttctctaaatttcacaacaatttttttaaaaaaatcagtattattaataaatattattcagtactatttataaagcaggtgagactcagagtgtaagtaatggttctaacatctcatagctagacatagaggagctgggatttaaattcagacatgtatgattccaaacagttcttcatactgttctgtagaaaaatctatgtgtagccctaggaaatgatgtgactttatataagcaagagcaagtggggaagtgttggggttggagatgtttcactggttgggttgcctgggattggatgctatgccaaaaaagaacctaagagtgaaagaggaagatagcacctgtggagtaagccaggctgccaatgccaaggaacccatggtccaaagaccaaaccaaacaagtactcagccccaaagacaaggcaattataggcaagcagtactcaatgagaaaaccaaccagaacagaaccagagacagccagtgggagcttactcagcctgtgttcattcccgtcggggttgggagtggtataggaaaatgtcgtcgtttatttatgtatttttatgttattttggagacagggtctcgctctgtcacccaggctggagtgcactggcactattacagctcactgtaaacttgaactcttgggctcaaacgatcctccttccttggcccccaaagctctggggttacaggcatgaggcaccacgctgggcccagttcgagagtattcataacattggttgggcaacttgctttggaaggctgtactatcttgctttatctgagatattcaagtgcttttaagatctttatcaactccaattagacttcaacagcatttggcagctttctacatatatcgtgtttcaaggttgttgatatctcttgtttttatctatggtagagctttcacttcccttttacattctacttgttgctttagggtgatctccaccaggaaaggaatcaataattcgctttatgtacccagtagaaaactgtatgtttctaaaaaccttctaaaggaagcagctactgaaaaacaacataataaaaggaaaatgaattgtgaaaatacatatgtaaagggataaattgtatatgtaaaggaaagtaaaagccaggagcctattttacattatacagccttataatttggaaatttcttcatagcatcattataatgtgaggcagtatggagtatgattaagggcatggatttttaaatcagcaacctctgtttaagtcctacctgttactttagcaaatcagttgtcttaaccctttatgtaaaaaagggaatatcagggggatttatcttacaaaattgttttaaggattaagtgagctactctatgcaaagcacatttcaagtccctgtcttagtcagttagagctgtcataacaaaataccataaactgggtagttcgaactatagaaatttgtttacttagagttttggaagctgaggaatacaagatcaaggtgccacctgacttcctttctggtgagggctctcatgctgacttgcagacagatgcctttttgccgtgtcctcacatggctgagacagtgcgagctctttggtatctccttttatgaagacagtatcatgtcagacaaaggctctaccccatggcctcatttaaccttaattacttccttactttagatataggcatactgggggtcaggatagcaacatctgaattttaggtgaacacagttaagttcacagcagttcacagccatccccattacatgttttaattttatttgtttatttctttttcgagaaagggtctcactctgtcacccaggcttatagtgcagtggcatgatcataactcactgcagcctcaacctcctgggctcaaacgatcctcctgcctcagcctactgagtagctgagaccacaggtgtgcgctaccatgcctggctactttcttcactttttatagagatagggtctcaccatgttgccccagctgaccattttttaatataccaattaaattcaccaaacatatacttgtttaaatttaactcaaagatataacttctattaacatttcttaatatattgtaattgagataaagcacagcattatcatatatcattattgtatattatatgatatatctaatattattatattattattatgggatttatcttacaagattgttttaaggattaagtgagatactctatgtaaagcacattgcgtagtccctgtcttagtcagctagagctgtcataacaaaatactgtaaactgggtagttcatagatgtatgattatgtatgtgtcatgtatcatgaaaatgatttacattttctcccattctctgtggcccatggcattttaaggacttcataaaaattggctataattattatttttattggagaagagatacactccatatgcctcttctattaaattttaccattttagtagttttaaaatgtataaatcagttctttttagcatatacacaattttgtgaaactatcaccactatccacttccagaatatttccattacccccaaaaagaaaccccttaccacctagtagccctttccaacaccttctttccctcatatactgggaactactagtctgctttgtgtgtctatgtatttgcctattctggacatttcttatgaatggaattatgcaatatgtgaccttctgtatctgcttctttcacttctcataatattttcaagattcatctctattgtcacatgtatccttttcatggatgaataatattccactgtattgatctatgacatttgtttatccattcatcagtcaatggacatttgagctatttctaccttttggctattattaataatactgctatgaacacttgtgtaaaagtgtttatgcagacctgtgttttcaattctcttgggtattgtgcaaaaaagagttaacaggcctgactgctgcgctttgaaaagcctggtttaaaaggttggccctttattggcatgtggaaacctggatttcagtagggtgcccactaccctaactggtaagagtggctcactgttcctaaattgtgcaaataatatggttttttatgaacaccttatttccttctgggaatctggaattttggtatatgtcaagcagaggctgcctacatgaccagcccccagtgaaaaccccgggtactagtctttaataagtgcccttggctggcgttttcacacgtgttttcataattcattgctgttttatgtgcatctcctgggagaagacttgggaatcttgcctctgatttcctccagtcttcactccatgtgtttcttccctttgctgatttttctctgtatccttttacattatgatctaataagtcataactgtgagtatgaatatatgccaagtcctgtgaatcctcctagtaaaacatcaaacctggggttggtttcggggactcctaacacaagtatatacctagggatgaaatttctggatcaactttttgagcaactgcaaactgttggccatagtatctacactattttacattaccactagcaacatttgagccttctgacttcatgtaatcactccaatacttgccatcatttattttctgggtttttttgttttggtatttggtatgtatttctttaatagccagtctactgggtatgaagtgctatctcatttgatttgcatgtctctaatatctaataatgtggagcatcttttcatgtgtttattgaccatttatacatctctgtttggagaagtgtttattcaagtcctttacctattttttaaattgagttgttttatcattattgagttgtaagattcttttcatatgttgaatactagattattattagatacatgattcacaaatattttctcccattctgtgcattttaagcacttcaaaaaatttggctataattattatttttaatcaatgatccttcaaatcactaggcttttctcattgaccaaaatagcctcatatatattatcaccatatgcatacattttcttggttttttttttaaccctttaacgtttgctatgttgatagcatactgatttctctatgttgggaaagtatatttcacacattttggtaattatctatggaatatttataaatatctctattatgtgctggatattttgcccagagtagaagcatattaactgacaagggccaactcctgaattcccttttagaaaatgttaacaactgctcagatcctacttcaggatgcttttcgtgtcaagatcccaaaggtttgataaagaatggttggttttcatttgagatagtcattacccagacaaggttggttatatttcacttaatgtttttatggcttctaacacaaccagtagttttctatttatttcctgggagtagggaaggatagttgtgttgcttgaagtgtattttttattatttttgctattaaatgagaacaacaaaaattcactgtaattattaactttctttcattttcacatttatttctgtaatttctcaagtccctgaaataccctgaagagacttatctagttaaatagttaatattttgttgtgaaagttttactataagccaaacattttactttttgtttttaaagtaaatgtagacatatgcacattcatatgcaaaatgatgggcccaaattggatcagggatttttaacctgaaatccatagattatcttcagggaggtgtctgaagcccctgaaattgcatgtacatattaactccccccatctacttatcaatgtgttctctaatttaaaaaatgattaagaactactggactagataagtcttagatctgtccagattaggttatttttaaaaattcagttactaaccatcagcttgtcagtgaagatatgttcaatgaaggaagggagggaccttgtcaatcttttttcactattgtatcctctacatgtgaaacacggtacgtactcagaaaacatttgttgaattagtcaatgaatgaatgattaaggaacaatttctccatagagtgacctaacattagaacattagaaacaaggttcataaggacaagacttcacttttttttttttttttagacagagtctcactctgtcgcccaggctggaatgcagtgtcatgatctcggctcactgcaacctcgcctcctgggttcaagtgattcttctgcctcagcctcccaagtagctgggactgcaggaatgcaccaccatgcccagctgattttttagcagagacaggatttcaccatgttggtcaggctgatctcgaatttctgacctcaggtgatccacctgcctcggcctcccacagtgctgggattacaggcattgagtgaccacgcccagctaatttttatatttttagtagagacggggtttcaccatgttggccaggctggtctcaaacccctgacctcaggcgatccgcctgcttgggcctcccaaagtgctaggattacaggcgtgagccaccacgctgggccaagacttcacttttgaaatagaatgaaaagttaatttacatagaaaattcaaaaattgactttcttggtgggctaagcctcagctagttctctcaaagaccttccagaagaaccaggttctattataaacaatagttgacaagtaatcaggatatgtagtgttcagccctagttctgctatataccagcttattctacattccaagttgttttgtttgttcattaactcattcattaaggatggatcagatatccacagtgtggcagaaagaatgataaaagctggggaacaatgaccacattaactcaagtgtctatcttctaagagcttgcaagcaatagacaagtaagtaaagtattataagtgtgactagggtaagtatcatggtgtacagaatgctttgaaagcagaaggaaaggccatttcattatagggaattttttgttgcctgacaaaaatacagatatttcctattttttgctacattacactttgcttctttttgatgtcaatgagatagagatgccatgacatcaaaagccagaaaccaaccaaagggatttatactgcttttataccctattaaatgcaggtagacattacctaccctctttccagccctgtctgaaggtggctttcttttatagtctaaactattctgagcctgaacattgagcataactcgttcagagacctggggaagattaaaggtaggttttctgggacttacacctgaatttttatgtacccaactgagccatcagttttgggaaagagagggcaaaggtggaaagatgtgcttgctcactttattactctcctagaggcaaaaaatttgtgtccatggtgatttatgttcaaaaagatcttattccatctagaccacagaaagtcacatgtgtcttcctatctattagataaacactaaacagaaacaagggtgcattctccttcctatgccaaacacttcccctcccccagcattatagactttaaagaatttaaagacattttgtgtttacatacttgtgtaagaattattaggtgccagaaactaatctcagcactttaaatatattaagggatttaacacttacatcctataaactgggctccatttcacaaggaagttgaggcacaaagtctaagtaactcactcaatgttgcatagtggtagagctgagattttgaacccaggcactgtggttttgacccctatagcttatagacattagcatattctttttttgtttgtttgtttgttttgagacagagtcttgctctgttgaccaggctggagtgcagtggcatgatctcggctcactgcaacctccacctcccaggttcagcaattctcgtgtctcagcctcccgagcagctgggattacaggcatgtgccaccacacctggctaatttttatatttttagtagagatgagggttcaccatgttggccagactggtctccaactcctgacctcaggtgatccacccacctcagcctccccaaatgctgggattacagacgtgagccaccacgcccagccaagataattggtttagaatcagttttctaattctatctgcatcccttaagagagagaaaaagaaacaaatcatggtagtggcagagtaaccaaggcttttggggcctcactgtatttgtcattaagttaggatgcagaaataatacctgccttagcttatacagtgtgggttggggaactctgccatgaacatggaagtattaagcactgacacatgatatactgatgccactgctgctatttcatgtccggcattgctcttcctgcatatggtactgaaggcacacctactgctgtgtgcatatgtgagtgtgagtgtatgtgtgtgtgagagagagagagaatttgtttgttgcaaacacactaagcaccctcttactgctacagggctctgtcagttactgctgtttttgcctgtagtgcttatcagtgatagcctcagggtttgcctgctcacctccttcaagtcttggatcagatatccttttctcagaaaggacttcactgtcaactctatttgctatggtctgaaagttttgtccccattaagttcatatgttgaaatcctaaccctgaaggttgggcctttgggaagggattaagtcatgagggcagagcccccatgaatgagattagcacccatgtaagagaagccccagagagctgcctttcccctttgctatgtgaggacacagcaaatgggtgccctctatgaaccagaaagtgggcttcaccagacaccaaatctgccagcacctcgtgcttggacatctcagcctccagaactgtaagcaataaatttctgttgttatgaagttacccagtttatgttattttgttaaagcaacctgaacagactaagacgctatttaaaattgcagtgttcttcctagattctctattccctttcttgatatacttaacttcacaatacgaatgacctttcaacaagctatgtaaattacttaatctgcttcccacagcctagaatgtgagctccttggacagtgtgtttacttctctctgtctatcctcagtgtgaatagtctagtacatagtgggtactcagtaaatacttgttgaatgaatgaaagatgttaatccattatcccctgtcagttacttcttacttagttgacatgtttctcaagcaagcagatgcttttgcaataaaggtagagaaggtcacagtcatccaccttctctgtggctagaggtgtatgggaagggatttgaggatcatttgatagcgaaatgaagaggacaggtggatgacttattcaaaagacccaacaactcaatggacgtgctttttacctcatcttaagaaagctaagaaaacgtttttttcctctcttttgataagcctgtgaattcaagtcaatggcattttttctgctgccatttatcctttcacagaaagggtttttgctttgtgtttgcccaaatcagtgtgcatgccactttaccttatgacaaaatgacatagaaaaggcagaatgcccaataattggtgcaaattttatgcttgtcattttgaaaggttataaatcccctcttttataatgttttctatagaggatactttaggacagaatatcccttctgtacatcaatatgctgctaattccaaaaaagaacaactttgtaatttgaaagaattggtaacaagtgtggcatatgatgaatcacatttatccattctgctgtctattgaagggaaatggactttcacttgtttccttctaaaccaaagtttcaagacataaatattgacaaaatagattatctctcttcctaagggatgattccatcattctttcccactatatttctaggtaaaagtggaccagttttactgttatccaaacaataaatgggaggaaacttcaggtactatgaaaaacatttcatttttaattggaaaatcaagattctggtgagagctccatcactgcgtatctgtgtgactttggatacaccacctaatctttgcaaacctttgtttactcgcctcaaaaagtggggtttgataaaaatctgaactcactcacatttaatatgccattttactcacagccttagtccatttgtgctgctatcacaaaatacctgagactatattatgcataaagaacagaaatttatttctcactattctggagactggagagtctaaaatcaaagtaccggcaggtttggtgtctggtgagggctgctctgtgcttccaaggtggcaccctgttattgcgtcctccagaggggatgaaggctgtgtcttcacacggtggaagggacaaaaaggcaagagggttgaatgctgtttgaagcctcttttatgaaggccttaatcccattcatgagggaggagtcctcatgaccttatcactctcctaagggccttacctctaaatactgttgcgttgaggattaagtttcaacataaattttgaagggggcacacacattcaaaccatagtgctcagcgtaccagaatctcatgtgttacttggtgctggtaatcatagagagcagttgccgtagtgtatcataatgccagtaagtacttggctctgatcttagaagaaaccaagttcagtccctgttctgcagcctcttataacggtggcctgtctccaggcctctcttttccatcattaaatgaggaagagcatagctcttgtctgtgggttatatgaaccagcccccaataaccatttttactttgtagagagcctaaccttattatgtactcagtaaatgatggttattattgtcattattttacatggctctaaagaggatacataggggttatcttttgaggaagggagagtcagagttgatttgtagttttgtaaacactcttttttcaaagctgagcaaatctctgcctaagttgaatgattatggctttgtttatccttctctgacaggactttctagtttcagtcagtgggtaatgtagaacatatgtctggtttggatttcccgacaaactttcaattaaaataccaatgtcccaccaggaagaaccgtatctggagccccttacctgccataaactttatctacattgtgttctcattcccaacttcactgtagacatcatgatagccctatctcctaagaaacaatgtgaaaaataattaaaatagtttcacaccagaaagaaaagcacaccaaactcaaatttagtggacctgttagaaatatgttctccaagttttgcttgagtagctttcagattactccctttcacgcttcctagtatatatattgacgcattcactatgtgccaaattacaaacctgaaacatttagagaaagacagaagtagggtactttagctgccaaagagacaggtgcaaaggctcatgaatattagttgaggagctgcggtgcatataacatgaaagtactgcctgcaggcattctgtgattgggcagtttaatgtcagtgggaaacggagggtgtcactggggagttaaaaacaacagcagttcaccccagaagggcttaaaacagatagtctccaggaaactgtgaaattatgactgaacgtagaaagggcaacctctccactttggtcgtacttttgtttagatgagaaggaggatggtttggctcttgggagcgttggagagatagctggggaaagaaacggtggtttctcccagtcccacaaaaggttggacaactctggattatagtactcttaatacatgacaactaaagcgtcagaagccaaagcagatcttctagatcatttatacctcctattaaacagaaaaatatatccctatgagcatggataatgggagacactgttcattcagagcataaaagagaggcatttccagcatttgatttcagagccatgcaagtgctcttttttccttggttatcagctctggcagccacctggtgcttaaaacagcctgatgtggttgctgaaattacccttctatgccctccttaaatagtggctcatgattgtagatcacctgcatctgtaacccagggtgcaacattctaatgcatatgcctgcaccccgtccccaaatctatgtaatcagaaagtttgggaaaggccacggaatcctatagtcctcatttttaactggctctctgggagattctttatgcgtagaaagaatacacaaatgcatattgaaggcattagcactgcttttggttaacggtcttttcaaaaggccaccattaaagtgtatgaattccagcttgaatctaacagtctccagaatgacttagattgtagttatatatatttttttacaacaagaaactgtcctgtagtggggaagggcctggacaacacacatgatggagttttccatatgcatccagaaataccagaaggggtacagttcaaggaagcagatttttagggagtagttgatcccggtggtgttcaggttgaagtacagacacaaaaatgaacagtaagtccacagagagaaggcttttgcctgccacattgctgaagaccagtcttacttgtatgtattcacacacacacaagtacatttggagaaatgtcaaaaagaaataagaatagaacgaagaccaatgacatgaagaaataactcactgaataaattggtgtgtacctttctatgcatatagtgttgatcaggagtttcttaggtacagctgataacaactgcaactcagatttgcttaaatgaaggcaatcattagctctcatatctgagaatcttagggataaagcttgcttgggacggaacttgttccagagctgaaacgatgccatcagaactcagtctgtccctatcctttaattttgctcttttctgttttggcttcattctctttttaggttctctctctctatgtgggagtctttggaagctccaggcttccttctgtaagcaattctagactacaaaagggttttttccttgtagttttatgaaaagtcctgcaatggagtctcattagccaggctttggtcacccatgcatgggaaccaatttaaccaagaaaatggaatattaattggtcaggccaattgataatgtataaataagtattaataacttatcaatgctaagcagtgtcatctgctactcctgacctgtgcagaggattttagtctatccaaaccacttgagttgaaagagtaggagggttggttcaccaaagaaagagtagaatgctcttacctaatgaggagcagtggatactgaggcaaaaatcacagatgtctactacatagttatgccagtagggaagcaccattgagtgaattagtgaccctgatatctcatttacatttctctagctaaagccaatcaattttatacatgtatgtttctatgcttttattctcatgagtaaacagtaatgcacctaaatataaatcggaaagtttgctgcagtggagcgctgggttgttagggtagtacactactctgtgtgatattgtaatggtggatccatgtcctaatacatttgccaggaccacagcatgtgcaatacgtgatggaccctgatgtgaactgtgggctttagttaatatgcatgcattcatattggcttatcgattgtaacaaatacagcacaggaatgcaagatgttaacaatacgggaaactgtgtggagaaggagtgtaggcaaactctctgtgctctgctccatttttctgtaaacctcaaactgctctgaaaaaataaagttctattaattaaaaagatgaagttagctataactattattagtcctctctagagtaaacattccatgagggcaggacaatgtctgctttgcacacggttatgtcgcctccatgtaatattggaattggaatccaatctagtcccagaaactcggatcagaagccatttgggtcagaaatgtttgagaatttaaaatgtttgtaattttagaagagaaatatagcccacaaaacatgcccagtgttacataatagcatccccagctgagtctgggtcagcactgcataatcaaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttcttttccacgcctaaaaatcctcgagcaatgcacaatttttccccaaggagagaccctttttagctcccagcacttccccgtcctaccactgtttctaagatctggcattacaaacgattagggcttcattatgtgtgggacaaatgcatgatggcggcagcattattttgttaacaagagaacaaagaaatcgtctgagaagagttcacttctcatttggatttttttcactttgtgccttcagacatacaccagctgtcggtagacttctctgtttcttgctgtttaaaatgctcatttgaggggttaaaagaaggaaggcggaagcaatgacaaatgaaagtaatgtttatcctttaagcaggcatgtctgtctcctctaatatttgctttgcctctgctctattcagctgaacaaccaaatagaatacttattcaatagaaacgctgtgtgttggccagtttttcaagtaggcacttgggtaaggcctttgaacatgccttgctgtctgtcttataaatactaacaacactaaattgtattagtaatgatagtgtgacagctgtccaatcatcatttctacaatcagtgattgaattttaaaggaattcttgcactcaggaaaatcactcttacagtatttcatttgtttgtgaatttccttaggttattgcccatacgttttatgagtaatttagatccacagagatgctgctgatcttacagttttttagccaaaatgcatttccctaatcattaggaagcctggaggagaaggttcacagccagcaggacacagtgtgccctacgtgtgcccttcttggaacatgctggtggtggaaagagtaatggttcttcccattgggttcccccttggtgtgagtggtgagggagaaagtgaaatatgagcaggacactgagagcacacccaacaacccagcttagcagaacttccccttccttttccctggtgactttgttctgcaatctgataaagcaacacgttcccactgattacacacacggagcatttactctcttgattggtcaagggctctgcaggatataggcaaagccactctggtttgcaccaggttacttctgtgcatgcataacgcaaaaagctacctaccctccagatgtgacccaggtacaactcatatctaaacccatgcagtcttccctggctggtattctaagcttctattcaagcccttgtgttccccattaggtgtcctagagtttacttcccaagtgaaaattgttgctcttgaagtgtttctacccaagaccaggtgtttaatcaaatagcccatttgatgtcatgggaagattgactgtatatcacagtgctgggttcttggctgttatggcagcacttcatacctgccattaggattaagggcttaaacaagtttcaggtgcaacacctgggaacaccacagcaatgacaagtagacttgaacctggaatttgtagttttctaagatgaaatcataatattgcatttttgttctttcccaacagagtcagttgaatttgcaacagatggaaatacttccagcaaaagaaaagggtgctgttctaagggtcatgcggcgaaatgtggccttcatcccacggagtagccgcagagtgatctagcacatagaacagaactctgcagggtagtttttcttcactgggatcctaacctgtttagaaatgaaagtggccgggcgcggtggctcacgcctgtaatcctagcactttgggaggccaaggcgggcggatcacgaggtcaggagattgagaccatcccggctaacacaaaattaacaaaaaattagccgggcgtggtggcaggcgcctgtatttccagctactcgggaggctaagcaggagaatcgctcaaacctgggaggtggaggttgcagtgagccgagatcgtgccactgctctccagcctgggcaacagagtgagactccatctcaaaaaaaaaaaaaaaaaaaagaagagaaaagaaaaatgaaagttgtctgtgctcaattcataactagttttaaaactttagaatgcataggccaggagcagtggctcatgcctgtaatcccggcactttgggatgcgaaggcaggcggatcacaaggtcaggagttcgagaccggcctgaccaacatgctgaaaccccgtctctactaaaaacaaaaaaaattagccaggtgtgttggcacgcgcctgtaataccagctactaagaaggctgaggcaggagaatcgcttgaacctgggaggcggaggttgcagtgagcagagatcaagccactgtactccagcctgagtgacagagggagaccccatctcaaaaaataaaataaaataaactttagaatgcataaagatcaagagatgcttgctcaaatgctgttttctgagtcctgataattagaatccagtaggtctgggagggactcaagaatctacctgttaacaagcactcttagctaaggtcatagaggttcagtatcccttatctaaaatgcttgagactggaggtgtttcagactttggttttttgtggggggtggcagtggattttggaatatttgcatatatataatgagatatcctcaggatgacacccaagtctaaacatgaaaatcattaatgtttcatatataccttatacctatagcctgaaggtgatttatacaatgttttaaataattttgtgcatgaaacaaagtttatactttgaatcatctagcacaggtgtcactatctcatgttggcactcaaaaagttttggattttggaacatttcagattttggatttttggatgagggatgctcacctgtttcagccgggaggtttcttgacacactttgagaaataattattttaggtatagtttgacttacctttttactatgttgctttctatgaaatgtttattttgagattagatctactgcctgacttggtccagctcctaggattgttcacagatgccctgtaaaaataaaaataaaaaccaaaaaactacatttagcatcagtggaattttcctagctccacccaccctctagcttcctgctttatgcgtgttatctttttttgacctttcccttggaatccagattttgttctgtacttgctcctgtgggcttgatatttgggcatctgcctcacttccttgagttaaccatcacctgagattcaggcttatttttctctgctcagcctcagcccagccccatccattcagattctcttgcccagcctcgcttccagcagcctgagtagtatcctgcttgcctgggagggaagttcaggaaaatgtggaagtgggccaaattaattaaaagaaaaaaaaatagagatcattgatgttccaatacagcaaataaattaagtgacacccggctgcggagaggtgctttattactctttttcttagagggtttttttttttaagtcaaaaaatattttgtttccattacagatgtggtcatttttattctgtaacctaggaaaataatattaaataatattttctaatggaaaattctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaatgggatatctgtgcacaaatgtagatgacttactctaagaacctatatgcagaagtgacaattcagactgattcagtgttatttttagggataatggtttaaaatattaactccataacacagtttttaaaatcctggtttaattccttttgaaggaatctcagaccatttccataaagacaagaaaaataccatgttctaccctcacctggtgtccattgaataaaaagaagtttattacatcagaaatgtaattcaaatcatagcactgatttgttttgtgcagagtatgtgtgtgtccttcatgttcacttttcacagcccaaacctggcagtctttggtttgctctgattaggtgttatgtgtcagacctgcctgcttgagccccaacaggacggaagctgtgttctcacaatgcttgccttctgagttggcaaaatcagatggtacttaatggagtttttatgaatatataagtgatgaagacaataatgtacaaacttaaaatgtccctaattccagaagaatctggtaattaagacatgtctatatgtaactttttaaatatccttagcactccttgaaactaagcctgagtgtagaaacattccaatttgtaactgcagccttcccaattgttgttaggagtacatgagataatcatcataaaatacttaccaaaatggccagcatggaggaaatcatccacaaatgttactctgctctagtgtgcacagccagatggtttgcaaccctgcacaacatacttgaattggaagtccccgaatccaataaaatgttattaaatcaaatgtaatagacaacaaaaaacgaaatggcacttaacacactccttattgagaggatttacatctgggagggtggaagaaaaaaacgtttcttgaacaataatatgtctcactttattagacatatttcttatattaactcatttgtatttgtaactgcctatttacttatactgtgatctttgggtttataaatgtcttatctctctaaccagacttgacctttttgaggtaataaaacattcttctaaaaagaaccatgaacagtaccttctaaatatttcaaactacaccacaagaactttaaaacaattgtgtgtctgtatatatgtctatttatacattttatatagagttgtgtttgtatataaagagagacagtcacactctgggtatatatggagagacaagtataattatatatgatagaatggtttgtgaagtgaacagaattgtatcagaaaacaagagtttgcattctgataatgatatttaaatacagagaggtcttgggcaggtcacttaacatctttaaacctcagtttcttcacctagacctgcactatccaatgtgatgtcctggcatgatggaagtcttctgtgtctgtgctggccaaggtgataatcactaagtgcatgtggctactgagcacttgaaatgtgactagtgtctgaggaactgaattataaattgtatttaattttaattattttaaatctaaataggcacgtgtggtaagtagatattttagtggacagtataaccataaaatcaaggaggatgggacaatgtcatatgaaaagaagctctcctgaattcccccggtatgggtgctaccaacgcagttttgagcagaatgattctcttttgaaatagtggtactctcccttgatatcttaggactttaaagtttaaatgctttttcccatatttctcccaacagatcttgacaactttaaaacaagaacaagaagcactgtgtctgtccgtcgaggtcaaggaatggtgctactgtgtggcccgccaccccattctggaggtacatataaatgaactgacatatgcatgcttcactctctgttatttttcttcctcaatgttctccctcctgacaccagctgagtgcacagtgtcatttatagagattcccaaagcccctccatgtggaggaaaaaccacggtgaatgcctcccatcattaggacaggaaaataccagattgtgcaaattttccaccccactgcagtgtacctggcacaagaagaaagacacctgagtcgatcaaaatcataatgctgttgcttggtaaagcagtgtaattaaaacgactcatacttcttacaacttgattgggttaaaaaagatggccctacttcatttcatctcctggttggtctgggaactgtctgtgaactgtgtctactcgcaatacttctgacaccaaatgtatgggttttttccacactaacaaccaagtctccaatcttctggacaccaactggctgtccaacgattcaattccattttgacagtaactaccccattaactactctgggatggttagtgtcagaactcataggataaaggctcagtcccacaaggctgcctccacttcagatgccactttcaagtccttgacctcacacacttctgactaactggctataaagtgggactcccataactccctccttggcttccataatttgctagaatggttcccagaactcagggaaaacagtttacttacataccagtttattataaaagatattataaaggatacgtatgaacagcccgataaacatatagagagagtgaggtctgaagggttgtgaatgcaggagtttctagacttgtggatcctccccacatgtagatgcattcattaaccctgaagctctccaaacgctgtcatttagggtttttatgcaggttccgttgtgtaggcatgattgatcgaatctatggccattgtaattgatggccattttccagcccttctcccatccccaagagtggggaatggggaggctgaaagttccaaccctttaattatttggttggttcctctgacaaccaatcaaggggcctcaccaagagtcacctaattagcataaactcaagtatggttgaaaagggcctatttatgaataacaaaagacattcttctcagcaatatcactcaggaaattacaagggttttgggatgcagaccaaatatatatatttcttattaatcacagtatcacaggatcagaccaagaacaaaagttccttgaccatagaatctacgatcactttgtggagactcatagcaactagatcagttaggaatgcacttgactgcaactaactgaaaacccagctcataatgttcttttatattctttttctcacatgcaacattttctctttcttttttttttttttttttgagacagagtctcgctttgtcacccaatctggagtgtggtggtgcaatctcggctcactgcaacctctgcctcccaggttcaatcgattctcatgcctcagccttccgagtagctgggattacaggcacccaccaccgtgccaatttttatatttttagtagagataggatttcaccatgttgaccaggctggtctcaaactcctgacctcaagtgatccacccaccttggcctcccaaagtgctgggattacaggcatgagtcactgcacctggctggcatgcaagattttcaaagatatacaatctaaagctagcacagcttctagaggatgtcttccaggactcatgcccttctctgattcttctctgaagtgcttagcatgtggtatggatgaggcatgaagtctgcattccaaaccagatcaaatgggaagaagcaaagacaaaaggcaatgatttgtttttgcttgtttttgtccatttcaatttacctttattatcgtaagttttctttgcctgaggactttgcctccatgtcattgatcacctcagtggcaaaggaggttgaaaaatcaaatattttacgcagatgtgttatgccctggaaaatatcataattttactagtaagggagaacatggagagatgtgtaggcaacttgcagtgtcggctaaaaggaactacgatgactaaaaggcaaatataactgcacataagggattcagtagtgtggaggtttaataagtagtaatatttattaggattccactaaggtctgtaatgacaagattgataaactctacccttggaaatccaggctgaagtttagttcaatatctgctattcttgttattgccttaattttcagtttgactttccacatgtttaaaagaacaaacttttagatttggaatttgaaaaacactgttttatttttgtcctctgttcaaaagttgtaatgttttctttctcatctaattctgagctaacatttccagcagaaaataacaattagtaaaggtgctaaaaggcatgtacttcaagcatcctgaatacgaaggagaggtgggagaggtaggttcccctctatgtctggatcagggacaaggaattgttaggatttctggtttttgaagactgacagaaaatctaggtttgatttcagaggtctgtgtttggaaaatgggattattcttcaggatttcattttcctttcaagttagtatcagaagcactgaatttggactctgggatatgagttttgatccttgttctgtttcaaatcattatttgatactgggaaaatatcttcaaattctttatgcctcactctgcctgtctataaaatgaagagattaaaagaagtctctcaaatccctattgattctatcaacacataattataactcgataagggctaaacatcttgtttatcaagtgtgtttgcattattgaaggcctgtcctttatatgagaaaaccacttcactgtggacatatatttagattcaggtgaagttcacttagactaacacttctctttttaatatggaatctgatcaaaataaaaatggaagattttactaatttcttctgcaggctaccttcattgcattaagttttcatcacatggcagcaaccctaaaaattaatcttgtaggtatattaagaaaaacaccaccactgtccgatataatgatctctttaggaaaggcaaaacacatggagtgatgctgtgctgctacgcaatgaagtacctgactactttccctttcccacagagaaatagattaaaaatttccatagacatctactgaaatgcagttgtctctgctggcagcagtcagcagctctgaaatccagttccttgagctgtgctgacattcctgacaatcttgatggtgaaagacaaggaaataaatattcttattataagctctattagaaatggcgtgcacattaacgctgtgggcaaagcaggcacggctaagaaatttttgagaaaagaacaaagaagatattcaaggttataaaagagcatctcagacatccatcagttttggacaagggaaacaatgattatctgatgaaatccttccaatttctcaaaagcctccaatgcaactgaacggcagtgattctctcactgtttttccgggctgtgtgtcaccctaaagcgagaagaatcactgtgagctgctggacatactgagcattttagacccagcatatggtctcctggtttccattgtaacagatcatgcagaggaagggaaatgagtcagccttttattatatcagtggggtactgagtaatggcatgaaatccattgtaagggatgctgcatgtcctatttcgaaagctgtgcggtgtcagaccttcttagggtagcagagaaatgagcagcaattaatctgttttgaaaagcatttcagtcagcaggtatttccagcactctaccaatcactatgtgtggcctctttgtcatctcttggtttatatgtatgaattcagatgtgatggttttgcatagatttttaccattaaatataagaaaacaccaaaaaatagaaatcactttgatggactctggctatccttggtgctccttcctattagacacagaaattattgaggtccagaatgtccactttgctttctgccaactccagggtcactgggcaccaggaattcatgacctttaaccaagctctcgttaaataggaatagaacagaggaactttgagattcttccttccaatatacgaaaatttctagtttattcctcaataaaatcctcacaaactgttcatcaagagaggtttttgttcatgccttcattttatgtcaccaagatgcttgcgactcaaagggtggtccaagcaccagcagcattggcctcacctggaaatttgataaaaaggtaaaatctcagaccccactacagcctactgaattggaacttgcattttaataagatctccgagtgatcatatgcactttgaagtgtgagatgccctgagtcatagctgtggttcccacgcacaccccacctctgggcagtgagggttgacagcttgagaatctggagggaaaattgttaaaaccataggtgtccaacctgttcacaagcatattccgattccataaatctgggctagggtccccaaggctgttaaaaaaaaaaaaaaaacaggccaggcgcggtgactcacacctgtaatcccagcactttgggaggaggccgaggcaggtggatcacttgaggtcaggagttagagatcagcctggccaacatagagaaaccccgtctctgctaaaaatacaaaaattagtctgctggtgtgcgcctataatcccagcaacttgggaggctgagacaggagaattgcttgaactcaggaggtggaggttgcggtgagtggagatcgcgccactgcactccagcctgggcgacagagcgagactctggctcaaaaaaaacaaaaacaaaaacaaaaacaaaactgtagctgactcgctcactctgaggcagcaccagatttaaggtccattcacacggatcatctacagaactagcccaggtccagccctgctgagatggagtgcttcgatttccacatcactcaagccgaagggctgagcattccttatgtgaaatttttatttaaaataattcatctatttacttattttttgaaatggagtctcactctgtcaaccaggctggagtgcaatggcacaatctcggctcactgcaacctccgcctcctgggttcaagctgattctcccacctcagcctcccaagtagctgggattacaggagtgcaccaccacacctggctaatttttgtatttttagtagagatgaggtttcaccatgttggccaggctgatctcaaactcccgacctcaagtgatctgcctaccttggcctcccaaagtgctgggattacaggcgtgagccactgcactggccaattgaaaataattcaaaataaaatgtagttaccttaggctttagctttgactttatatgtttttgttcataaaggaaatgaaaaactaagaaaagggtggcttttcctaggtactcatactcagaagtagcattctggtcaggtgcagtgcctcttgcctataattctagcattttgtgaggccaaggtaggaggatcacttgagcccaggagttggagatccacctggcaacacagtgaggccgtctctaaaaaataatttattttattttattttatttgggacagagtctcgctctgtcgcccaggctagagtgcagtggcgtgatctcagctcactgcaacctccgcctcccagttcaaacattctcccacctcagcctaccgagtatctgggactacaggcacatgccaccatgcccagctaatttttgtatttttagtagagacagggttttgccatgttgaccaggctggtctcaaactcctgacctcaggatccacccgcttcagcctcccaaagtgctgggattacaggtgtgagccatcgcacccagcctaaaaaaatgtttaaaaattagccaagtgtggtggtgtgtgcctctagtcccagctatttgagaggatgaggtgggaggattccttgagcctagcagttcaaggctgcagtgagctatgatcacaccactgctctccagactgggcaacagagtgagatcctgtcttaaaagcaaacaaacagacaaaacccagaagtagcattttctattcagccagctttcctacattgttattggtgaatgtatggcttcccagagtatatttaaaaaagaaaaccacctgattctgattctgcgattattttcattattacgggttttggagaaactagctaaaattttcatctttagatttttcttttacacagaacacatccccactagagttggatcctatccacagggcatcagacccagggaccttcgaacacgaacatctgtagagtcctttatagtgtttatagtgctttaatttatattatattatctttgaatcctcacaataatcccataagaagtaaggacatgtgtttcatagataaggaaatagaagcaaagagattatggagggcacactctaatcaatggcaggaataagagttactgttgcctagaatgcgcccttttatttgtatatagcagaaaaactggaaacatgtactgtactttctgtgtcagtggttctttggcgctcaccccaggtcaattaaatctgagtttcttgatggcaggggatcctctggcatcatccaggtaattttaatatgcagccagggtggaaaacttgagtccctgcattacaaaatcaagtaggacttatcccagcaaaacgtctctatatgcaaacctctccagggttccataaatgtaattttacgtggacatacccatacagattataaccacagcccttaaaagaagcaagcatgcctttccacagcatggttatttcagctggaccatgctgtatttactgtaggacagagataaaagcgtgaaagtaggacatctgtgttctagtcctagctctcccatcaacttgctatgtggtcttgggccaattatgtaacttctctgagccctatttcttcatatgacttctgtttctgtcttcccacacctactcagctttcgttattaagatatcaccttcagagttagactcacccagtttcttacttagtccaaactatgctgacaggtcactgagccaggacgaatcttactgtgctaaaagtgagcagcctctatgcccagaataatcttcaagatgtccacattcaagtcaagttgccaactctgcctaactccacattcaataccttattctcatcttcttccccaaactggttcctgggtttaccagttttatataattttagattttcagctgcctccttagtccagacacttagcttagctgttgtcctcatttcttacccaaaggcgcatgaaatcccattttaaccccactctaaacctccaaccataacatggtattctttgcattctaagtattgcttaagtctaggaagtctagttactgggccccacgcatcatatcagacctccttggctattgacatttgcctggctgggtcctaggtttgtcaactgtgctttggacgactggtcactttcctcaggaagcagtccctgtacttccagcttactccctctactttctctcattacctttttcaggctccctctccttacccatatctgggttcctagcatcactttcaagtcctcaaacaccactataatgccaaccaaattgaattcatctttgttctgtaaacttttcaaatctgttatgaggatgaaaagacataacaaatgtggcagcaatttgcacagttaaaacttccagacactcctgattttattaattaggctgggtttgattgttttcatttgcttaagcttgaagtcaaagttaaatcagagaatttctcatctttggagatatgtgattcttgatttacattcatgtaacaacttttatgtaggcagatacttttcggatatatctcccaagagatttatatggaatttacatctattattaacataaattggttatgctctggcattgtggctttattagccattcttctaacatttgaaaattgctattaaagactttacagttaaggtaaactctaccaatagtcttctcataagccaaaccctgtgtgattctttatatttgcattttctatttagcgtgtacagtatgtgcccggacttcatttccttagaaaaacaaggcactaggtagacttaggcggatgcaggactttaaaaatactgctgaaataatgctgagaatatttttaatagactgaagaatgttgtcttaaacatatttttatatggcagcttaaaaaaagcaaaatgtgagatttttaaatggttacaaaattaacaatcacttaattgtcataaaaagctataagaatagtgctgtaagtattgatcaccttttctggtcatattgggaacatgattgaaggtacatatgggaacaaggaagggcccagcatttcacttgagtcatctcattctctctctctctctctctctgtgtgtgtttgtgtatgtgtgtgtgtgtgcgtgtgtgtataatgagagaagtgcccaaatataatcctagttttaaaaacacacataacaaatgatagctaatggttttaggtcctgagtctttgtttcttggccaccactgagagagctgcattttgataccaatttcatgtcacctgagaagcgacttccctgagagatgccttatcacctgcaagtaaattaaaagccacaggtgtccagtaggttaacactgaccgtcttggaaatcagtgattcagaaaaggtcctgtaataaggcaaaatgtaggatctcgtcatctggtcttggaacttacaaaatgatgtttaaaatgttggttgggagtggcattgaaatactgctactatgccattttccaagaatgttgaggtcagccaaacttggtttaaaccaccttttataatataatttctatgaaacatgcattctgatttccatttcccaacagaggaactttatatattcacttaagtagatatctatctcaattcagaggggaaagcttaacatttagttagtgataggttaatcaacatcatagactactagataccttttttaaaaaaatcaggaattaaatattcttctgtttgtttttcttgtgacaggatctcactctatcacctagtctggagtgcagtggcacgatcatgggtcattgcagcctgaaaccgggctcaagcaatcctcccacctcagcctcttgagtagctagtactgcaggcatgagccaccacaccaggctaattattttattttttgttagagatggggtcttgttttgttacccaagttggtctcaaactcctggcctcaagcgatcttcctacctcagcctcccaaagtgctgggagtacaggcatgagccaccgtgcccatccaggaattaaatattcttaaggcgatcttgtctgttgcctcttgactgtgttcctttgaaagatatgaacttggactcctttatttgaaatgtaatcagccagttcctcccttttttctcttccccgtttgccaatcagagggggttacagcgcattagttgatttaatcagcatagaataatgtaaaacagtttataaggtgatgcctttctgcattcattaagcctcctgtttcacccattgaacagaaaaagagagccacattgatcagggactacttgtgataaactatctgacccacatggcctgggtggagtgtttcgtgtttaggaggataggccactgggagggagtgcttgccctcactacaccaaaggcaggctccacttctctcatccatgagatcatttagctcaaagaaagaatcagcaaaagaagcaaaagggaggaattggggcctggcatgtctacaggagtgacttgcttctcctctaccagatatgacaagaagaagtgaggtggatatttctgatttcagttatctctgaaattggtgaagtatattctgtgatgctactgacatactttttgcctttgaattttcctgtcaactctttttaaaacaacttgaatgtttcatgactatacttttgaatgcctagatgtcaacaactatacacttatgagtagaaaaaaataagttgatataagtaacgaacgtttcctggtcatagaaaaattatagtctttttatagctgagcttccagtttcttaaagtaaccttgtagagaattggtggtctggttttttaagaagagttccctaggagtagtagctacatactttctactttaattctttttttagttctagtaagagagatgcttaagctgtttttacagctatagcaagttcctggccatagcacttagaaatagactcagctacttaataaataccagttaattaaatatcttattgttcagaaaaaaaataataatttggctaaaaaatagcagaaataaatttcaggaaattctttttctgtctccttttttcctcacttgcttttgtgcaaacgtttctatgtgctttattgggcagaaaccaagaacttaatgatgcccctaattacccagcttctctcctgacagttagtttgtgtgtactttaatgataggcactatgtaactgtatttgtggatacacagatttcaattcaagttgagtacatctctattttctttttaaacatccaaaaaaaattaaaaagattatctccaggtttgatccttagaactggaggccactgatgtcagagtaagggccaaacacattagtaccgaaaggaaataatgtttggaaaatgagaatggatccataaggctaaatgatctacaaactgtgatcatttgacaaagctggaccacatgcagagctttttcttttggagttgtcctgtcccagaaagcagtgaaggatgacattgtgttagaacataggttgggacatgaagagtctggagatgtgaaaaacacattacacatccaggagagtgctaccagggatgtactagccagaagagaacaaatgatcaacactgagctttcaacaacatgaatctggctgagcgtttcataaataatccagtggacattcactacaggatagacgggcaccattcttgttttaatgcctgctggaaatataccctgtgaatctcattttttcagctgaaaaaggaatgagtggtgctttggctacatttttagcaatgaataggtattctctcaggtcagtgcattaagcaggatgttacatggaattaagcaggataatgatgcagtacatagaataaggaaatgctgactgagtcctggaaatttggaaatagactctggttaggagctcagaaatcgaaggctcagaaatggatatttaccactctcagggattttgaacctaggagtcttaggcacaaataagaagttgttaatttttctgatatattttttaacatgttcagtttggttttcagacattaggaacaaaataactggaaaaagccaaattgaagaccagagaaaactatacatttaggcaagtgaagttcagtttcacacacaaaggaataaatcatggcattttgtatgagggtaggattaaagcttttgattctatgtaatatcaaaatactgatttaagaggaagtgatttactggagtatctgtatattaatcaatgacaaacaatatggataaaaaacttttcaaatcaatcaaactgattgcagttctccatatccactaatgattttgacatttgcagatatatagaataaatacaaagttccaaatgaagcataatagttttacagagagaccaactctgtctgcattatgaactcaaagaaatgtttaatgtttaattcagagactgagagaatgttcgtgatatctgaagtaggtggtgctgctaacaaaacaatgggcagccactttgtaccgagccaagagagctcttcccatctccagccgaaacacaccctctttttctcccatcatctggtgcaggttaacacattatcacaatcttcactgtcacaattaacccctggaaaggagttgtgtcataaaaacactccataggacttcacaaatccatatggcaggcacagctgggaagacagttgcagttgataacgtagcatttcagaaatatccaaagaatctctactttgtgaagtagtgtggaatttacacatcctctcattccctcaaatcagcacatacactagggaacacctgggaaatgccaagatgcttcagttttaggtgtttgaagcccagttcttatcatttcacgcaaaccagagtatgctttttgaaaagatgaaaggacttttaaaaacaaaaggtggctgatttaaggattatgtttcttccttctccacttactgcaaactgaggtagctatgacagctctctaacattagtacccaaatatgagaaagacattcatgtaccttcttctcttgctaccctgagaatttgttcactgtctctgcaagccagcactccttctaaatgtacaactccagtttacttcaatggacacagttgtgatgaatgaaatttatgattggattctaatggattatgtaaattaggatttcaaggttaaaggaatagatttcttttaaaaagtaaaaataggagattttggcagaacctttcagataccaggccttgtcatagacagggcagatataggagtgggccaaaacaaaatgttttctcctgccatgtagcctacaggtctgctagggaggagcggggtaatgaaatcatcatactgagatgtgtgctcttggttgtgaggtgggggtgagggaaaggaaaacagggttcagtgaccatgtaaaatagaaggacatcatgtggattggggagtcagagaaggcttccttgaagaagtagttctgtggcttagatctgaaggacaagagagtagaaggaaaggaggagtattatagacagaacagctgtatgtaagtctggagtggagaggttgtcaaaagaagccaacatggcacatgagtatggacatggggaagggtgtttcagtttactgtgaaagtggtgactgaagcaatagaaagctccatttttgttcctcaaaatcttatgaaatcaatgatagccagacaccagtaagttggaaacagaaaatgttatcaaattgcctcaaatttaagttttaaaaattgagattctgggagccccgtgcagtcaatttatagaaatggtgggatgcacccattcttagctggtgaaaccaaggctgggatagaattacaaccgatgtgttaaagtcatagagttaaataaaaaataaaatatctacactatgtaaatgaataataaaataagaaatctacactatcatgatgacttgagaaaatacttagtgataaaaaaaaattacttggtgatcgagaaggaggggaaatgtcagacattgcctaaggatgcaaagcaaaacaaaatagaatgaaaatgctttggaaggaacgccttaagaaaatataagaaaatgaatggatgcatctccactgtgcttttggtcaagtacaagaaaacatggattctatgaaacaaagatgccaatgttaaaagagagttgccgccaatgcagattgaggtttgaagggagctggcaatgatgagaaatggaaatattaaaatctgcaatgcagactcagtaaaaagccaaataaacattgtagcaaattgaattagtgataagcatggctaactaggtaagtttttataaagaacataaaatgaaagtataataatcagaaagcttcataaatataaaaattaggtagtaaagttccaacccatatgtaatcaatgtaattggtaaagacaggtcatcagtgtgtatgtattgttttattgtttaatatcatcacatacttaccattccatgtgagttcatcatccttttaatagtaaaaacatattgtactttctcatgtttgagcggaagaaaaaaaattatggtattttttattttaataattaaagaagaaaggatgtttactgggagctgccacaaaaacacttggtgttttatacatggtgttacacacagttccagagatatattcaaaggatttggaaaatttttaaaaaataattccaatgacataactttacttgggttcagcatatgacctgtactcctagtagctcatatattctgttatgtttgtgtatgacacataaatttgttaaatataaacaactgggctgggcgaggtggctcacacctataatcccaacacttggggaggccaaggcaggcggatcacttgaggtcaggaaatcgagaccatcctggctaacacggtgaaaccccgtcttactaaaaagaaaaatacaaaaatttagctgggcatggtggcgggcacctgtagtcccagctactcgggaggctgaggcaggagaatcacttgatcacgggaggcagaggttgcagtaagccgagatcgccactgctctccagcctgggcaacagagcaagacttcgtctcaaaaaaagataaataaaaaataataattaaaaacatatcacaatttttgttaaaaaaataaagaaagcatagatgtaagaaataaaaatgggatatgtaccatctaagttgctagagacaataaaatcaaagaagttgtggccaggcatagtggctcacgcctgtaatcccagcactttgggaggccgaggtgggcagatcacttgaggtcaggagtttcagaccagcctggccaacatggtgaaaccccatctctactaaagatttaaaaagttagctgggcgtggtggtgcatgtttgtaatcccagctacttgggaggcttgaggcaggagaattgcttgaacccagcaggcgaagtttgcagtgagccaagatcatgccactgtactccagcctgggcaacactgcgagactccatctcaaaaaacaaacaaactacagcaacaacaaagaagctgtaatctatttaaccagagactcaaaataaagatgagcaaaaaagcatacatgaagtatagaaatatgacagatatgagtgtgtgtagcttatgaaatataaagaaatgcaacttattttaaatataagagcctcagattgagttaaaaatatgatctaaacaaaatgcaatgatacaaaatacctagactaccaacaaaacagattttaaaaagaaaaataaatgagggcagaattattagttttagaccaagcattattcaaatacaaaagcattaaattagataaaggcaaccttttttttttttttttttttttttgagactgagtctctctctgtcgcccaggctggagtgcagtggggcgatctcggctcactgccagctccgcctcccgggttcacaccattctcctgcttcagccttcccagtagctgggactacaggcgcccgccaccacgcccggctcatttttttgtatttttagtagaggcggggtttcaccgtgttagccaggatggtctcgatctcctgatctcgcgatccgcccgcctcagcctcccaaagtgctgggattacaggcatgagccacctcgcccggcagataaaggcaatttttattattaaaatacacaaaccacaatgaagacattccatttacattattttaaacaccatgaaacatagagtcatagtatataaagctaaaagtttgggaatacaaggagaaattactaatgcatatttgttacttaacttgataggtcaagtcaataaaaataagcatataaagaatttgaataatgtaataatgattggcctttcttaatgtaaacatacatacttatgtattttctctttaagcacttccataaatcctatttcaattgtttacatgttcagccaaaaaaaatttaaacaaaattgaaattatataggccaggccttattttccgccataatgcaattaaataagaaattagttataggtcaattttatacaacaccacaaattttttaaaaaccgtcccatgcaaatttcaaatcacatttctgatacctactgggtcaaagaaaagataaaacccatattaatatatttttcaaaagtgaaaaaaatgagaacaaacatatctacacttgtacaatttatgaaaagtataccctgaaacaaattaataaccttaaatttgttgtataaggaatcctggaaatcaaaatcagtaccttaagtattcacctcatgcaattcaaaggaacatagcacaaacctaggggaaatggaaagaaagaagataaaactcaaaattagtgaattagaaaacagtatatagagagacatccaagaggagctttgagatatgagatattctctccaaatctaatcaagaacaaactagagaaatacaaataggcaaaatgataagttaaaaagagcatataattttctataaaatatttaaaatcatttaaaaaactacagacaactctatgatcatttaaacatccggatgaaatgaattatctattaagaatatataaataacaaaattgaaccaagaaaatgtagaagatatgaacataccaattattatggaaggaattgaaagttgtcaagatttactctctccaagttctctggtctatacattttataaagaaaatattttaaagttttaatgtaattctcttgccaaataatttgtggcacagcaaagacaagatgaaaagctaccagtttattttatggaatgagaataatcctggcactagaacttgacaaagacagcaaaaagggaatgcctctctcttatttatgaatgttggtaacgcttacatagtgggtaatacatgtaggcactattttaaaagttttacatatattaactcatttaacccttacaaaaacctgatttaggtgttatgtattcccattttatggatgagaaaaatacctgagacattaagtaaatatggcattactcaacaattcatgaaaaaacactttaggacatgtatataaaatgagatagaagttttaaaagtacaggtaactcaaaataagccaaaataagtatttgctcaaaatataccatattacagattaaaaatacaaaaacaaaattaaaaaataaaaacataatgaagagtaaaaagatacttctggggtggggggctgggggagggatagcattaggagaaatacgtaatgtagatgatgggttgatgggtgcagcaaaccatcatggcacatatatatctatgtaacaaacctgcatgttctgcacatgtatctcaaaacttaaagtataataataaaaaagatacttctataatctgcttaatgacagccaatattatatttaacagaggacgtaaagacaaacaagaatgaaacaaggtttataattattgggtgatgatacatgaaggttcattataccatgatttctacttttgttatttgtaatatgttagaaaatatatgtaacaaaaatgttaaaagaatggtttctatggttgaatttagtgatttctaaggtggcttccagctcagctcttacatggttctctgttgttaattacctctttttccaaaaaaagcattttttgtactagcctttcggggaggaagatgtttgcattatgtggaggagtttccaccatacatggacacattggtctcctgcaaaccacgtagttcttttattgcttcttttttcatttgaaaatcattccagatactgaagttaaaatagctgtccttgctttcctgcctggagagatgggtatcactaaaaatgcctggattggcagtaatccgctttgctcctgcctggagctgttctgaatctccagtggcaggccctcacggtgttactggggcaagtgtgcagtgacgtgcatttcatctgcacacagcaacggtcagactacttggctttctgcagggaatgaaaaaatacacatataaccacccccgttcccaaatggcactgtagcctagttaagaaaattgcttgagggggagtgcattatgctaagagggctagttcattttcaggttacaaaactttaaattcaagttgacacagcttctattttcatttccatacttatctcaactggggaaatgtggtgtttgtcactaaaaaccagccagtaaaatgtagagggaagatggagagtcagtggtccgcagcctgcaagtggctgtgatctgaaatatgtcatgctttagttggtagcagataccataccaaatttgcttcccactggtagactttctccttttattttcaacaaagtcccatgtacccagcagcaatctttaacagcaaaaatgcaattaatataagtcatctcatcatgtactagcattccagatagctcataaacaattaagaatcgagtctgaattaaatgcagaggttcagggctaagtgtgttacaggaagacagagaatgctgttctgtcagttttgtgaccatgagcagtttcattcaagaaaccacatggaaggtgttccactgttaagtaccacatgtgacctctctggtttgaatatctaagtagatccataaagcttaaagtacataagctttcgtgcggctatactgaaatgtaaagaatgcgaatgaaggcacccattaaaagataaaactgggtaagactaaaattaatcctccataatcctagctttagaaactctcatctttactgtatacaggtatctttaatgtgagttattgagtaagtccaagggctcttctggtcaccctttcacatatagtctaccacattcctattccaatagaagctgggaagcattccaggataaattaattgtagaatcaatttgcttttatagagcatggatgagagaaatattgaagttttaagagtttctgttgccagacttatagaatatatttgccattcagaccctatggtttgtaaaaaaaaaaaaaaaaaaaaaattaagcattttgggtgttgaccctgggttgtgtaatttatgcatggctctggtaagctgttacctcttaatcacccaggagccccagctcttgaagcagactaatgattccctgctgactatctgctctgcttgcagttctgccttcaacacatctgtcagcaccacttcccaaggggactgtatgaaagttgcaaagtctgacatccgtacattaactactctatgactttctccattaataatggactgtcccgccgtaagctgtgagtttcctccccaacaccgaccgcttttgcttttatgtgccactaggcctgtcatcagagagacagccagagaaaagacatctggcatctgtaactcatagggggttcatgaaaactaaagcaggtagattattatctcaaatgaagttcctggaaatactgaatgatgaatgtcgtactaatggcctccttcctctagcttggtgacagcctgtaaccagttacaaaaaaaaatcttgacatacaccttcaatttttatttaagagatatagtcctaattgttatgtcaaaaccttggaaatagaggccaattattttgaaaacgttattttttccaaatctacaaaggaattgccatatgatataatagctaaaggtgttttcaagatccattttccaattaattgctttaaaaaagaattctctgaagtaaatcacaagtgcctttaagattctggctggattgtttgttaatataccttagatgcagataaaaagcgggggcaggaaagagaaaattggaagcccactgggtcagaatggcaagttttttgcttttaccaaaaaaaaaaaaagacagtgggaatcacaacagaaagaggtcggatgctgttggtgatttttgtacctctgaagcttctaaatatagaggggtttattgcttctcttgataggttccttgtcaagttactgtagaaataacttacttaccccacctggaatttagaacagggcttttaaattttcaaggactgcactgcagttgaattgaagtgaaccagatgtaagataataggggttgggaagaccctgaggaagtaaagagtacacatctcatcaataaggggcagggcattgttggttacagtgcacccaagggagtgctcttagggtcaactagacaatcaaactgacttgatttccatgggttacacttgacatctcattcacttacagaccgagcacagtgtatgcccgcagagcagtactaggccttggtcttcaatgggaatccctggaacagtccgaatagcaatctagggacttttttaaaattttttttctctattcccaagtgttatttcaagagcaaagaagttaaacttgtgtagctaagtgtagagtctcctgatttagaaggtctatgtcttaaataggagccaagatctctggtgacgttcctataggcacagcttccaaaatccccaggtcaagcctcctcattatgagtcaccacactcagggaagcccaacccaataacttctcaacagatgtgttcatttgcagtccttccagccagattcagcttaccaatccggggtcattcttataacaacatagcctgcttatgtggctgacatttcaccttaccaggtttccagggtaacaaagccagaaagttaacccaagataaagttctccatagagagagagaattttaacccgttacccactgttgtcatatgggagtataaactcagatcttttcttttcctttgttcctgcttgcccttctcctcctctttctcctcctcctccaccttcttccttcttttagaaaagctggggccggcgcggtggctcacgcctgtcatcccagcactttgggaggccgaggcgggcggatcacgaggtcaggagatcgagaccatcctggctaacacggtgaaaccccgtctctactaaaaatacaaaaattagccgggcgcggtgatgggcgcctgtagtcccagctactcgggaggctgaggcgggagaatggcgggaacccgggaggcggagcttgcagtgagccaagatcacaccactgcactccagcctgggcgacagagcgacactccgtctccaaaaaataaaaaataaaaataaaaaaataaaagctggacgactagatttttaaaaaatgtttagtctcccaatttttaagcgagactactggagtaagaatactggaccagagaacagaagacctgggttctattaatagtagtctagcaatttgctgtgtgacctccctgtgttaagtgaaaggcttgcataaggtcacctgaaaagctatttctgtgatactgttaatcttttctaattgctaaagaggtgatgcttcctgtttctctgctcattgccagggtacttgtttctcttccatcagcttttctccttctctattctgcattatcatatgaaatcaaagagtgaggaaaaaagtcaaggatcttcaaaatcatacatgactgataccaatctcatcattggactagatttctcagtgaagataatctgagggttaatgctaactctcatagaatttaagtcaaaatatctgtctttgtttgcattgcccaaagaagttggatcaaaagagttacagctgggtggattttaacttttaacccagtttttcagatgtgttaatatatagtgcaaagtttccaatgtagttagagttactacaaccctaactgaaattgcctcatactgtgacattattatatcctacaatcactcatatatctttatttttccaactctaccatcacaactgagaaaaggtaatgtggtacatttacaaataaaagaggattaggattattttcattttaatattcccactataattatctacagatttatgaagaccgagtcaagggttccatttgtagccatcaataaagagattaatttattattcccaatcgggctccaaccctcaaactatatttggccattggcttcgggatttggttatttcctcaaccctttgtgaagaaatcttttaattttttgtgggtcagaggctctttgttatatggtagaagtatagtccgtaaggaatagaaaggacgaggttgaaagtagctgtgccttgaagttattaaaaatatgtttcactcatgataacatgatcattttcaggaattttattcttcctcccttgaccacaaatattaaacgtttcaccagggaaatggctggtaagagatttagtcctaggagtaggatctaatcttttatatcacagtaagaagctgatcaaaggtgttgaaagctgactgttaaaggattaattaggtcacattgaaatatatgattttaaaacagattgaaaccagaaataaataaataaatgaagctagctgcccccatttttttcaagaacatgttattgaagagaaaatattgagccttcatcaccatttaaaatattcttaatgagcattgttgaagccattttaaggagtgtgttcttcaacataagggcaacggaaagccatgagctcttcttctaggaattgagcttatatatcactctttctttaaagagtgcaggtaatgggttgcagcagaacagggctgtgtgaagagaaccttgaaacagatgctgcaataatccaagtaagagatattggtgtctttatcttgggcagtagctgtggtggtggattctttgtgtttcccactcaacccaaacacaaaatcttccagggctccaatctaagatcaaccccatcctcttggtcactggattgcattccctctcacccactcaagaacttcactctagctatcgttttactcctctctcctgcattagatacattttctttccctgctacatcactcctacctgcatcggaacaatgtggcaacatctcctgctttaaactagtaagaaactcccactgctcaatttctatgctcctcttacggcaaaactgcaccaaagagtcatctctacatcttctctttcacggactcttaccctcagtccattgggacttttccccagaattgcacaaaagtagctctcttcagtgatgtccacaatactaaagctgatgataaattcttagttctcacagtatttgacctatcagcagcattcaatacagctgctctctctaaacttctcaaatacttgcttcttgtggcttttgggctataactctcttggtaccccctttaaatccctggatttccattttctttttttttccatttttttcttttctggcttctcatttccctgtcatctactcatattcttaaagtaaagtataagtgtcctcaggctcaagacccaggcctttatctctctgtatacttgctctctagtgatttcatccagtccaatggcttcaaatgccatctttatactgatattttataaatacctactgtcagcccctctccctcctaaatacttgacttacatatccatttcctgctcatcttctcacgtggttgtccagtaggcatctcaaaggtaatatgactaaacctgagcatttgatcttcttcctaaatcttattctcctatagttttcccagtcacaggaaagggcacttccattcatccagtggctcaagactgaaatttgggtgatagtctttatttatttatttatttccatgccaccattcaatctgtttgcaaatcctgaccactgtgccttcaaaacataccctgtatcaaaccaactctccctaccttcaaccattgcaaccccagtccaaactcccatcgtaagtggcttgatcacaagagcttcctaactggtgtccctccttctattcctgtttctccagccttttgttacataaaagccagggtgatagatagagtttgaattatttgtccctgcccaaatctcatgtttaattgtaaccccccaatgttggaggtggggcctggtgggaggtgattggatcatgggagtggatccttcacggctcagtgccgtcctcacaacagtgagttctcgtgaaatctgattgtttaaaagtatgtggcacctaccccccatctcttgctcctgcttttcaccatgtgaagtgcccgctcctgcttcaccttccaccttagtaaaagcttcctgaggcctccccagaagcggataccagcactgtgtttcctgtacagtttgcagaaccatgagccaattaagctaattttcttataaattactcagtctcaggtatttcttcatagcaatacaggaaaggcctaatacagtgactcttttaagtgtaagtcgttcacatttctccctggccaaaagccctccaaaggctttacttctcactcagaaaaaaatccaaacctctcaccttggccagaagcccccataaactggcccctggccatctgtccgtcattatgtccccacaacccccatccttctgttccatatactgtttctcaaagacatgaaacacgtccctcctagcaatggggcctttgtgagtgttgctcccatgccttgaatgtgagtcccccagatacctcgtggcttgcaaccttctttcatttcaaatctctgctcatttccaccccttcccgatatttttcaaatagtactcaccatccttctccatcgctttcactgctttgttcttaatcgcatgtagtactgtgtgacataatactcctttttgagaattatatttattgcagatttgcagaatttcacggttgtactttaaagcattttatgttaaggtcaccatagatatattgtgcagtagaactcagaagtagaatgaatatgtaatataagtctcaaggcttgcagtaggctgctttggggtttgccttctgacccttcagaagtgtgtgttcactcagctgttccggtaaggacgcctcgatggaaaagtttaaaatgtactggttcatatggactgggcaattacccatattatgtaattgagggacacctacagaaacgatctctttccccttatctatctgtattggtctgccatcatacctgcaaaattccaccattactctctcttaatggaatcaactacaattagaagtcaaccaacaatgcctgtataggaagcatatgtagagacttttagttaaaattatatggtctaatcagcaagagtctatttaagggacaataaagcagaatatggcttattttaaagcattatagaggctctctcaacccaccaccctttaactgactttctggataaacagtctcttcattccttccgtaatgcataatgactgttgcctgtggcaagctgaaggttcatggctggtaggctacgctcaggtgaatttggagcactctgttcctaggtgttgagttggacactgccaaggatgagttgtttttattcccaaaccagtttatgccagtttcacttacaattataaactttaaatattatataaactaatgaaataaaaattcaaaaggcaagagttgtcatttccgcaaaaactaggtgcaatcctttggaaaagactcaagaaaaacaagccaataaaaaaattaaaggttctacggacaattatacaagtttatttttaaataaaagacaattataattcatactctagtataattctgtactcagatcttgtcacaactcttttgtaaggaaaccaaaactgtaaatgagagttgtcaatgcatgatgaacgtagcttatgtgaaaataacaaccctagtccactgtcaactttaaaaataaataaaaggtaagagttacattgttcttacatgaaaatattgacaaataataaatttaattgcctaaaaataaattactttattagtaaataaagataagttatatataaatatataaactatatgttatgataaatttcataaaatgtttatgacatacatatggcattactttatggtttcccacttctagcaacttttaaaattaccaactaattctaggtcccaaaagtgtaggacaagcgggtttttcacatggtttgaaaacagttttcaagagtagagattgcagtttcattacagacatgttgagaacagcaaaggaggtaaaatactcagatcaatcctggaagtaaagtaaaatcagcatgcccattctacatatgaggctaacagagagtcagtgacgtggagttgagctgttttcagagaactaagatttgccttcttcaaggttcatgctgttagctttgatgctacaataccttttcaaacctcttctcctatacatctcatttagatctttcataacttggctttttcaaaatagatgtcaactaaaggcagctgagctaatcaggtattttaattaatggcatctgaattattatgacagtgtgatcatagagatgccatttttgtcttcagtaatcaacccttcttccttaagaaggtgtgggagcaggtccttgattaaatagatctgggaaatgctgaatattggattctcctcttggagattttacaatgctaataagatttggagaaatcctgtagtaaagaaatctgcccagcattttcaacccagttgatatgatttggctgtattcccagccaaatctcatcttgaattgtagttcccataatccccacatgttgtgggagaaacctggtaggaggtaattaaatcataggggcagttactctcatgctgttctcatgatagtgagtgaattctcatgagatctgatggttttataaggggctttccccttccttcgctttcattgtccttcctgccaccatgtgaagaaggacatgtttacttcccctaccaccatgattgtaagtttcctgaggcatccccagccatgcaggatggtgagtcaattaaacctctttcctttataaattacccagtctcaggtatgtctttattagcagcatgagaagagattaaaacactggttatttcccaaacatatttgtccacatgattttatcatgtatgcctctttatgttggactaaaccagtattcagtggcacacatttaaaaatattgctattctcaagtaaatttggactcctctgttcatagctgttgagttgtacactgccaagaataactgatttttattcccaaaccagtttatgccagttttacttagagattattactagggaggccgaggcaggccgatcacctgaggttgggagttcgagaccaccctgaccaacatggggaaaccccatctctactaaaaatacaaaattagctgggtgtggtggtgcatgcctataatcccagctactcaggaaggctgaggcaggagaatcgcttgaactcaagaggtggaggctgcagccgagatcgcaccactgtactccagcctggggaacaagagtgaaactcggtctcaaataaataaataaataaataagtattatataaatgaatgcctttcatatgtccattcctgttcttatatattctcagcttgttgaccacagttccctgggctgaattttgtgagtgcacccttactttgttcagctttttgtcattatcaggagagaaaaggcaaatgttgcaaaaaaaaaaaagatagacttggcagttttttctaatagctaaactgtgaccttggcacccatccccttagaggtcagtaagaggcccttgtaatcatccacaagcagagagtcagctaaagactgagatcaccccttgctcatcagatcctggttaagaagctcatgaagaggaaaaaaaagttcagactccttccacaagctaaataagtgcctctagggtcaggcatcatcaaagagggtcaactaatcaatgttcaccaagcaatttgtgatctgaagtgttgcaagaatgctaaaattatatgtatcttgtcctttacaactgaagatggcacatcaggaggtgatagctctgtgttttgatgctggctgtgactttgtgccagaccttagccccggccctgctgcaggcacacgtccttctttacaggataaccaggcaatttgtggtttactgcctgctgtgtgtgtcctgtgcaaactcacagtgtgctgacacatgactgcctagtaaatatcaggggaatattgaatgctcgtgctcagagcttttattgggaaacactttccctcatcccaccctttgctcctctcctgaatgtccaccaccatgcatcagaacagatcatttatagagatactcttagggaatgccagtctgtgccagtctgcctgtcttccctgcccacatgctcttaccggggccgacttgacacccaaaacaactcagagagttgaagtgatttgcccaagaccacacagctaacaactggcaaatgtggtattgtatctaaaatactagcacagggttgggcacagtggctgacacctgtaatcccaacacttcgggaggctgaggcaggaggactgcctgaacccaggagcctggtcaacatagcaagacctcgtctctactaagaataaaaaaaatattagctgggcatagtggcatacacctgtagtccccagctactcaggagggtcacttgagcccaggaatttgaggtttcaatgagctatgatcatgccactgcagtccagcctgggcaacagagtgagaccctgtctcaaaaaaaaaataaaatgttagcataggcttttaaatcatgtgtttttcacttacagtgaggctgagtagaaatctggggaagaattaaagcagagattccagggatatgttagggcagagcaggactcatggaaggacaagggggttggttttgttttcaatagaattgagaaggtagagtttgaaaacacatttccagaagtccccgtgttggttcccactggatgcttgttaagattatgtaatactcttcagtgctatgtctgttgtttaagtgttctgttcattgggattcttttggttgcaagtgccaaaatccaattcaaatgagcttaaataaacacgggaattttttggcataaaagtcctattaactacaactagattttagttcccaaatgatagtgttaggatctctctatcatctcttgaatttgcttttcacaagctgcctctcactgcaaggtaactcagcgggaaggagaaaatgcttcatttccagtaattttagcaaaagcttcaaaattggcctttatatgctaacttgagtcatatgcccactcttaaaccaattatggtgagtggaggatatgagggtggtgctggatagaaaatgctgattgggcagccagacgacataggtctattcctggagccagaacggagattagcctcactcgtatagcatctactaagagtcggggagaaatgattcctgattttaaaaaagattagaatgaggttaccaagtcaggagaagctaggcacccaaaacaaatgatgtctacttgtcatcttattgtaaagtagggttgcaccccaggatcccatcccgaagagttatttctagatgtgagaggtgtataccatgtacaacaagatccactgtcctggaaacatgagcaggattcaagaaacttgattctcctaaaactgtatctctgctgaatatatcccactatgtccctagtgccaagaagaatgcctgaacctaataggcccacatgaagcatttgttgaatgagtaatttaaaaccaggcagaagggatacagagtttcagtttgggattatgaaaaagttctagacatgaataatggtgatagttgcacaacattgggaatggatgtagtggcactgaactgtgcacttacaaatgattaaaatggtaaacttttatatgtattttgccacactaattttttttaaagaagaaggggaaaaccttaggcattaaggaaaacaagattttggtgacttctggatttttgctttccatttaagcttgccttagtgagtcattggacctcaacggctaggcagtcactgatgggagcagaaagaagtacttatccagcacttctccactgaagttgagcccaaacattggctgttccctactttacagaagaagatcaagggatacaataaggttgggattgatggacgtcaggaggatttgctttaggaatgcacgtgatatatgaaaagggttcagccagaattcacaaactctgttgtctcctatggccagccaggcaggtaagaatgtaaatgaatcagataatgtgagtcaggtggagatccacagccttcctttaaacaggccagtcactgctcatctcagaccagttattgccttgaagaaatacaggttcagtagtgcctggtctcatggtttttcatgagaagccgtatgtgtggaatcttatatgaaatgtttccattttggaaaatgttagcaatcacttttttttcttttttttttctgagacggagtcttgctctgtggcccagactggagtgcagtggtgcaatctcagctcactgcaagctccacctcccgagttcaagtgattctcctgcctcagcctcccgaatagctgggattacaggcacgccccaccacacccagctaatctttgtatttttagtagagaccaggtttcaccatgttggccaggctggtctcaaactcctgacctcatcatccacccacctgagtctcccaaagtgcagggattacaggcgtgagcctccgcgcctggccagcaatcactttttaaatgttctacagtagcatggtaaacagaacacagctattttccagatctttccacttacttccagtttctttccaaggatagactcttcactttttaagaaatgacagtaatgatctcatgtatttgtttatttatttttacgtttttcagtttaaggtgacacaaatggttaggacagataccatcaccccaattttactcttgaagccactgagactttacatggagggacttcagcttgcacccagatcatgcgaaaccatgttctgtgccatgtgagactttaagaggttgctttcaaaactcccccgcaggtttccttatttatcatttatctagatgaattcttcctcccttacattggagaaaacagagtttctcaatttcccatgactctctttgttagtcagatgggagagaaaagtcattacctatgcgaacctgtagaaatagatttgtgtatttttcagtaataaataaaataaccagggaatttaaatcatataatattttccatcttgccagagatggatttttttttcccctggggaaacttttaacttaagaatgtgtttcaatctccttgatgtgttggaataatcattaatgtttacagttgctgtagcaactagaaatgctggcaattgagtaggaagggagcctgagagaggaagataagctgtatcaattattgaacatctgtcaaacagttagccaatttaaagtgacagacaaaaagctagaaatcgaaggtgggtacaatgtatttgttaagttaacaacatcagttatgtattgttttgccactattacagagggataattaacacttatttgcatccacataaagggagcattttctatggcgaatatacagttgcaagtgtaaatttttatgtcataatcatcttaatccatctctcgtggatgttagtttgcagtttcaatatctatttgacagacttttgcattttttaagagcacagaagtgaaacactatgcctctgatcatatgcctctccaggcactctcctctccttatcctaaaaccactactcatttatgcagaagcagtggcctaaatattggccacacgtgtctccagtactctgtcttactctgatggcagttatcatagatcaattaaaactcctttttcctctgagtctctggcattctcaaaaccctaacacagcacctggatagccaatgccagttaggaaggactctgtagtggagtctatttgcaatccctgtctgttaatgatttctcaccttcgcttggcgttttattgtttacaaagtgttcttacttgcatagtctcatttggtcatcaaacctctaaggtgggggttgttatcccttctttacatgtgagaaaactgaggcttagaaagattaagtgatttggccaagatcacagagttagacagaagatacctacttacctactgccttttccactgcactgtaaaagaaaagatcatcaggtaaaaatccagggtgatgggtttcagtactgccctaatcacttactaactaaaaagaagaagaaaaaataataaaacaagaaagtatttaatccttctttagatagttctctctgcttctaataaaggagaactgaacagattttttcctaggatgctttcagctataatctgtaatacatgaactctaagtaaaatctagttgctaagtttctcaattacagcatttgtttattaccaggccacaccctacctcgtggctgcactcccagtttcttcccagatctcagttttttgaaagtgagagagcatattaattttataatttttgctacttctatttgttagcataataagcatgctaacactgtatacatgatcacaagatttaattttctggcctggctttgtttaatgttaagttttaatgagtcaccttttctctcttcctcattttcttttctggaaagcaggattattagctccaagagatgagtcaaatgaagtaacataaatggaaataactttaggaaaataaaatactgtctatgataagatattagggtagctttattccttataaattctgacctgatctgataatattaagtagatgatgatttagaatgggtcttcagaataaatttaaaggaacatgtaagtcatcaaatgattctattcaccatctttgccttatcaacaataataataataaacattaacatttattgagtgctaccatgtgctcgacactgtgctgattataagtagcaatttggctacagtattgcacgtgatcccccaaccctcctatggtgtgttattattatctccatttttcagatgagaaaattgagtcttagatatgttaagtaactttccatgctcacaaagtagtggtaaaccaaggtttcaagaccatgtacgtctaaccccaagttctagagtagatacttgaccggttataaataatacttcacacacccaaggtaaagatatttattttaaaatagaacaaagcatggtcttgcctagatgtcccataaagagctgtaatcatcagatgcccacttttttcctttaatttttcttgaagctgacttttttcttgcaagtctttgtgttattgtcttcaaagaattacaagagtcattgggaagaatccaccatttctaagaaccagtttttacgcagaactattttaagtggtaccagatggataggaaattagtatacaactatttttcaagtggggcttaggaacaatggtaagaaggggccattagtaaatggaggaaggtaaaataagtctctaaggagaaaaagaaatgacaagggtttatattatattaagaaatttttcagatactttttatcacaggggacggaaaaaaaaaaagaacagtgtccactagggagttttttataaaatgaatttattgtttttgttttgttttgttttgtttttgagacggagtctcactctgtcgcccaggctggagtgcagtggtgcgatctcggctcactgcaagctccgcctcccgggttcaagcgattctcctgcctcagcctcccaagtagctgaggctacaggtgcccacgaccacgcccagctcatttttgaatttttagtagagatggagtttcaccacattggccaggctggtcttgaactcctgaccttgtgatctgcccacctcagcctcccaaagtgctaggattgcagccatgagctactgtgtctggcctaatttattgattttttttcaaagcatattacctgaatagaatatttcttctgagtagattttcttgaggaattcaaccaccacatgtactcacttctctgcctgtcagttctgagtcctagtttcttctcccagaccagcttgtcaaaaatacattagacatgagcatggacactttgcgctcgctctctgttttggcgtcttgaaaccagaggaaaaaagacctgtttgttcagtttgaattttaaaaatctctgattggctgatttaagtcatgtgatcctcactgaaccaatcactgtgtcctgaggtatgattggtctcctgtgactcactcccatctctatgctggccttgggggaatgatgactgccgttccccaaaaaccaattgacgaagcattgctaagaagatgaaaagtgcctttctggcaaacctggtaataaagccaaactcatagatgattaatctttcatctagtcctcttcactgcacctcaaggcagaaccggaccattgcagccagtgatggtcttttttgtttttaaaggtccaaataaaagaacaaaatacctttattttgaaaaggatagttccattctttacagaccaacagaccgaatgcttttgttattggtttcacaggagcattagcaagacgcagggaagcggggaaaagcatcttgggccataatgaaaactggcattttatttttctttcttcttctttttttttttttttttttttgagacagagttttgctcttgttgcccaggctggagtgcagtggcacaatctcggctcattgcaaacttcacctccccggttcaagagattttcctgcctcagcctcccaattagttgggattacaggcgcctgccaccacgcctggctaatttttgtatttttggtagagacggggtttctccatgttggccgggctggtctcgatctcctgacctcaagtgatccgcctgcctctgcctcccaaagtgctggcattacaagcatgagccaccctgcccggctgaaaattggtattttcttagcacatttgattaagggttaatttgtgctcgtgatttaaatgtcagttgtctgaattttagatcacaagtttaatcaaggagaatgtggaattgtttaataatttggtgaaaaggttgtgtgttgttaacttgtgtgggagttgattatattacttgaaagcttgctcagtcagtcatattactgcttgaagccttaaagaaagtaaataattagagttaaactgacattttccaccattcaacatttttttcattattcctgagaatccattttagttcccatattgaatcctcttttttctttcttcacagaaattgcttagcttaaagtaagaagacagattttgattatgctgtgagaaaaagcaaaatttctattaattatgatttgtccagtcaaaattttcctacgaaatatatttaagtgctgatggtacgagtgacccgtacaatactgatatttcaggatttaactggtcacctagttccctgaaattctcagtactcctgaatgttgctatggggttaaatactgtggcatacaaaagaaaacaaggttgtcctgatccctaccacagtccccctcaaccacaggcctggcacatcagtcagggtaatcactgctggactgccatgtcattggcttagttaagctggaggtttcagttgcagtggctcctggcataggaaaagaaatctttgtcatggtctcaagagatgtctgttttaatcccaaatctaattccactgatagtctttgtggtcttggaatagcttatgtaattttctatatctcactttccctgtctctccaatggaactaatccttattctacttatttctaaaaattgtcagaggcaccaaatgagataatggatataaaagtgttttgaaaatgtaaagaagtaggaaagttgtggttctgctgatggagatggaggcttacttagtaaggtgaacaaaagtatctggctcactggatccagtttaactttccttgtgcatagagatgtcttattcagtccaggtgttcctgtcacctttgagtaactgtgatctgacctgtgtccaggtcacacgggtgtcatctggtaactctagttttcatcaacatatgtcatttagcgtaagtcacatcaggtggactaacttcgctgctgcatgctttcctttctgcctttactgagtccttctcattcttggccagtcagtcatattttctttctgtcttagtaaactcagcaaaactgcaccagagtcagaaataaatggaaagggaaggatttttaacgaaaggggctcactcattctgacttaaaacatgtattttgatagtccagaggttttttttgttgttattttttccctcctctgatttcagtgaatttgatttaccattaatggtctgatgaaagagatatactttcttatttacaagcgacttctttctcaactaacactttgggcctggagttcagcaataatactgttgctccaggaaacttctggcatttggaattccacttcgattcaactaatgcttagtaagttgatttcacaaaagtaaagtgtatgttctctggccatatgtattcttgtccacaagcagtcttcaagcctggaagatggaggagagatgagcaactgaactattctaatacagttacaaacaaatttcaacgtgtgaaataatgggctggttgctacgaggcaaaaaagaaacaaacacttattttgttgttgaggagagaccacatgtaattttcctggtcaggaaatggctttttgcaaaaggtggtggctgagataagtaaagcagggaaacacgtcctgagaagagagtgcacaagccttgtcagagggactgaaaagcacccggcacacaaggggatcagtgactatttttccactataccttaagcaacccttcttagcagtataaacctttcttaaaatacaatttcgtggggaagtgcaaatttcaaaaacagagctctctgcttaaagcccagatggacgggcacagccctcccactgtgtcttctctttgcagctacaagcgacccctgcaggaatactatgtattgtatgaatccattaatcacggatgcccttactcagcctccctaaagttttgcaactcctcgcttgagggatcctccccaagagtatacattaacaaagagtaaagagtagaaagctaaaattaagtaacttggggtcctgttatggaaggatttgaatgtgagctggatgcattttactttatccaggaggcagtgggactcacagaggatttgtgtgggaaggaaggacatgactcaaagctgccctttggtaggattaatctgacagcgttgtatgggttggcctgcagtggcactgaacctgacacaggcaaaagagcaggatgttcttaggccagtgacagatgacggtgagacaaaaaacctctatggaattcgaatccacaggacttggatgctgattttctccccagcaatgggacccacactccttcctagagagaacctgggatcaaaccacagggcttgtatgaagcgggcataagtgtggagctgaaagagttgtatcatgtgattttgttctgttctcctgctacttgagaaaaagccatattctttctgagactgggcattgaactttgatagttgtctctttagcttttatgtgctttccacattatctgaaagtattctatacttggctgtcaaagggtatccatgcttcaagggattaacacttttaaaatgagctttgtgtgtttgagctctttgtaaaatatggtgatacctttgatttcttaaaataccaaatttttaacaaatagctgaaagaaacattctttatcccccatgaacagtgtttccatctgcccatcatagtccacttcagctgcatctctctgccatggctttactggtttgatggtttgatcacactgaacagactgggccatctattttttgttttgtttttttgagacatagtcttgctctgttggccaggctggagtaaagtggtgcgattatggttcactgccgccttgacctcctgggcgcaagcgatcctcccacctcagcctctccagactcctgagtagctgcgactacaggtgtgaaccaccatacccagctaattttttatttttgtagagatgtggtcttattatgttgcccatgctagtctgggccattctttgtcacagtcaggcaagggtctaatgtcagttctgtatgatttcagcaccccacttttatcccatcaaaatactcatattagcttatatttgttttcttcagcaccattcttataccaacaaaagtatgcaactaagggtcagttccatttatttatctttgtgtctgtatcctaaagcaggggctacaacctaaattgcctatagattcatataggactggtatatggagtagggaatggtagaggctatggcaaactggagactgagtgcctgttcctcagtggaaagctgctattcacctttgacaatcatttgcctgatggaatgagagcctaatgtatccaaaccttttaaaacagtgtttctcagagtgtggtcttcaggccgacagcatcagcagcacctagaaacttgcaattcttgtccctccctgttccacctccagaataagaaattccaagagtgagatccagccttttgtgttgtaacaagcctttccagtgattgtgatgcttactcaaatttgagaaccacttgttatagtggacattgtgttgtatcactcagactgcttttgaggactgatatttgaggactatgtttgtttcaagaaaagcccaatatcaaggccaggcacagtggctcacacctgtaatcccagtactttgggaggctgtgatgggcagatcacttgaggtcagtagttcacggcaagcttggccaaaatggtgaaaccctgtctttaccaaaaaatacaaaaattagccaggcacagtggtgcacgcctgtggtcccacttgggaggccgagatgggagaatcacttgaacccaggtggtggaggctgcaccccggcactccagcctgagtgacagagtgagaccctgtctcagaaaaaaaaaaagaaaaagaaaaagaaaaacccaatatcaagatatatatttgatttttagttttttattatttatttttaattgacaaataaacattgcatatatttatggcatacaacattttaaaattcgtatacattatggattggctaaatcatgctcattaacatgttcattacctcacataccattttttctatggcaagaactttgaaaatttactctcagcaattttcaagaatagaatacattattagtaactatactcaccatgttgtacaatagctctcttgaacttattccttctgtctgactgaaattatttattctttgaccaacattcctccaacctccctgctccccagctagcttctggtaatcacaattctactctctgtttctatgtgttcaacgttttgtgattccacatgtgagtgagatcatgcactgcttgtctttctgtgcctggcttatttcactttgcataatgtcctccaggttcatccatgttgttgcaaataacagtattttattatttttatggctagatactattccactgtgtatatatatcacattttcttcattcattcatccactgatggacacttagttgattccatatcttggctattgtgactagtgctacaataaacatgagagtgcagatacgtctcttcaacatttcattgcctttggattttcagtttcataatatagggaaactataacagacacatccacttgtcagtctcagtctgtcctgtgcactgtcactcttcagcctccactccagtctgaacatgctaacaaaaaggatgctttcctggtttttttttttttttaatgacttcttcccttgcaggatgcaaagtttactgactccagatctaggcaatatttctcaaactttctcactgatacagttctgagagcagaggagagacagggaatgcagaattatatgctgaagccattcactgccaaatacaagattttgttgaagcctttccatttgcctttaaaaatcatataagttgtatgtcctattttgtcatatactcatatttggcttattgtctaaacaatgagttaaattactttcaagttaaattccgtaacttccacccacaatttcttaaagaaaatctgcaccctagaaaaatgctcaatttacccccaaaaaatagaggcaagaaaataagaagttacatgtaagagggggaagttataagtcatactcaaacatattcaagagccatatacctgaccagaaaatgcaccttttgccatcttgcttttccatacctccactgccacatctgagcgagtaaatagcatgtactaaaaatatcttgaacaaagcgagtagtctcttagttggaaggcttatttttagaaatacctggcacaaggttggatgagatttagtactaggccttatctaatccttgcctcatatgggcaccatttcatttctccaaaatcagtactgcaaagacggtgaaaagctttcactttatgtgccaacacaaattgattggaggtaattgcctgaaacactgtactgagaatgattctcagtctgtgtctggcagagtcaattataaatgttagccatgggtgtaggagtggcgactggtggtccaagtgacagatatctgtcatccctgctctactcagcactaataaaaaatgaaagcagtgtctgaaccctggatggtcctgctcattgcttgggacctgtctaaaccaagttctctggaccacagaatattcctaataggggtcctgacagctacagtcatgatttcagcaacctaagctgcaaagggtcattaccgtcattataggtttaaatacaaattagtctgtcttctaattaatagaggtacaatatctctcccatttccacaccttcagatctcaactcatctaagacactgcccctccactcttgtttcccaagcattgttcactggatgacagctcacatatgactttatatttatcattctgtgtcttagtataattaaaatgtcatccagaggccccctctctcagaatccaaagtctattggtcattctcttcttgagagagctctttcatatgacatgagtggttttggtttcttctgaaaccaaacactcttgccttctcctgctacctgtttattgtgcacaatcatcagtgctatttaattcttgcagttcctggtataattcttactttctcagggaaatttttgggttgctcgcaatttctaacatttttttttcgcaaaggtcagagaaagacaaggtatcaatccatttacgaaaagataatttttgttgaaaaaaatgccaaaagaaactctaagaatttacattaatatgtttggtgatcggtgtaactcttggtttaggcagggaaggtattcttttaattatcctatttttcagatgagaaaactgaggaatagaaattactttcctgctgattaaatcccgaagccaagactcaattcatgtctcttgacaccaattccagagatctttccatggacttatgccatttttccctttgctcagcacactgataactaattccaacccctgtctttgtaactgctctccagcacacctctccatctcagcactgagctcagtgcttttgcaaacaactgatgctttgtaaatatttgaccaacaaaggaaccaatgaatacattcattttacccatttcatttgtagaaatcacttaaaatacacttttcacatctactttcttagaattatatatccatttaaattcaacctcacaaacactgtgtaaaaaacaggatacatattgataaaactatctaaaggtaaggggactctatcatgctgttaaaatcatttattaaagccaaaatttgttataatgcaaagactaccattcatgtctcctgacttaactctaatatcttccttctacaaaacacaacgcagcttaaatcaaataaataagagtgtgtgtgtgtgcacgtgtgtgttccagttcttgaccttgccagtaactacccttgtgattcctagcaagttactgggtttccttggatctttctttccttatttgtcaaatgagcatgttggatttgatgatctacatatagaatgtacggaatgatgaaagagactgagacatcatgtaatcccactcccccaatttatagataaggaaaactgatttcttctggctccaaaatacatttttaaaggaacatatggcttcctaacagaatcagctcttctgaatactggggctaccccacagtcccatccctgccacttgtcaaatgtgtgatcatgatccactcatacagtttctctagacttcagtttcctgatatgtaaaattgaaaaagttggactaagagccctttcaggtttaaaactttgaggttaagaaaggcatctttgaaaactgacatctttgccactactgggatatgactcagaacataacgaagcataatatagctctagaaataaattggtgtcaagaacaattaaagagcaaccatccagagaattctgattgatcatttgtgtaatctgttcaatgagtacctggatttgaaaattgcttgattggtgtcttcttttaaaaataagagccatacatcatttgttgttggcttagagatacagaaaaaagaaccaattaagtgagcttcagagttaatttccaatagatttggatgctgcaaaccaaaaaaaccattgctaggcctttcttctttaatgagtatcacaatacaactagcctcagtatttttcagttgagccccagaagtttcacaatccatttaatatgttgcattccaagtatctgtttactcagttgttaaaaattgccaatgggacagaaactgtctgtcacttccagagcaattagtgtgtgaaaacttatcaaaagaaatctgtcaagtttgagtaagtataaatattgcatgaaagtccctaaggaaatcaaactgagtaggatacacttttgcgagttgcagcacagaaaagtttattttgttttatttacttggctttatttttcagaatgttgatagtgcttcatgtaacccaatggattaatgttttgctctgataaaaacagattttggttcttaagggaaatctcaattgtatattgagcgatataaaaataccagatcttggtttcaaatatgaagagctcttactttgtcctagatgggacactggaatgagagttaagctagaacgagtaggttatagtccgcctcacccctttttggtgctccagcctaaccctttctagacctcagaattttcttatctttaaaatgaagaaataggacaagcgatttgttgggtatgttttagttgtactacactttttgcctgctttgatgtctacattctcattacattatattcctcctgctccttcctgattgccctgaagagataaacaaataaaaatacaatattccaggtggtgatatttgatcgtgaaaaaaactaagttaatatcttggtgagagatttcccctgttttaggagcttagtgcttaggccaacatgttctcaccagtacaccagccaagacttttctgctgaccttcccacttcaggactccacagtatttacaaatgtcagatgttgaaccatgttggttaggttccttagcatcttctgtttgaggctcttcttggcatctatggtttcttcttttttttttttttttttttcagcataagaaatggttacgctgttatattgttattacaattggggaaacattacaactttaattcaatatttgttgttgttttctgttgttctatttaatattaatgattttgtagaaactgaagtaatacagttaataatccgtatattttacttattgttttttgaattgaactaattggtacagcgtttcccaaactaggttttttgagctgtgggggttagatggttgtggtggtggtaattccatgagcaaataagtttggatgcttaaacactctctaaggagtttcaaggacattggcatgacaaaatctcttgccagtcctgaaagaaaaaagttgaaactccgttttactttgtttaatccagtacttctcaaagtaatttgatcatgtaaccctttgagttttagggaggtgggggtagaaaacaaagaattaatcatcaaagaccactgtttaggaaatgctgcaggaggcacttccggttgtttgcatctctcactaagttactttagtcacaaaagcagtgaaaccaaaggaatcaacctatttttaattagatcaaatagcatgttaattgaattttcaaaaaagtttttacttctataatgattaacctgttgaagtgcaacaccaataataactaacatctgtacagccctttagagaattcaaagtgctttcacataatcggttgctcaccacttacctgcatcacatttaaaattgtcctcattttatggaccaagaagctgaacatgaagtttaaatggcttccctaatataacgcagatttgaactttagtcttactttgttgttgttgttgttcctctccaattagaaaaagaatgaagcagatgccattttcccaatatcgactttctggttgctaaatgagcctcccgcagaattcagagagccttgcagccagtagctactactgagagttctgaaaaatattgcagggaaaaaaaaatcatttcctagccaggcgcggtggctcacacctgtaatcccagcactttgtggggccgaggagggcagatcacctgaggtcaggagttcgagaccagcctggccaacatggtgaaaccctgtctctactaaaaatacaaaaattagccaagcgtcgtggtgggcacctgtagtcccagctacttgggaggctgagacaggagaattgcttgaacccaggaggcagaggttgcagtgagccaagatcgtgccactgcactccagcctgggcaacaaaaagcaaaactccatctcaaaaaaaaaaaaaaagtttccggtatttgattccaactctccttggagaaatgtgagttgattagtattgtgctggtaaattacattctaacttccatcatgtgactttggaggtgctaatttatacttaaaactctcttataaataattaggggataggtaatcttctcattttgcataggagaaagcttaggtgctgatagattactaggtttgcttgaaactcacctgttgagtatgtaaggactgcattgcgatgctgtttgttgaaagcctgccatacgggatagtacttcttcacaatgtattataggggcttttcctcccccagattttagtttcttgaggaagctttctggaaagcacttgtatatttacactgagtatcctcttgacaccagcatggggttacttgtaatgacatgcacatgcgtaaataaaatgattagccattctcatataaacataattatatctttctaaaataatacatgtggaaatgttataatccagtgataaagggaaagcaatgtgcatgacccctcctttgtgcgtaaacagtggatttaaggcagaatatgtttcctgttgcacattcagttgttaaggtcaagtacaattgggacacattgaaggattacagtacaaaaaatgccttttacagtaattagcgttctctctacaaaactgaagtgacctttctgctattttccaaggacactttatacatttagactttagctcaggatcatatgaaaaagtgacatataagaactcagtcaactagttctgaaaccagaggccccattgcatttagttgttcccttaccctcccctcaacaaagtaatttttgaagataaagtgggacatgttggctactcagtgccagtagctagtatatcacttctccagctttggacaaatctggaaattacactttaaagagaggaatcgtggaatgcctggagctgaagcagtttgatttccttggagcacaatagttcactgcagcaaatcatttatactcactgtcatttagtggtcttctctgaaatggaaagcatgggctcatgtggtccttcataaaacatttacctaattcttataaaagttagaactttcaaaggaacatttttgatacaactgcctatgaaattcatcccactggtcttatgggataagggtgtgtgaaaatgttgctgttttatcactatctcatatccactccctcgtggatctaattttttttaatatggatgtatatttgtggaatcagtcaactagtcagtcagtgtatacttaatgagtgtttgccacagtgttaaactgctctcttactaaaatgatggaaaagtattcaacctcacaagtgagaagaaaaaatttgagttgatagtaggaggcattgggagaagactgcattgacactcaggaattattctgtttctaactagagctaagaatttgaataagttactctgttcctaggtgcccgtttctcagttaatggaaataaaactatcaaatatattggaaagcataaagtgctatgcaagtatggggcattatgatgtaatataatgattattatctataaaacaaaagaaatgatctaaatagtttccagggtggcttccagcattactatatcaagattataggcaccctgggtctgtaatttgagcattactcaatacatgttacatagtgcctgacacctgattagcaaactataaatgcttagcccttgacttaaagaggttggacatcgcttaatcagctatcagtgtatcttttacttctctggaaataaaaccttattgactgatagtagaaaggctggtaaaatgccacgggggactgtgattacttcctatctgtatttagtgggctgaaaaagagtcattggacaacaatgtatacatttttaacctgatcatttctttcatgaaaacagtagagttccagtgccaaaagacatatttgtaatgaagatttttttcctttcagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggtgagttttcaagtaattttgttaattttgtttctgcaatcacaggatgaatgtggaggtatgttatgttgttggcacatgaagctttgttgtctaaattaaatgtaagaaaagtttactgcagcctatatttggtacccatattttctccacttgtgtaagagataaacccatgaatccattttggaaaactaattagaaatctaattgctaatctcaacaggaatagaatgaggatttaggtgaatataaataacaaaggaaggtatttcttgtttctctcccacttaaactgtatacacagtcagaatgaagtgaaaggttgaacaattagctcattaatcaattctgtgtaatttagtattctgtgtccaattatccaaataacttctggatgtacagtactgaacgcatagttcccaccacagtgaaatgtagacataacaaggcttgtttgagacagaaattttaattccccacactattagaatatttcaagaaaatatatgaaattcatatattcttaattacctaaatgacttaacaatgtgtagtaaaaatcactgtgtactttgtaaagacggccgtgtatgccagactctaggagtaccatgccctttcccaccacgggtttttatatatgctgttccctcttcttgaaatgctcctcctttccttagtcccatcctctcagcttctcccttggataaactgatactggttcttccagtttctttaaagatgtcactgtttccaggaagccatctctgcttgctcaccctgccacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatcgaagattctcaataaatatttgttgaataaattcaaacaaagacataattaagcccttcaacaagggctgatatcatgatttaagcagtcgttgtagacatgttcaggtttctattctttttaaatccttttactgtctagtacacattcagatcttctattatgaacaggaatgacgagacccatcacacaagtgaggataccatcagccaaaaacattaataggaaacatctacttgacacttaatatgtgcctagtcactgtgcacagaactatatgtgaattatctcatttaaatctcaatcaattatatgataaacattttcttttgcagacggggaaactggggctcagccacatttgttaaaaattaatggctccaagatttccacccagcacccatgtcttactgactccagagcctgatatcttaaaccctcacagtgcttcgttgcattatactgtaacacctcttatctgaatttatacaagaaaaacttgacaaatgcaagacgggaactcagatttctattccccaagtttgttactctttccctgtgttttgtcagtgaactttgtgcccaagtgatgctctgaacctgaaccttccagaacaaagtattttatatactaagcagctctgaagagagggtctgagcatcctttctacatagactacactgtggaatttttgagcaaataatttagattttaaccattcatttattcatccatttaacatacatttatttagaacttcctgtgtgacagccactatgctgagtgctggtgaacaggaggctcttgcattctcctgggggatgcagacacaaagaaacaagcaaacataaacaaaaccaaaatcctattattttagatgccagtaaaccagtatgataaaatagcagctctgtggtgggtttggggggtggtgggtgtctactttagacagccatggaaagcctttctaaggaggggacatttgagctgagatctgaatagcaagaaaccggccctcttaagatcagagggcagagctttccaggctgagttaacatcatatgcaaaagccctgaggcctgaaaaaaagcactcagcatgttcagaaaacacgaagaacagttgagcgtggttgaagcatagtgagcaggtaggagggtggatagaattaaggttaaaagagagttttaatcttaattagaaataggagaaattagcagattttacttcgagtgcagcgagaagccgttagcgaattgtatgcaaaagagtgatttatgtttttaagaagattgcttagctgctatgtggaaaacggactttcagaaaacaatagtgaaaactggaaatccaatcagaatactactgcaattaattcagttgggaaatgatggggggtgaaactagggggtaacagcagagaaggagagaaatggattcaggatatagtttgctggtaaagctgcgagaacctgatcattccttaaatgtgggagacagtggaagagaaaatcaaggatgacacataggtttctggcatagcagctgagtgtatgggaatgccctttactgaaatggttttactgcacaggttagcaaaggaaaaatcaagaatactattttaaacattatttgtaaaaccaaatacataacttctcccttggcaacaggaggaattatttgttttgtgcttttttggccatctttctataataacattcatctggtatattcatatttgtccgcttgccttccccaccttgctcacattatgatcaaggaaagatcagcgttttcatccgactttgtactgcgctccagcacggtgcttgccacatggcaaatgttaaattaatatgttggattaagctacattatattcaataaaactgaaaattcttatcagcttaaagagaaaagtaagtaaggtactagctctgtcaaaagctatcagtgctatctctccagactgacagatgaagaaagtttcaaaagatatgctccagtggcattttgtaagaaatctcttaaaaatacagcccctgtggcttctacccaaatgcacttaggccagaatatctgttcagtggtattatctgttttggtctatcaagtcatggatgtaattacatattgactttgatatactgtgacatagccagggacagacgtcacacagaactgcctcttcaaaaaacaagaaacaaacattcaggaacacaagcactccagaatcatcatgtacacttcaaactggcaacaactctgccttttccctggcttttagatttatcttgatttgtctggtatatcttcatagagatgacaaatgttttgtattaaaatattttatcacaaagttagcagactaaagatctcattcttcagccattaatgcccactcattcttaatttccatgagtgttgcatggtgaaaattcatgtcttttccatttacactggagtatataaaatggacactcaaactgtgttactaagcacaaaataggttattaaattagctgttttctgaagatgagagaaaaggggaaatacaaatcaagaagagattgcaaaataaagaggacattcttgttaaaatctattctgtgacagtaaaatcaatgaaattctctctcctcaagatctgggatttggtgactgtatattagactggtaagtgcaaggtgagtatagaatttgtacaatcattttgatgattgaagcacactcaaaatttcacatcctctgtctgcctcagaaaagggaaaaaaagcaaggcaaaggagtttgaagcctgagctgaactaattgctagacttgtcatttactttgctaagagcacatgtagctggcagaactgtatttccccaatattcagcttgtttcttgggcatttcagctaagcagtctggactatgatttcttatttgtacccaaaaggccacagtgagtcataaaagttgaacagtgaaccttggctcagttcctaatacaaatgaggtgtgatgagtctcatgtctgttcactgaccatttaccactcacccgagtcctgcaaaaccctggggctccctgttcccttttccccagctcttcacatggctcactccttcctacatctcagatgatgtctcctatgtggggccaggaggtaaggacacaagccatgaggatcccgaagccaagcagtccaggcagagttcagccccaccatttattagccacgtggctttgaatgtgtcagtttaacctcattgtacttagttttctcatcagtaagataagggtaacaacatctacctcagatagttattttatgtgtcataattgaaagtactttgaacagtgacaaaacagaagtatatcatcaataactttcttacctaaaatatgctcaacaaattatatttttaaaagacagattactatagtgtatagatcatattattcttcttttttaaaatagtggataatgacagggaaaagtggaataatactctccaaagtgactaacgatgttaaactctaaagggtttaacttttagtggtaaattttgatttatttttttctttttgcttgtcattatttttctcacttttctaaaacatagagttttcaaatttttagaacattgtttgataaagattattggacctaataggcacttagagatcatgcaattttatatctttattttttgagaaacaagggaactgaagatcagagaattcggataagaaaaatggcatcaggacagattcctggtccctgatcatcatattatttcactgaggttcagaaaaggctgtttgggctctagatttagacatttgcttcgtttcttttgctttataatttttgataattttatagtgagaattatttcaaataactatattactttgcagtattcacttctgggacacataaaaatatgagttggtagatatatgtgagaacagattttatcagagtttatagttatttatccagatatttttaaatctgctttgagaagataactgatttgggaaagtacacctgttgcttaggaaccatgagagggagaaagtataattgggaagaatacatcatggttattattagtacaggtactaaagtagtccattgatccttattagcacagctgttggttataaatagtgatgagcctgctctgttatatgcttcctgcacagatctcaaagagttatccctaaatttccataaacaaaggtaacagaccactcatatagcataactactaaagaaatagtagccttcgatgataatcatattggctcttctgtctttagccacttacatggctctctctaaaatggcttaagatgaaaagaattagcagagattaggacagtcttgagaagatgagataatgtctgttacactgtttatgcacattacattacacacacagggaaatcatttagcatgaaaattcattgtttagcctttgcctttttttctgttttcctggagactggttggggactggtttggaaggtttggaaggttttttttttgttttgttttgttttttaaattttgcttattagaacaaagatgaatgttgagcaatttatagcctgtgtctgtctgataggtccatgcattgcacagtaattgttaaatatttttgaatattaacccgaattggaactccacatagaagagatgctacaaaacaaggaacaatgagattatcctatcttagagtttcaaattctctctttctctgtactctgtctctctttccctttctctcctccatttctatatttacatacattgttaatcatatacattttggatataggtatgtatatataaaccagatatattgtctttgggggttcaaatgtaaagttaacttctctaaatgtttattatacttcagtataaaattaaaatgtttaaaatgtttatgtatgttctcaaatataactgaaatacctgaccatgttttcccaagtcctcactcatttttcacagcctaatttagccatgaaaaacagtgaataagagcagcattgaagtatttaatcttctcatcttaaatcaagctttcacccagtaggaaaaagcccaaacgatgacctcagcatccttcagtttcacaacttttagtcatgtccaggactaaagtcaagagggcaagtaaagggattctggagtatagtcccagacgtaccagcagctctcataagacaaatcattaccatttctttggtccttagtcttctcagctatgcaaaatgggtgatttataataagttctatctaaagtttcttcttcttgtcttcaaggattccagtcacaactttctagcctacttaactccaatctcaacatttgcccaagccagataatatcaggtttaacagacagatgctgctcattgaatccgatttctcatcaatgctgacagctgatccctgcagaaaactaggtgcattcagtctttcaggccacagtgcgccattttgtgagccttcacctctgtgaccattatacctcctagtggctcagaagactacattccccacaaacttctaaatttaagaccaaaggagacctttaaaatagaaagcagaaaactaaaagattctgaaatattcttgttgcagcatcatgcatcctccattatggtcttgccaactggtcactgtaaactttcctaatactgctccatgctacattagatcctcaactgggcatcaacagccactatttttcttcatgaaaagggagctttatttgtaggccacttaattaacctagtgggtttttgaacccagtcatttaggagatctcttctagattggagacgtgatctacaaccctttattgaagacctggcatttagacaggcaacaggtagagatatgccttccacttagacataattttatattatttaagatctagagtttataccaaaacactgctttattttactctcacttctaattgcaacctttgtgtggttttgtcacagcaatcatgtcttgattttaattctctgacaacatcgcagttgaggatctgtgggcgtaaaacatgttttatgaggagaacatctaaatgactaaaggatgtgagatattttgctaaactgccattgctaatctgatttaatagcatcttaatggctctgtgtattttgaaggtttgacaagcttaggaacttggcagtcatctttagacctctagcatagccaattccatttcaggtccatgggggctaaaggtcttggatggccatttggctactcagttagaaagcatctgttaagtgctcgttgtgtgtggcacactatgaaataaaaagacatgatttcagcctgtgggaacctacagtcttagagaattccaagttaatgaagggtctaaagtttcattctttactggaattattgaattgagttctgaataatacatttatagagggacttgaaatgaaagagggaagcagaggtgtttagcctagaattgagttgacttggggcattcttttgatcatgcatttaaccaacgaatactcattgagtatctgttctctacttgtctctagagatgcaaaagtccttctctgccctcatggattatagcctggctgagaagcctaattgcagttagaagcaggagtggggccatactcaggggagaatagagaattaaagcagattcacttcagtttcaattttggtaagaactaccttggagcagtgaagtgtacagggaaattaggtgtagaatcacagcttaagggtgaagaaaccgggcctggtcttgggaatcaacccaaacttccatgaagagtcagacaatctaagataaaataaataattccaggcagcaggcagattatttgttttaactaggaattggcaaactctttcccacaggccaaccttgcctgtggcctgtttctgtaaataatttttctatagaaatgttgggtattcttggctaattcctagattctctatcatttttgctgttacagtaagttgtgcttatccgtttgtttttgtttgtttgttttttgagatagagtctgtctctgtcacccaggctggaatgcagtggtgcgatgtcagctcactgcaacctctgcctcccaggttcaagcaattctcttgccccagcctcccgagtagctgggattacaggcatgtaccaccatacccagctaatttttgtatttttagtagagacagggtctcaccatgttagccaggctggtctcgaacttctgacctcaagtgatcctccaatctcggcctcccaaactgctgggattacagatgtgagctaccatgcccggacagttgtatcttatctttaatcacattatctaattagttgttgcttatatatggaaggtactgttattcttgtgattcagtatttggcaagcttgctgaaatttcttgtagttctaataatttgtctgttgattctattgattctctcaaactttgctatcttctgcatttcctctaagccaaggatcagccaactagtatttatgggcccaccacctatttttgtaaataaagttttattggcacacagccactcccatttgtttaccttatggccatggctgctttccagctacaatggcagagttgagcagtaacagggactgtatagcccacaaaacctagataaaattcttattttctggccttttacagaaaaaactttgttaacccttgacaaaatgatatcattaaatatctgaagactgtccattaaaatacttgttatttgtggctccaaagacttgaactgggaccaacacgtacagagatagagtgtttagttcaatacaacatggatacatggataactttttagtaggaaaaacataggagtacttccttgaaggaaggtgaaaattggcttaaaagatgacattataactaattgcccaaactggaaactattagctcattacttcaggaattcaggaaaaccagtaccgtccagcgcaagcagaggtatttggcctctctgcctttaaatgagacagtcttcttgaaaaaggttatctctgcattttcaatattgaaaaggaaggaaggtggtgcaggtttgattaaagtcaaatcataagatttattttcatctctcacaggtttctgaggacaccttaaaaccttgactgtaagaggtgatgtgacaccttgagataccttgcctctcctgttcagcagtggggaggttcttgtctcaacagttgttgccccatactctgggaattcacctactggatggtggtggtggtagagaagataacttggacagtccactagactacatatatctccttcaacccaggggaaaacatgccttttttcaaaagggcaaaatggtaaactcagtcaggtgaatttgtgtgactaattggatatttccaaatgtttttaggttagtgatatatacatcatatgacttgtttctcaagaaagtcaatgtggaacttttcataaaacaatttttgcctttttttttcaggagaaaatcccactctgtggaagttagtaaatgtcccttctgtagttaaatttagtaagcacagatgccagctaaggcaggtgttggcaaaaatcttatggcacgcaactctgcaaactggtctccttctgccaacagagtctctgcaaattgtacttaaacaagcacgatgtgttgctgatttctctttcatattctctaaattgccagttgttttgttaaattctgtgttcttacagacatcagcatcaactttaataattgtccaggttttgaaggagatacagttgccacaagttcttctacagagtccagactctggatggacttggtccctcaagttgggactccattgctagtactctcccaatgactagcccttaagatatgtttattaatgttaggtggaacttcttgcttttgctcatagttaggaaagttgttcttaaagtgtattcttcagaccagcagcatcaacatcaccttggacttcttaaaattgcaaattcataggctgcatctcaacttactaaatcagaaactcaagcctttcagttgatttcaagtttgagaaccattgttttaggaaaaatacttaagaactgccaaccgtgtcttcctcatgaaatcacctcttttggttattcaataaacagttattgcctgcatgtgccccattactaagccatgtgctgaaaaagagtagcctatgaatgtcatgaatataaggatcagatctgtgttaccacagtgtgcccccatttgtgggcactgcatatggcttattattggtgtcaaatgaatatttacttatttaatttattggaatattaatacaactaagcccctgtcttctaaagactttgatatatggaatttcaagtgccgtaaccttcattactattgttgtatctctcttactccaaagaatataaaacgttggcaatgaattataatgaattaagacatttttactttatgcataaaattatgttaggtgtttttatttagatttgaaagcaagagttgtctttacaggcaaatcatgtatttcatatagcagaaaagtatggctgaggttgtatattttggttgaactagactaaattatatgtgttccttacttctactttgccttggttgtgtagacctgggtaggtctttacatcttcccaccttttttaatagttcgaagatgaaaagggggttctggagcaattccatcaatgttcgcactcttttagcctacttctgtaaatcactagagcagctgtgcaccaattaattgcaaaagcgtacaggtggtcagcagaatgacttgataaatgcactcttattttaaggggcctttcatttcttacaaaacaaaaaaggaaacagcttttaaatttaatgcagaaagtaaaggccaaaatagttaaaataaaaaaattagtcaaataacaacatatcctgtgctagttgtaaccaaattaaatggaacagttcacaggtgttccaaaacgatgttcataatattgttgaagaaaattgcttctcttgtttttatgactttaatactaggccaatctttatatacagtgaaaaatttttaaacagcagtgaaatgatgccattctatctctgatccttctctttatgtactgtactactgccatatatacacattaatctattactgatgactctgttattcacgttcctgtagccataaatatggatcactgtgtatcaatccagaaatcactcactctgtgtgactagataaacaacatatacagatcattttagtaaagaatgatcttaagtgagtgaacttgtactagaagctataattatacttaataaatgacttctatgcctggaaagaagtatatgtttgacttaatggctattatatatcacagcataaacactgcattcctacatcttttcctcccttcaacaaatccttacccatcacattttttcccatattactggtattgggctaagatttgtgaaggatacagaaaaaaatgagaagaatttctatccctaaagcaggtaagagaacaacagaagagatgctctctgtgtgtgtgtgtgtgtgtgtgtgtgtgtgtgtgtgtctttctgtctgtctgtctagctagctagctataaagatgatagaaaacagcattgctatttaagaggtaccctgaagtttatatgtaaaatgttttatgtcagtagttactcactgaacacctacaagtgaagagcctgcagtggaagttaggaatatagctatgaaaaagacagacgcattatttggtgtaatatgttttgccatctaaatggaaggcagacactaaacacatgaataaacaagagaattataaattgtgataagtaacatgaagcaagcaagacagtagtagagaataactctacttggtgtgggcatgagaatatgcccacacaaagacttgcaagtaaatggtcatggaagcattattggtaatagctaaaagtggaagccacccaaatgcccatcaactggtgttatgggttgaattttgtccctcaaatagatatggtgaagtcctaatacccagtgcccctgaatgtaaccttatttagaaatagagtcattgtagatgtaatcagtaaagataaggtcatggtagggtaagatgggccatagatccaatatgactggtgtccttctaagaacacaatgggaagacacacatacacagaaagaatgtcacgtgacaaccgaggcagagatggactgacatgactataagccaatgaatgccaaggattgacagctaccaccagaaggtaggaaggattctgcccagagtctcaaagggtgcatggccctgtcaacacctttatttatgacttctatcctctagaactgtaagagaataaatttcttttgcttagggccactgagtttgtaatgctttgttaaagcatctctaggaaactaatacaaccagcgaatggagaaggaaaatgtggcatatcctacagtggaatattattctgcaataaaaaggaacaaactactggtacctgttacaacatcgatcaatctcgaaaacgctatgttcaatgaaaggagccaggcacaaaagaccacatattgcacaatttaatttataggaaatattcagaaaaaaagcaaatgtacagagacagaaagcagattagaggtttcccagggctgagactgggaatggggattcattgtgaatgggcatgagggatcttactggggtaatggaaatgttctaaaactagattgtggtgatagttgcatgactcagcaaatctgctaaaaaccattggattgcacacttaaaattggtgcactttttagtatgtaaattataccttaaaaacttgttttttaaaaaaaattatcaatggaaacagacaaaggtagaagtttttatcatttgggtcatttaaagaccattgtgggctagagagtagggcctacagaggagagggaaaggcaggcagtaagtaggtaaaggattctgggagagaaaatgttcagtttgggcctaaatagataggattttaggacgcggagataacagttcagggatctgggacattgcatctctgcgttgccagtgatattttagttctttcaaacaaggttgtgtgacatatatttgctccttggtggaattttcatgatcagattaaataaacacaattttatatgtgatatttatagacagagagaggctgggaaaaaacctgaccacttctaagacctccttggcttttgtattctaaccttattgtctcatctccctctaacacatgatacactgcaaggcaggctgtcttgatttcctgggaagacgaaagacctccttctctcaaggcaattctttttaattaacactgctctcagagtatacagccatatacacagcactaaaaggtgttaacttgctcactgcgctcaaagtcatactactgatatttatgggatgatgattcaacggtacgggctgtttgttagcaagttcaacagctgtgtgtgaatgttgttgtgagtatgcactgagtctttaccaggccagctttgtgcagatgctgaaagaaaggccagcccagactcaggggcaagagaactcagacagcagaggctagcccagaaaggaggaataattttgtaaccgaacatgtcaagcatgagtgtaatgtatttgaacctacttttgtagtgttattcatttcgtggtgagaggccttcgtaagagattaagatgaggagtcaggggcctgagtttcaacaccgactggttttctgtgggactaaagataaaccgtttaactcttgagattacagccttgcttgtaaaagaaagggatagattagaactgtgatttttaacctatggagggataagcgtcccttcaagaataggttgctagccgtggatcctctctttagaaaaatgtgcatccaggaggaaattaatacccagattaaggttgctgaaccaaatgatatcaaaggtcccttccaaatccaacactcctcatcattccaggaaaggaagaaaaatgaaaacaagaagaagaactattatgttcgagtttgcactattgacaacatactttatagcaaagttagctagactgtaagtcatcagacacccagggttgattctgtttctcacagtttgaggagatcctcttgatgcttctcaaactctgaaatggctgatgaaaagggtcacctcggtggggtgcggtggctcatgcctgtaatcccagcactttgggaggccgaggcagacagatcacctgaggtcaggaattcaagacgagcctggccaacatagtgaaacctcatcgctactaaaaatacaaaaagtagccatgcatggtggcacgtgcctgtagtcccagctacttgggaggctgaggcacaagaattgcttgaacccgggaggcggaggttgcagtgagccaaaattgtaccacagcactccagcctgggcgacagagcaagactcagtctcaagaaaaaaaaaaaaaaaacaggcaagggcccacctctgcgaagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccattttttgtctttaacctttccttctaaggttcagtctctttttcctctgactatgggaagcctaaaggagagatgaaatggagagccctatctttttatagtaagccaggtaattccaaactctttatgggcacagttgaatcaaagatcataaaaactgatcagagatggaataagaataaatgtattagaacaattagagcagtggcaaattgagtcaagcatgtattgataagaaataattgataaggccaggagcagtgactcatgcctgtaatgccagcaatttaggaggccaaggcaggtggatcacttgaggccaggagttggagaccagcctggccaacatggtgaaaccccgtctccactaaaaatacaaaaaaattagctgggcatggtggtgcacaactgtagtcctagcaactcggggaggctgaagcaggagaatcgcttgaacccggaaggcagagattgcagtgagccaagatcctgccaccacactctagcctgggtgacagagcgagacttcgtctcgaaaaaaaaaaaaagaaaaaggaagaaagaaataactgataagtatttaattgcaaagcatggacttagtttgttagactgtgttaccttgggcataattgtagagtcattttccgggatataggaaaagtgggagaatatgaccctccaaataagtgtgccattggcaaggtaggtgtaacttaaatgttttctgtagctgtatcttgttattcttttttcacaggtccaaaatgtaataaaaatacaggcatttgatgttaccttgaatatactaatttatgattcatttatattggccttggaaatgaaagtaaaagttgtggccacagaatgattactcagaagaattattttattatatagacataattaagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaagtaagttctggtttgcgttccttctcatcctcccttcagcttgagcaggtatagagtttttcttgcactgttcacagcgatggtttctgaggtgacggaaaagcaagtgaagcctttctctttgtaattctgtgtatgcatcttggattctgcccctcaccatggagagaggacatgtaatggtgcaagaaggattaggctgccacaactgacatgaccacaaaggaaaggagaatgggcaattctgaaaaagtattttgttctattatcatgacctgtaatgtgcatgctgtctaacccagaatgacaggaaaacaatggcctccacttgaggtacagttaagctgactatgtggaaaaatacggactttcattttggccccagtttatagaggatgcatcagacttttcttgaatttctttttaaactctcagtctcttctctctactttggatttccttctcctctggctagagataggtaagacgtgttgttctctaagagagtctgttttacaaagttgtccaaatattgtttacaactttattattcagtgtggacttccttgagaaaagcctacttctaaactagctaacttttccttacagaatatatcagacagcataaagaacatgaaatgcacatcatttgggatttttatttgccagtaaccagcaataaagatttggcataaacagtataaactattatctgaagtgagaattttgacatcttctttggattttaatgatccgtgtcaatctttatgcccagccccatctatctgacgaatccattactaactctctttttcctgcgcccaaatgttgactaaggcaacaacagtaactttttttttttttatttttcggtagaggcaggatctgcgtatgttgcccaggctagtcttggactcctggcctcaactaatcctcccacctttgctcgtctaagtgctgggattatagtccctagccactgagccaggcaacactaactccaccaatccttatatcagcgtgtaatctcttttcttatgatttttgtgttttacagcaatcatagaagaggttcctttttccattttattgtcggttctaatagaaaggttgttttggtttccatgtgttttcaagtcgtgacaaataagctacagtcgtatctttactttggtacagtacaatgcagtggtaattttttatgtcctgaaaacttatcatattaaataaattaagacataattataggattgaacactctacagacattaaaagtcaagttgcaaaacaacatttaagacatagaaaatgcccatgctaagagaacaaaagcagattgctaacaggataatatgattacactttttatttttattttaaagtatttgtgtataagcatttatatatatgaaattaaagatgagagcaggtaactgggtagtctagatatacatttgatgaattttttaagatgacaccttgaaaaatcatctgtgaaaaagagcagaattcacgttgttcacacttcaaagggggttatgaattaaactctattcacactgtttgaatagtgctggaataaaaacaaaaatcccaaattggcttcttcagtctacacagaaatgtttgggtatgcacatccagctgctgaaacacatcatcactgcccacttaagagcaggaagactacatctcagtatggttatttttaaaggcatatattaagtgcatatctcatcagtataaagacaccgattatgtacttttcatagaccttttctgcattttgagttagtgtctgtctaacgaacttaaattcttctaaaacaaatatagtagagttgatggctttaatgttttaaataccatctcaggtttcccagagaagattagcaagtctttagtctaattacttctctgtgtgtgtatttgtgaaaaataaataagtaaataattgtatcccctgccaggcagccacaatcttaaaagctgtggttagctcactaaaccattgatttgcagattcaatgatgccctctctgcaatttaagatttgttccaacagttatggcagtaggatgatagatgccttgagagtacataaagacctcacagatggcatctttctttctctcactattttaagcgaagtttccccaacccatcttgcaaatggactgctgtaagttggtaaggttctcaatatataaatgacaaggagaaaaaccatgttgtccaaaagaatgtaccttgagtgaacccttcctgtatgtcagcaataggttgtgtctcccaaattttatgagctcattatttctactatcatttattcattatttggatatttctcaaagtagggcacttgcattgttggtacatagatttatggaaatatattgtttctgttatctattgctacataaccaacttagagggaacaccagaattttattatatcttacaatttgtgggttaagaattcaggcagggcttggctggctgattcttttgcttttagtggcatccttcaggtctttcagtagtatttagctgacagatgaactggtctagaaagctcacaagagtctcacacacatttctggtattttgttggggacgttggaaggctggtgtcactgagactgttatctggaagccttacgtacggcttctccttcctggcggtctcaaggtattcactcttctcgtaggacagctcagggctgccatgagacagaaagcagaagctgccagtttcttaacacctgagctttgatcctgcaacatcacttctgtcttatttattagtcaaagtggttaaaaagcgctaccagattcaaggggaggggccatagacctcatctcaatgggaggaatgtgaaagaatttgcagctatctttaatttgccacaaatgcacatgaacatttttattttcatattttttatttagaaaaaaacatgtatgggtgaaaccttgtctctactaaaaatacaaaaattagctaggcatggtggcgggcgcctgtagtcctagctacttgggaggctgaggcaggagaatcacttgaacccaggaggcagaggttgcagtgagccaagattgcgccactgcaatccagcctggtgacagagtgatactccgtctcaaaataaaaaaaaatatattaaaaaaaaaagaaaagcaaaaaacatatgaggaaacatatataacatataaaaatctgtttttatttcaatgatgatattgtataggagatagatcacttttttttttttttttgagacaaagtctcgctctgtcgcccaggctggagtgcagtagtgcgatcttggctcactgcaacctccgcttcccaggttcaagtgattctcctgcctcagcctcttgagtagctcagattacaggcacctgccaccatgcccgggtaatttttttgtatttttagtagagacggggtttcaccatgttggccaggctggtttcaaactcctgacctcaagtgatctgtccgcctcggcctcccaaagtgccaggattacagatgtgagccattgcaccctgccagatcaccttattgaaagttaagaaaagttatttgattttaagaacactaaataagtaatgctagagatgtggatatgattaaagttataatggagatagaggaatgaatgaagtttgcaaaacacccaaccttatatgtgtagaaccaagaaggaagcgtttaggttcagataaaaggtccagttttctctagtttgattcactcctttttattcttgctatcagtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatggtaagtgtatgatttcagtttatcatttatagtgctacagaacttcctgatattgaaatcataagctgagaggcattcaggcattttgggagagatggtgcagaataggactgtgtgaaactcatggtttgctccataatcagccctggttgattctgggtgtggagagtgagggtggggggcaagggtgttgacggagcagagaggaagacattaggctgatgtgtttggaggatgggtattagtgtgaacacacttgcaaagaagtctgtttttcctctttgcatcaagctgtaaacctgacacaggaaacgttttattattcctactcctgatttatctttttttttttaagctctgtgcttttcttcattagaattttgatttgaggcttgtgctaatcttttgtaattgctcctatttgttagcaatttaatgtggtaccatgaacatttcaaaatgcacactgtccaaatttagttcttatcagagtggaacgtgacaaatctctctcaccccaaagactttttatgtgcagctgctcctattccaatcaaatcatcagcattgatccaaacaatataaatgtaaaaccactagcacatggtcattattgagaccatcttggaaaccctgttaggatactgatttgaaatctcgaaaaggatttcattggataggcattttgaaagcaaactgagttctgccaaattggagcatgccagaatcccatctgtctgggatacagaaaacaaatactatagattgataattatttaagaatggtttaaacaaacaacaatgcatattaaaatgatgagagtagttctgtagggcaagttgtagcaaaagctttaaatgttcttatttcttgcagtaattgatcccacaaaagtctatttatttcactaattcttcttccaaagcattttggttttaagatatgaccgaagttctaagccctccagtagacagaaggggacccctcttggctaagggggggcccagagtaacattgaaaaatgagttcttggccatgatgggagggtaatgtcagacacatctagttatacctgctcccttgctaaccgcaatgagcctttcttccctaagggctaaacacaatctagccctttgaaaagactccatcactgacatcaaccatgcacctgatgctgccccttattttttgcctgataagagaccaccaacacagaatggttctgtcattctagggaggatgtgccgtgaggggtttcatgtcctctggtctaccttttgacatcacagggccaaaacctccaccctcagatgctaatactgccatttttcatacccggaacccatgaagggttgcacatgcagatggttctcctttcataaatatccatgactcctcctgtagcttattaaatatgtatattcatatttatatacatatgaatatgtatataaattcatggcttctgtgtatgaaatatacatatattcatatttatatacatatttatgtacatatgaaaatatgtatatttcatacacagaacccatgaaactcagttgcacatgcacatgtttcttctttcataaatatccatgattcctcctgtagcttattaaatatgtatattcggccattccactcagcacaaattcctgtttgttccctttgctcctccttggaagtgcctgtttacagcttctggccaagggaggctacgcttcctagcctgtcagaatggccaccaggcagactaataaagctctcccttccaaaaagaaagaaagaaatggaaggaagggagggagggagggaaagggaaaaaggaaggaaggaaggaataaaagaaaaagctatggccaaagaattctgatcgataatcacgtaacattttttaaatcttgattggaaactgggcagagatttccactatgagccagccttcaatgacctcccctaagtgactctcagcatttcattttggactcacgttcccctgatgcagcttctgaggggagagaacacacagagttgtagaaagtattaatacttcacttgatgagctgggcagtagctgtttgaatacatctgcacttctcttttatcattcgtctgtcttcaagaatattaaaggactgactctcctcatgccagatgacagacttgatatttaatctttgctttcctcttaaactgtcatagttggtatcttagttgatgggttgtaaagcaaaagacaccacagttaactgactgcaaaatcatgagactgtaaattacagatttattcagtgagatgctatggctgtgtatttttaactgtgtagggctcgtttttctcaccaatgtaataattattttttctatatcagataggaacaatctgtaaatattcagataattggccaacattttctcttttttcttggttgaatagtctcttcagttcagtggtggctgttcctaaatgttatttgagtagcttaactaattgaataaagtcattttaactttcatgattttctgttaactgaaattcctgctctcagtatgttaaactggtatgaaattttctgcaaccaggggtcggcatactgctttcctgtgggttagaggtttcctgcactggaaatacagtactccaggattactgttatggaaaatcaactttgtcactggctcccagccctgtgcagggaaatgtttttttcagggatcctgccctggagatgaaaatcaggttctaacaatgtttcctttttaaatggagttatctgcagccatgcatgggaaaaagagcagaataaaataaaatttgcctgctttctgaagataactcagccttagctcacttgtcagccacgcttggtgttaaaaacttgtcagatcagttgacttccacagcacttggctattgcatttatgtttattcttttgtttttcctcatctagcacatcagtgacaaaaattatctaattgttttcattgtcacagccacaggagagcttaattatacataagcacttggctgtcatcttttttcctctcacttttttctggtctgggtcttcccagtgctgtgttcctaatatccagctgcataggtctccaatttaaatgaattatgataattaaaatcaccatgtagatgataaaaggtgagaaagtaccccagtcacttatccatgaacattctgtctttgttgacaagaatttcttacaacctaggaattataaaccatgggtttgagcttagaaacctgcttctttgggttccaggttgtttattgcattcatcagctctccacttcagcaaccagaagtgtgctaactcctattcagggttggcaaaatggcaatttttttccttcttgcattaaaaccattttgcattaaaaccattttgccttctttcaaaagcctactaggcatgatgattgttcccagtgtctgaataatggaagccctattgccctttggtttgtccctactgtagccatgtctttaagttaccctgtgctactcatgtttggtatgtatgaagaactgaagcaagttcagagatagaacatttttaccctaccccatcttcccaatttgtttttgctataacctgtacggtctagttgaatctacttttctcagtctgtttttggcattaaaaacttcctaaaaatagatttattttcagtggtaaaatgctatggatctctgttactaaagataaacattttccaaaatgactttaatacattatttacttgtttaacaaatttttttttattgcctaccatgtgggagacattatcaggcactatggctgcaagacaaaatccctgccctcaaggacctaatattttactggaagttaaccaaaatgcactattaagcaaataaattaactaggaaattttattttttggtaagagtgataaagaaaataatgaggttgattggccaggtgcagtggcttatgcctgtaatcccagcactttgggaggccgaagtgggtgagtcacttgaggccaggaattcgaaaccagctccgtctctactaaaatataaaaattagctgggtgtggtggtggtgcatgccggtagtcccaactacacgggaggctgaggcaggagaatcacttgaacccaggaggcggaggttccagtgagccgaggttgtgccactgcactccagcctgggcaacagagcaagactccatctcaaataaataaataaataaataatttgatatgatagaaagtagctgagagcaagagaaagatttcataagatgaagtagtcaggaaagacttgtctgggaattgccctctgacccaaaacctaaaggatgaaaatgagctaggctttcaaggggaagtgcattgctggcagaaggtgaggaagtgcaaagactctgaggcagaaaactacttgactttcttgatatgcagcagggaagtcagtgttaactaaatcatagtgagcaaggggcaaaggtttgaaacttgggaaggtgacagactgcagtactttgtaagccaggcacagagtttgggttttattctctgagtaaaatgggaagccattacagcatttcaaggcaggagggtgactcgatttgattaatgttttgaaaagaccgctcaggttgttttgtggtgaatggatgattggaaaccaagagcaaaagccggaccattgccaatatccaggtgagagacattgttggttaggacgtaagagaggaagagaaatggagagacttgagatatattttggagttagagccaataggatatgctcatttcattcctacatctgtctagtttatagatatggaaattgagtcccaaagagattaaagtaattgatttaagtttatacagtaaaaaacagagctagatttcgaatgctttgctagaggttctgaaacttcagtgtgcatcacaatcacttggaagtcttattacaacacagaattctgggtctcgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaataaaatctgctagacttcttagatgtattgatgccatgtaaatattgaaggtctgggatcatatactaagtttgacccctatatttccattatagagttttctcctcatatttcagtcacagatatgccagagttaattagatctctactagtaaatatccatcatgatgtttctaaatcccttttgccaaatgatctaattagagcaacacttggctttctatataattacaacatatggcacctagagggtacatatagtagaattataggttgcctgatgagaaatccaggtggtgggtaaaagactccattaaatagagtaggtgtgtgtgggtgtgtgtgggggggtatgggcatgggtgttaatgtacacaattcctcctacaattctccctagaataagtaatattttgtaattcagctgtccttcccacatgaaacaacatgattatatcatggaacaggagttaaaatttaaaagaaaacaaataattgatgacattaggataaattttttaaccttccatgcccctaaaaatgatcacatgtagtaagtcagcaaggctgaaagcagctctgtgtaagatgcattatgtgatgggatgtattcctccaagcaagatcacttacccaaactgctaaatataaaacaaagatgggaccataaagaaagaatggtttcttaatgcctatttgtaatctctggaagtagagtacccaacttcagtaggtgaagagttcagtgttggtttgttgaatttgaaaagcttatcctgcactgttgtgctggagcccagtagcaagggctcaaaagagtggattctgcacatccattcccagctctctgttcagcgatagctcacattcatagcttgatgttagccatcggcagaatatttacaccatggaaataggcccacttcaagggcagtttttccagagccactgtggtaaacattgacagcacaccactagctgtgggcatatgcagctcagagttggccacgccagtttaaagtccctgggacagatcaggtggagaaacatgactttccaaattgttacttttgaagtaataagggtgtgggaggttcattgagagaaaagagaaaagcaaaagggctgtggacagactcttctgatttatgcagagtgtgcatgaaagagaaaaagaaacagaaaaagttgtcagaaagctaaacggagaaccacgaaatagggctgctgtgaaattctaggtatcatgaatggacagtggtcaacaatgccaggtgtggccacaaagtcattcaggatgagaccacaaatgatatatatttggtgacaatgaattcacaagtgaccttgaaataaatactttagataagtgcaaaagctgtacaggctgcatggtaagcagccagatgcagtggatctttttgcaggtgttaggtaaggaatcggaagcttagatatactgcaagagagtgacatatttgtggcaaggatctcattaggatggaggagattggggaatatttatagcttgagggaaatcacactgtgtcgaagaaggagttaaagatgtaagggaggggagatgattctcaaggagagagcagaagaatggactagaaatcaattattgtgggaaatgatgaggaacctctgttctctgtgggtaggaagagaagatgagtaaagtctcagagaagttaagggtaaaaggagttgaggaatttcatataacatacctttgacctcaatctcaataatatgagagtcaaggtcatcttctgaaagtctggtcatgggggtgattgtgcacttgagcaaaagggaggcctggactgtgttttatggtcaatgtgatagaaataacatttgaattgagctttttatattttcagttgcttccacacacattgactttcccacatattgatttgctctaaagggttttattccaaaagaggtggtttgttccaaaggatgcataaaattgttatagaaaaaatgaggttgactgctcttaatatcaggaaagatgtttttcaggtgaatgcaatgtgttccaactcagaaggaaaacaatgcaatttaaaattactattatcctttctcattttctcaaggactttccctccttcaatcattcctgctctttctctacatcatcagactctcccttttcttactgttcctattggattgttccttccagcacatctgcatcttcctcatccactttgcctcctttgctctgtctactttccctctctctccaggcaatctcctcccctcccatggctgtaaacaccatgtgtgtactgacaaccctgaaatgtgtgtcttcagtacaggattctcccctgagcaatgtatggttaacattcttcagaaggaactcactcctgccaccagtctccaccctgaaccttagtcagttatacaccacctctctctgatcgcttgagcctgaaacctagaaatcactgctaatttctgtttcatcaccccatttatcctatgcatcaataaattttaaaaactttacttccaaagaacataatctatctccttctttctatgtgcattgctggtgcactggcccaaccaccctcatttcttgtccagatggttgcagtagccccgacgcgtcgctctgcttctatactcgctcccttccaatgtgttctctgtaccatagccagaatggtaatggaaatcaaatctcatcacaaatgcttaagatagaagctaagctgttgaacacaacctacaaggtatggcatggtctggctccttgctgtattatttttgtgttttgtttcatttcccctcccttacatctttaactccttcttcaactgcctctccctacctgtacgtgccagaggtctgaggccgtgtataccgcacttctcactataacaccagtgcctcctttcctcttcaatttcttctttgcatttttctgaatttgtaattccatatttatgttttcattgagttgactgttatctgccttcctaaactggcctgtaagctgtgtgaggacaggatctacctggttccgttcaccactatttatccagcactagccctggaatacaacttagggctttagtcaataagtgttcaataaatgaagaaagaaatcaatggacttacagcctcttttcacgaggactagagacttctccaaaaataaaagcaatagtaaagataaaagtaagtaatttagggagttggaataatggagaattgtcagtagaaaaataaaaatggcagcaataaaattagcacatagaaatactttcagtataattcacaggtctggttgtatctgtcttgctacccaatcaaagaaagaaacataattagttataattatcgtgtttataaaattaaaaacaattgtttgtccaatagtaaaatcttagcaaaaccttcctcatgagacgcaattactgcagttgatataagatttcatagatgtgccttataattttcatacatttggcaaatcatgtggtgatggaggacaccttagtaaattaacttctgtgaggtagggccaaatatagagctttttaatggtgaagcttgatgtaagggtacagttgtaaatactacatcaatatttcccaacacgagttcttgagatggggtgggaggtgatgtatagggtataaagtggtgttctataatcaaataagtataagaagtacaatttaaacattttgtattgcagactgtctcagaatccttaatatgttgattacagtgataatcttcaggaagcgtggttcccaaatttatctggaaatcaattttgctgcacagaatacatcaagggactagggtttcagggagcaaaaacttcggaaagctttcctctaagtggatgtaagactttatttactttaggaattccatgattaattttcacaaccatgattgtataaggacggattagaaggaaatgcaagattataattgctggcaaagaatagggagtgcacctattgtgtgtccccaatctagatgaggtgtatactatacagtagggcaaagagaaacgtgagggcaaatgtcagaatgccgcctttagggtggaacaaagatgcaagttccttgggagaatcagcaagcaggagaatcatttagctcacaactgattcctgtccacaaagtcaacaacaaagaaggctgggtaaaagctacagagagtctcaagtttttcctgatgtatttttccacaggctgttagacctaaaactgaatagctaaatcgaaagcaaaccagctatcccaatatagcataacagcatgaacaactcaagcctgcaattagcccagggagaacaggactttacttctagttccctcaagtgtggaagaagcaaagagagcacagtcaagtgagaaggaacactcggcaggttcttagcaattgcaccatcttcgttcttgatttaacatccagcgtttcatgttgattagtgaatacttggttatagagacacaaattttatttagattgtttgtttatttttagactcctaggtaatatataaatatataaatatatttatatatatatatatatattttttttttttgagacggagtcttgctctgtcatcaggctggagtgcagtggtgcaatctcggctcactgcaacctctgactccctggttcaagcaattcacctgccttagcctccccagtagctgggattacaggcatgcaccaccacacccagctaatttttgtatttatagtagagatggggtttcatcatgttggcgaggttggtctcgatctcctgacctcgtgatccacccgccatggctggtaatatttataatggccacaaacagttccctagcaattgatttggaagtgtttgcaatgctgggaacagatacccatatgatgcactttgcctacagatgtttgtatttgtatatgtgattatataataatggaattgtagttccatagtaaaaaataaaaataaaaatccattgatgaatttttcctcagtagctctaataacctttacctgtatcactcaaacataatcacaagccaaggtcatggttcagagaaaaaatgaatttttggggggttttttttttggtgttgctttgtttggtttggtttttgttccacaccctcaaataccaacagaaatataacacctcctttattaaattttatattaacagcaacattttgagataactagagcataaattttttttaccatttcattctcggaagcacaatagcacagagttaaaaaataaatctaagtagtagaattttaaagctaagagcagcatctagtctaagaactccttgaactggctcctcctccatgtgactgcattcattttctttctgataatcatgaaaagttgagctccatgatgttggtaacgaaacttttattatttctgctcctccatagaaccattttgtatttatttttgaatatgtcacacattttgctctccttgaatactagactctattaaacacctaccgaaaacacagcaaagcaaaatgtaagaaaactaacaggaataatttcaaatttcaaatgatagcctctgcctttatttaacaaatatttgaggcaactgaagtaaaaaataacatgaatgctctcttgaactttaccagaaccttgtctaaggctactgctactgccttagattgcgtgtcctgaaacaaactcagatgacaggttgcatacagaaggtttataggggagtgctctctgaggatacacctgcagggaagtgagaaaggcagaaatgagcagagagagaaactgtcctacaggttggttgcaactgggatttcagctagtcccactgagagctctggagctcagatagcccttcagaatggtcttaccttgaggcaagggaatgtggtctttaaatccctggatcagccagtcatgggcctcagatcatcacctataaggggtataagcttagtggaggcagttccccgtttcagggggtaattcagtaagcgacacagctttaagctgccccatattcttgggcagagtttttggaggtagaatgctttggcctgaaggagggaaatctgggtagagtactctttcctataattataagagatgactgtatggcacccttatcataggaagaaacatttggaactactcattatttttaaaaaaatgtcttatgttagccaattagtcttcaacaggatgcccggaggaatctgtctgaatttctcatcatgttcaaagcataagttgtaattgattctttcttggcaagggaacgcagtgtgattcctctgcctcatttcctttttccgatcctcccctcaaaaagcagactcagggaatatgacctagacagtatccccatttttagccttggggactctccattttatgaattccctttttccttttccacagacactctctcttaaaatgtctgggcacctccccctctcagcctttatcctctcttgcttactttttgtcaaagattgtcagtaacttcatttgaggaaggaaagaagggagggaggagacaggaaggaaaggaagaaagcaaatctgaagaaaataaaaaacttcgacatcagatcaataaaaccacctcttcgcctagttcctatgactttttatgcaagagggtcagtgtcttttctctgctttgagttgcaggaaagaaggacactttaattagcctaagttagtacatggccattgcctagaggatagatttgtgtcaaacctaaaaaatcaagggctagaaaaatagaacccattatatatacatcacaatatagttatgcattcaaattcatttggaatttttcaaaagtgagatagaagattttaatgtggaaatgttctgtacaacttatagatgcatgtcatattaggtaagagtagggtccagagagtctcatcttctttcaaggatgtatatcttttcctgtagctaatataatctctgattattaggatttcagggctaaatgaaactttagagataaacagatgagtgggtttcaactaccagttgaaaactctggttttcagccatccctgggggatgcagcatatcactattgttgaaaatggttcattgcacactgattgtcagaggaagtggggatggggaagaggtaaggggagaagggagggtcaataggagtgtatgagaatctcaggcaaggggatgctttggaaaatccctcctgaactttctgtcatgcgtggctttccaagccgtgggatttattggtttccccaggacttttgttttacatttatggtaaaactgaggttagatgattcatgacatgtctcataattaactattgacgtgtatatgctcatgtaacgtcatgtctcactgtaaagcaataaagctttctagcaagaagagtatttagaatcccaccagaaggttccaaaaatcatccaaccaagggttcactgaaatgagctttctttggcaagcacagtatattagctggctccacgtttaattttttaaaattaagttccaacatttataatttggtacatgccctataatccagacttcggacatctcttcaaaaactgaaggatctgcaacagacagcttgcttttttttttctttttttttttttttttgagacagagtctcactgtgtcacccaggctggaatgcagtggcgtgaacatggctcactgcaataatcccagacttctgggttcaaacaatcctcccttcttagcccccatgtagctgggaccacaagtgcacaccaccatgcccagctaatttcttaacgttttgtagcagtggggtctccctttgttgcccaggctggtctcaaactcccgggctcaagcaatcctcccaccttgtcctcccaaagtgctgggattacaggtatgagccactgcccctggccagcctgcatttctgtatggcaatacttatccagagctaagaagagttatccttttagcaaaaacatgaaatcttcagttagccatacaatccttgtatcccaaattaagatgtggtgtcagttgctgcttatcattgttttcgcattgtagtttttcttacagtaaaaataaaagcagaatattttttgcgtctgtttctctatcaaagagtgaaaataagaaaatgtagtcaaaaagaccacacacttcaagaaaatacaggaaaagaatatgttctcttatgccccataacaaattttcctgtgtacaggcaaagcatgtcatgaaaaccttcttgccagcttcattcatttttatgacctgcttacctcctataggcaatagtgcttgtacatctagatctagctctatccctttatgttaccaatgatcattcagaaggagaagaaggttttaaatccctcagactacctgtgaagtctggacaagaacctagttcctcacatctataatagtacagtgttctttttattttaccatgaatggttaatagtggaaactctgtgttttctcttccctggagattgtactaatctactcttgttattttttggttttttgtttttctttttgtcttcatttgctctgtcatactgacgtgaatggcaggttgtcaattaaccctcttcccagattgtattaaaatctgagtataaaagctacagccagatccctatctcttccattatagataccagacatctaacaacacccaagtgagggttttctttataatttttcctacacagctgattgtcagcctaacttagtgcctggtagataaaacggagaattaaacttgccttttaggccaggaaattattctgttctaacattattgctcatattaaaaccctgtgccattaaagctgtctctattaaatgaatatgtgctgggtgcgttgtttattcaatttaattgtagggaaaaaaaaaactcatacgagggaaatggttttttgaactggtttttaccagtcacaagccatgtgaatgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaacaaaaaaatatttttctgtcttttttcttctcttgttaatctatttgtttatttctggcaggtttggagcaaactcatttggtggcaaaaccaaactgaggctattgatagactttgtctttatttaccccatgttgaatcacagaaataataatatattgggttgtgagatactacatacaccagacttttcttgggatgttatataaaataaatatactatggtgttttttaatattcaaaatcctgaatgccaaaacacaactttccctgagagtttttgataaggggttatgtattagaccatttttaaaaaggtaaaataaactaaggctcagtgatattgttttgctcaaaaatagacaactaatcagcccttccagtgacttcccattcacttcaaatagtctctgcttgccatatcctgcagtgtcctacatagccaggcccctacttatctctctgaccatatctgctgctagctagctctttctcttagctacaatcacaccggctttgcagatcctcagtgacatctagctcttttttgcctcagggcctttacacttgcttttcccactaactgaaacactttcttccctgatctttaatgaacagctccttcttgtcccatatctcagctgaaatgttgtctttgcagagagacctcaagcacattcaaaaaagaccttgctcctgtcatgccaaccaaaacgagtgtgatggaaagttagctgaattcctactggattcatagatgaaataatatcagaaagaatacagatattatgaagtttgttttttctgcctaacgtctagtacttctttgtctgaaagaagcaccctagcgatgctttcaggaagggccttttcccattatttgcacccttccttgcttttttcagtgccaagtgctctgctgttctctacccagtggaccgggttatgggaaggcacaggctaagccaatcagaccctctccttctttcaagaatcagaattttcctatgggcaggacacagagcagagacattgggtggcagctccctggggatattgctccttaaattctactctctagacccccagagctactactggttgctgtcctttccaagccctatttgttctgctttttcttcagtttgtgagttaccccatatcttttcaataagttccccattttgcataatttaactttgcttttttgaaacagactttggtctattttagttacttacaatacccaaaccctaactgatataggcaaacagatagaacatctttaatttgtatgtttttctctaaatctaacttagaaaagtaactctttaatggcatttgggtgttcatcttagtggttaaaaataattatatcttatcccatttgaataaaacaacttaagaagttgaatatctacaatttgaggaaggggagcaatttgaaacattttgcttcgcaaagatgtttgcatccagcttaactgcttacccacctgattaagtaccttatccatgactaatggagttgtcgaacatgtggacttgcagagactcatggaattaaaatggatgtatcccctccagagagccctgtttcctcgaagggtagctagcactggagtgggatgctgtgtattcccacaggcatgtgctgacatgggagttgctgaaatttggaggctgaaacattttggctgcctttgtgcaaactcaggttgtctggcatctgcatcctcccagaatgagtcattgtatgtccatgcttcattgattcttgctgaaggagatttggacaatgggcctgaacctgccaaatgagtttgggaagccccaaacacatcggtagcttgttatataagcatcttgtgctcagcagttaggcctgccactgtctgtgatgagtagcaggtccctgtcatagtgacatccagatgaggttatttgcttacctctgtgcatgacatgtgagcccaaagatgctggactaggtcctcttccagcaaaatggtgcgcattgcccagatggtcttgcataagctgagaaagaatagagaaggcaacgtgtggccactcacctagactctcatttgagctcccttgtcagtgctttatgaatgtggaggatgaaaagatatcccagcattctttgatgaattggttttaactctatatggagaccttcctgaatcccaagataatctaatctctatttccacagcccatgaacttatccttataacatctgaagttcaaattatttatttagaatttgtgtcctatactagaccttacatttcatgacaacacgagttgcctatcttgatcattgtcatatcttatgcacttagcatagtacttgacacataatggacattaaatacatatatgatgaatgaattcactagctgtatcactttgggcaggttacttaatctctcgaaacctaattccccatctgttcaatggtgataataatggtaaccatcttagaaagggttatatgaggtaacccacgagaagcttagaattgtgtcttttgttgttatcattgataataaataacgaacaatgaatcttccctctactttcaaaaagggaagtcatatagaccagtggtcccctttttggcaccaggaactggtttcgtggaagacaatttttccacagatggcgggtggggtgggaggtggttttgggataaaagtgttccatctcagattatcaggcattagattctcataaggggcatgcaacctctagatccctcaaatgcacagttcacaatagggttcaggtcctgtcctgtgagaatctaatgctgctgctcatctgacagaaggcggagcacagactgtgatgcttgctcacaggctctcacctcctgctgtgccacctggttcctaacaggccatggaccagtaccagtctgtctgcagcctgggggttggggacccctgttctagactactgtgtaaatttagttcgtgcataattcgtctaaacttattggtaatacatagatatttactgtcttctccatgactccaagaagtgttttaactttacagatgaaaaggtcctacaaggaaggtttcagtcgttcatatgtgtatatcagaaaaacaaaggtggctcatctctccacagtagtttcactggtgatattttcattgcaaattcctttttacaggtgtcaaaaatcatagtatgtgggaatgtctgcctctagtgaccttcaatgcactattaaaaaaagaagttttgttttggattgccaggattttaaccttcaaactagcctgtgtgtcatggatccctgcactagaaggcttttagaaaaacagataaactaaaaggaagctttacagactgaacatcagctacaggaagacctaggtgattcccaactctatacccaggtgccaggaaggttctaaaagtcagtaaacacagagaggccattctactacccctggcctgaggccccaaattctggtgaaaagttctgctgcccttgtagtatggagctttttaaagcaaaggcagaaatacttagaaaaagaaagaggatgagcataagatctaccttctcccaaagcagccttatcgaaagccttagtgagatggtttctaggatatagttggaacctgtctggactcacagctccctatgtatgttgaactcttagtccaagactctcttggatcttgaggtaactacagtaccataaaaaggactagatttggggaatggcatcagagccagagctttgccatctatgtagtcttgagcaagtcacttaatttattgtacttaaaatggacttaataagaaacacctgcaatgttctgctcagatttcattagatgggaaagtgctttttatatggctctaacctctaaccactgtagagtttttgttacatgcatttttaggtctatgtgcattttttcaaaatgaaattatataataccttattgttttattatttgactctttgattgacagtatatagtagataccattccctactgaagaatataacattttcattctatgtttttattttttatggcgcaatcatatggcattgtatgactttgtcaattcactacaaatatttattacttaattttgaacagttcagtttcttctttagaactgctgtttaatctactacagttcacatcaattgcatcaaatctctagtattctaattagaatgcaataccaactatgggaattaccaagcagctgtattttgggcatcttcaccaacatggttatagcaacagcgaggatttgttgagtgagtgcctaatatgtgctaggtattttacatatactgtaccttgtataaatctcccccaaactctccagctcattgtcattctgctcattttgcacttgaaggaactaaagctcatcaacatcaactaacttaatcgtagacatagagatgactaagtgacaaaactggaattcatctgtaggttatttgacttcaaaacgacataaactgtgtccactatatgaagcatcttgcttgatctcaaactcagcacatttggatttgatctcaatgtcttgcccttgtctcaaacatgtctccaccgtgtgccaccattttatgaatggtgccatcatctaccaagctcccctaactggtagcctttccttccaactgccctgagatgacctttgtgaatgttaattccccccagattgttaattctaatgaccagcttccattcttcaatttctcagcaccatttgacacaggcggtagatcgctcctccctctgaaatccttgtttcacttggcatccaggaccgcataggcccctggttttttttttttctagtccatccaggccacttcttctccatttgtctattgggtcctcctccattctacaacttctaaactgacccggggcacagtttttgggccttttttgtatatgtcccttcttccttggtgtcttcctctagtctatagccttccaacttacctaaacactggagaagtcatttatatttccagcctgaaattctcccagaatttgagtatattgaatgatatattcaacacctacctaggtctttgcaatctatcctaggcaaaaatgtcctgactccaacatataaattgtcttcccccttagtgaaaggagaggaaagcagtgaagctttgctgggcctattgatttggatgacacgtgttctctgaatcacctagagggattcattgattaattgagtcattaatgcaccgattcattcattcaaatattatttagtgactacatcatttgccaagtaccatgctaagaatctagataaaatgtttagggccaattatctaggaaataagttttctaaattaagtcaattcttaggaatcaccttttggttttcatactaaacagggaatggagtatttctgaatcattaattcccaaatcaacttttctaaaatatgcataatcgtttccaaaatggagatttatttagatgtcacacaagataattgcagctttgtaaacctaacctaagggaaattgagttttcattcagaaaccttatcttgattgcctagacatcacccagcatcctctgacgcctctgcttgatgtccttatgtcagcctgtcctcaggagagaaagaggaaacttcaccaaaatgaacaaggtctttcaccttctccctttaggttttaggaagaagctgtttatgaaagttgtcctccagtgcccattgggaacttgcaaaagatcagttactaccgatggacagtatgtctggtctttctctctttttccacatattaaattgtcattgtgtcaaatgtcttgccatcaaatacggtgctgcaaagaaattgcaattatatttatcagttttttttctctgacctttgaatttcattcagtccacagagaatccttctcggtggttcagagaacatgtgtcatccaaatcaatagagccaacaatctctgatttttctctccccctttcactgagggggagggcagttcatatattgaagtcagaaccttttaagcctggaatggatagcaaagacctacagctttagtgcatgtaatcttgcaatgcaataacctggtagtcacgcaatctggacctagtaacaggttaccacaattccatatggagttttctagtgttttcatcctgtctgcctagtattaattttgagtttctgtctctggaaaattttgtttagattttaaaatcttggtttttgttctctaatcattttctctcactataagattctgactgtcagaattaaatatgttataaaactaatgtttaaccgtagtctcattccctacgccctgccccctgccccgcaccaccccaatcacctagaatattttgaaggaagaaatgggtggtggataatagcagccaggttatctggcagcgcaacctcattttaatattagctaaagcagaaatagtcaagagggcaagtctgccatgaaaagtcttatgaaacattacaaagttaaatggaccactaaaaaacggtagacagaagagacagccaggtgctcaccaaaatcttacagttgaactttaaaagtcatatataatgagcaagattagatgcaaaatcagccataaaaataaactatttcccaagactcaaggctaaagtgcacctaaatcttatttattagcatgactgaactagcagcacagtaaatcgtaattgcatgtgtcagtcacgtggtgtttattaggccttttctgattttgagtgacaaaatacacacaaactcatctcttctatccaccatgttgactctgttctcagacaggtgtcatcctcattaccacaaaatggctgcagcagctctagacattaaatattcagatattcaattccagaaggacagagtgagaatcattttccagaaagtcccaggaaaagtctcattgtagcttactgactctgattgagtcgtataattatccctaactaatcactatagccagaagacatgaaatgctgggattaatttaagcctgggccctgtgcttcatgccaacatttagtagtggagcctactaatatctcatggcagaggctgaaagagggataggtttttaagtggctattattggatatagtgctaatggacgctggacacaactgtttgaacaagaaggaatggtcaaaagtgacagatattgtgaagaaattggaacccttttgcacagctagtggggatgtaaaatgattcagcatcaacatcatgacatgtcctcaaaaaaattaaaagtagaattaccatatgattgaacaattccacttgtagagattactccagaattaaaagcaaggactcagctagatatttgtacatccatgttcattgcagcattatgcataataatcaaaaagtggaaacagcccaaatgtctattgatagaagaataaataaacaaactggggtatacagtggaatattttccagccttaactaggaatgaaattctaacacatgctgccatatggatgaaccttgaaaacatcatgttaaatgaaataaactggacacaaaaggacaaatattgcataattgcacttatatgaagtacctagaataggcaaatggatagagacagaaagtaggataatggttacaaggtgatgggaagggggtaatgggaagtcattgtttagatgggtaaagagtttgctagagatgatgaaaaagttctgaagatggatggtggtgacagttgcacaacagtgtgactgtacttaatgccactgaattcaacacttaaaaataattaaaatggcattttttatgttatatatatattttaccacagtaaaaaagatataaaaaatggaaaataggcaaagacaaaaatcaaaggggcaatatatactcccatctaagttaataaatgatgggaatgttacttcttttttatttttaataggtaaatgatgctaattttatttcttatttttaattatttaattgataaaaattaaatattcaaggtgtacaacatgacttgtgtatatattatataatgattaccacaatcaaattaattaatgcatccatcaccagattgtacattagacccccggaattgttcatcttataactgcaattttatactctttaaccaacatcttcctatttatttcccctacctccagagcccctagcaaccatggctctactttctgcttctacgagctctacttttttagatttcacatgtaagtgacattatacactatttgtctttctgtgcctggtttatttcacttagcataacatcctccaggttcatccttgttgctgcaatggcaggatttctttctttttaaggctgagtaatagtccgctgtacatatttactagtttctttatccattaatcccgtgatggacacttgggttgtttctatatcttggctattgtgaataatgctctgatgaatatgggagtgcagatagctcttcaacatactaatttcattttctttggatatatacgcagaagtgggattgctggattatatggtagttctaatttaaatttttttttgaacaaccgtactattttccacaatggttataccaatttacattcctatcagcagtgtacaagtgttgccttttttccacaccctagtcaatgcttgttgtctcttgtctttttcatagtagtcattcttagcggtgtgagaagatatcttattgtggttttggtttgcatttctctgatgattagtgatactgagcaccttttcatatgcctttggccatttacatgtcttctttttttatttcaactttattttggattcagagagtacatgttcaggtttgtaacatgggtatattgtgtgatggtgaggcttggactacagatgaccccgtcacgcatgtagtgagcatagcacctaataggtagtttttcagctcacatcccctccccaccttccccactctaacagttcccagcatctgtttttctcattctatgtccatgtgtactcaatgtttagctcccactaataagaacatgtggtgttttgttttctatttctgtgttagtttgcttaggataatggtctcccactgcctctatattgtgacaaaggacacgattttgttcttttatatgccgcatagtattccatggtgtatatgtgttgcattttctctatccagtacaccatcagtgggcactcaggttgattccatgtctttgctattgtaaatagtgctgcgatgaacgtaaagtgcatatgtctttttggtagaaccatttatttttctttgggtatatattcagtaatgggattcctgggttgactggtagttctaagagccactgtgactggccttttgatgatattttgatttgtctaatggatttctaatttagtatttctctgatgggaggctgttgcattttaaatggatgtttccacatattgcaagactgtagcatctctaggcccaggcattcctagtcattctgacaaacagaaaatctccatgcttcccaaacgtgctgtaagaagcattgttgcctccaattaagaaacactggtttatgaggaaagaaagtgccagttaaactggctgaatggcagttttatttcatatggtacattaataagtgagcaccccattttatatactagtttctcattagttcttatatattttaagtaatcaaaatgacccaggcaaggtaagttctgaaccttcagggtgaggcctagatattggaccatggaaattcactggcataactcagtttattgaattctcatggcagcccaaccagcaccttgcctgctacctttgtaatgtgcttcttctaaatgttagcataaacaatctgcatttttttgaattatcccggtgattgcttccctggtgcaactatgattaaaaataagacagataagttctaccccaagtagcttacaaaatgtaagcattataatacaatacagaaagcaagaatccccttaagtagcagtaaaatcacaggctgcaagaatgcagggcaggcagaaagacttccagctgcaggaagcagagacagcttcataaaagaggcaacacttaagaggttcttacgtaataagtaagcagtacatttgtagaaaggttggagaggggtattctgggtatgctatgagtaatccagggaactaatgctcaacctaggaagtctagattttatgaacttatggatccctttataactccagagcaactgacagaaagatggaatagcattccattggctagttgtcttgcccaaataacttgtttgacaaaaaccgtgcctccagggaacagaagggtcagtagtcatttgagtatctgcatatatacaaagacacatatacaatgagaacaactgaggcagaaattgaaagcaaagctctcagtgtctatgtcagagcctttccccagacggtgctaagtaaaatatgtaagcacttaaggttagctataaactattcctttgggcaaggaaataaatattattacaggaaactacagcaattttttgacatcaggaaaagaatatagtcctgcaaagtccttttaggtcaaggaaattagcttctaggggaaaatatatttaaaaacaaagagtcagataatgttttcagagcaagttttcagaaggcagtctatttccagtttatgctatctatagagcgtctgtgtaaagctctttaaaaatgtaaacacctaattgcatttcagtatgataagaccataaagtctttaagtctccacaggtatttatgagttcttggtcataactttgaaagcccttttcataattatgcctatcaacatattgtgaaaaaaaatcattgaggagcttacccttggctttagaaatagtatataccatctaattattattttaatataaattatttccttaccattagattaatatctagcccagagcacatgtaattgagaaatctgtttttttatttttagaatcatactaaatttttaagtgactgatttttcaaaaaaaaaaatcttctactcatcagaaacagtttgggatctgtaaaaatcccctagtttattccagacgtaaatttccccaaagacttttagcacctattaagtttttgtctccctaggtatgagagtttgctgtcagttaagaggaaatttataagaaaatgttaaaaccagcttaaataactttctagttctatttaatgttggtacaacttcaatgaaaacatttcaagtcagcatttcaaattcagctgccaagactcaggtaatatttcctggactcaatcatatgggcatgaaacactgcagttctatcttcaaagtcctttgaaatctgtctcatgatatctttagaagaaaatattccaaaatgaaatgaagaacttcattttcagctgaattttcttaacgtctgtcaccttcttaggtgtgggttctgaattttaaatattcctctttttgaacctgtggagattgtaaaaggctacatccctagtgaaaattggtttgagataattccctggaaaacttttgtcaaggtgtacagttgtcactttggttcatgttagaaccaggagaatgtaatatgtaataatgactaatgcccctttaaaagagcatttctctcttttcttgtctgcagatatttctcatgtctataggtaccgcacgggcaagagccatactttagataaatacaggttttgagtttttttgttttttgttttttgtttttggttaatatactgtctctctcaaaatcaaaaataaaagctaaacacttgaggctgcttataatacaagttatatataataggcctgttaaaataaaacatttagacctgtagaagaaggggaatgtgtactttaataatgacttagttagtattattagtgttttgagtttcctaggattctgagccaaaagagaaatcggcaagctgttaaataaagttcattatatgaaaaacggtgttgaagagagacaactttctcctgactttaaattatacattaaatgtgttagttgaatccaggggcaggttgattgcagtaatggcccctgctttgcacatgtcctgcgtcatgtcctttggtagtgccttcccactttcactcttgacttggccagactgcttgctttggccaatgaaatggtagtagaatggatgcaagcaaatgattttgaaagtccttgcacattggagcctaccccttgcggcttttcaaatcgtttcgctaccatgcgaacaagataaaggcctattgtgccgggcgcggtgactcacgcctgtaatcccagcactttgggaggccgaggcgggtggatcacgaggtcaggagatcgagaccatcctggctaacacggtgaaaccccgtctctactaaaaatacaaaaaattagccgggcgtggtgatgggcgcctgtagtcccagctactcgggaggctgaggcaggagaatggcgtgaacccgggaggcggagcttgcagtgagccgagattggaccactgcactccagcctgggcgacagaacgagactccatctcacaaaaaaaaaaaaaaaaaaaggcctactgaatattgaatgaagaggagacaatggcctagtccccctcatcaccccagccaacacctagctgaaacatagactcaagagcaatgaaaagtcttgttattttaagcaactgagtttgggggttgtatgttatgtggtgatagctaactgatacagatatttagacaagggatatctgctaatataatggacagtgtcttgtacagtagtttttcagcaactgttgaaaaactataggactgtctccttatagcaaatgacaacccttgagagcataccttacataaaaataaagatatttttattttcctcactgcctgttatatcaaatgttgttaaatccctgctagagacaacatacccacctctgaaccagaccaccttgttattagaagagagccatcctttgaagtcacacacaacaacactgcttaatggctagggaaacaaaggctattattaatctaaaatgctttaaacagggcttagagagaatgaaataagcagactggagtttagccatggtgcaatgctttgagggcgaaaacaaagccatccatttagataagctttgaaaaacactgtgtagaggggaattcttctagaaagtgtgtcttaacttctacaatccatttgatactcaaaatttttgtgttcctgctttcagtggcacttcctataaaaatccattgccttttccttcttcatcaaagtctttttaagcttggggaaaatagacttgtcaaaaacatgtcaaagacaattacatttgaaattttaagtcatatgaaagatgtaatttgaaccccaagacttatagactctctggacctcaaaaattatttaggtcaaccctatatgatttttgaattccctccaggaaaaacctaacttatctggatctcttctgccaaagacactcccagtaatagaaacttctgtggagaattatgccccttagggaatttttatgtaataaaatgtttatccctagatagagccattcacttttaagccagacgcctggtgcagcacaggaaatcccaggtttcctttctgccacactcttccgaatattcaaagacagcagctcttctgtccccaggttcaccaaagtcatttctttgttcaccaggctaaatgtgtcagcattcttgggttgcagttaaccaaaataactctagctaactcaagcaaacaggaattttattggaaggatatgagggacttagaaaacccctggaagaagcagttttgaaactaaatgaatctaaggtgtccctctgggattaggaaacaggaaaggcagaagctgtatatttacaggaatagtttgatcagggtgcccctgctgagttcatcaggttctttgtcctgctgttccaggaggaaggagttatgtatgactattgtagctttggttgtaagacacagggaaagggagggcctctgaccacagccttaccagattgaatccagtgagaacagctatcctcaaaagaacatatgagtactatgaaaacgggaaaatggatactgagtaggcgaaaacaacaacaattaaaataatgttgaacaccattctttcatcttcatgtgaagtggctttgagtcccatccgtcttgttcctgtgaatcatccagtgtccttagctgccctcttagttggtgttaattttttcaatgaccctctcaaatggtggtgccttgtagctctagctgcagtttgatcagcgcagagtagaatggggttatcccctcccgcattctggatgccgtatatctattaatgctgcccaggattatgttcatgtttttggcactctcatctgcccatcgagtcagactgagtttaaagtcacctaaaacctagtaattaattttctcaccgtttctctagtctatgccacatctgcccccatcattatcatatctcttcctgtgcctagaatgcactcttctactttctgttattgcctagttaacacttccttttccttcagacctcgctcgtattacctcttactgagactcaatttcccttttatagatatttataatactatacacttttcctttacagtacctcatatgatataatttcacatttatgaatgtgattatttggcgtcaagatggtctagaaagaaaatctaaatttcttattacatgatctagcccaaaccttagcagccaatctcatttcttaccactccactcacccatcccactggcctttctgttccaggaaaacacaaatcctgctgtttccttagggcctttgcacttgatgttctctctcattccccattctttgtctgaccactacttatcatcgattagatcttagctcaagtaatacaaagagaggccttccatgtttaacctaaagaaattccatcatcttttgtgcccccaacacacaccaaaagtccatttctatcataagactgtccatattttcttcttagcacatattactgcactaacttatcacattcatatttgctttatttgctttattgttagtctctccttccactgaaatgtgagatccttaagagtaatggcattatttgtcttatttattgttggatacctaattcccagaagagtgcagggcccacagtggatgctcaggaagtatttgttgaattagtgaattgaagaatggtcataaacagaataaattgtcttttccaatagagtttaagtttcatgaagggagcaaccgtatcagttttgttcactattgcatctttagtacattgcctgacacatagtaggttcttattacaaatatgtttcatgaatgcaataccatatttgcactattagtgtttttgagcattcatagggacatttatatttcagggatatttatgttcagacctgactgatacacaatatgtgagcttttcctctcaattccctatcatgaggaaaagaaattggcatcttatctctacctccacccaaagtaatcggcaatttcattggagaaatttttagccaccactgagactagttctgcataagaaaattagactgagatctagcaatttactagggccatcagtttaattatgaatatccaatgtgagtaaatcagacttcaaatgatacatgtttttcaccaaattgcttagtaactctgtcaactcttccattcattgatctctaaaattggaagacttgaggtgaaattccagtctcctaatgtgtagttcagtgtttctctgactttgggagcatataaatcacctaagaaccttaataaaatgcagaatctgattcagaaagtttgggatggggcctgagattgtgtgtttcttataagctcccatatgtgacatagctgctgacctcaaaccaaactttaagtaaggaactagataaccctggataataatagcaaacaccagttgtaagcaagtgtagcactttgtagttttcaaagaacttatttgtaaattaatttttaaaaatccctacaaagacacaattattcaggtatagatgaggaaactgaagttgagaaaactgacacctttaattgaagtcgcacaactagaaatttaaccaagtttctccttccacaactgcagttgtttccccttcacatcatctgtctggaccacattcacccactcattcacagtaaatttaattatgcttccatcgtgccctactcgaggggttgaagatacagcagtgaatgagaaaaagatcttaccaggttttctgatgtgtaaatggaatgattggcccttcccaactccagtggtctgtgattctattacggtgtgccatgtttaaaaaatgaaattatagaattaaggcattatcttaggtatcattttctacctctgtgctctcagaatcaataaacttaaattcagctgatcatcaccgtcatacaaaacttcctcccacattctttgtctcattgcagacaagcatatcggagccaaatttcacgctatccaatcaataattaattctcctcctaactgttcctcctaaattgtattgttttgtgctcctcctggccactgctgccctagttcaggttttctcttgtctagtctggcagtgtctagaagcactttctctggtgatggaaatattctatgtctgtgctaatgcaatacagtagccacttgccgtatgtgggtattgagcacttgaaaggtgaccaacgcaactgaggaagagaaattttaattttccttaattttaacgttaagtttaagtagccacatttgcttagccatctcttggacagcatgtgcctggatccttgcaggaacttttctgcctggtttccgctggcttcttcttatatctaaattgattttcctcattcattcaccagcatgatctttccaaaatgtaaatctgatgatatcactcccatgccttaagttcttatcctgggataaagtctttgcttcctatgtgactggcaagggtctttgtgacctgacccctttctgaacccaccagccccgctttctgcctcacagttaatgctctgacaatgagctaccaccttttctgcatgtcgtcccctgtatgtatctaactcctacatatcccttaagaatcagttcatctccatgaaaaattatcattgattcatccccacccaggacctctactatgttttcaggatactctatagatacatatatcatttcagggaaccacattattttatctgtctcatatttattggtggtgatagtggaaattcaccagactgtgaatttcctaaagggaagggttatttccaattcatctttattgactgagacactaccataggtagtgagcactactagccattgaatgaatgggagatgaaaagaaggagagatggaagaaaggaaagggggattaaaccagctagtatcaaattttaaaaataaatattggctgttaactgttcgggaatctcaatttttcagttaactttatttttttttacagttgatagctagtataaatctcagttagacatatttggatttttggaggactagtggataggtttcctataaacaattgatcatttgaatttagtttcagttgtacaaaataaaaggcattcaggcactgaaagacaaattttgcacgttctcacccacatgtagaagctaaaaattaaaacaattgaactcgtggagacagaaagtagaataacaattaccagaaggagggaggggtggaaaaggggtgatagttaatggatacgaaaatgtagttagacaggatgaagaaaatctatcattcaataacacaatggggtgactataatcaacaataatttattgtatattttgaaataactaaaagcacaaaatttgaatgttcctaatacaaagaaatgataaatgaggttatggataccccacttaccctgatgggatcattacacattatatgcctgtatcaaaatgtcacatgtatcccataaatatatatgcctattatgtacccatagtaattaaatatacatttttaatgaagaaagaataaataaaaggcattgtatcttctctacatagacagattattttaatcagccaaattatatttccttttgctaaaatgtctgagctttgactatattgactggtggacttttaaagccagaagacactaagttcagccatattgtaactgctcaatgggttcaccctgcctgctgcctagacagagcagatttatcaagacaggggaattgcaatagagaaagtataattcactcagagctggctatgtaggagacaggagttttactattactcaaatcattctccctgagcattgggggatcagagtttttaaggataatttggtgggttggtggggagcagggggcagtgagtcaggagttctgattggttgagttggagatgaacacataggaagtcgtagctgtcttcttgcactgagtcagttcctgggtgggggctgtaaaatcagatgagccagtttattgatctgggtggacccagctgatccactgagtacagggtgtgcaaaatatctcaagcactggtcttagattttacaatagtgatattatccccaagagcagtttggggagggaagaatcttgtagcctctggcctcacgactcctaaaccataatttctaatcttttggctaatttgttagcctacaaattagctggggtctaatccccaggcaagaatggggtttcttatgggaaagggctgttattgtctttgttttaaactataaactataaactgagttcctcccaaacttagtttccatcccaatgcccaggagtgaacaaggacagcttggaggttagaagcaagatggagctgtttaggtcagatcgcttttcactgtctcagttataattttgcaatggcagtttccatatcatttttcagaggaaaaaactatacaacttacccatgattaatcagtaagttagtggtgaattcagtagaaactggtgtgtatatgaacacattcttgaagtctaaatctggaaagaaaggcattttgtttttcaaatacctacttcagaggagttttgtttgcttttttttttttttttaatgacaatgattttggttgagattttacttaaaacaaaagttacaaagttgtgccgcctttggtacttcatgctgtgccagttaacagtggggtgggtcatctgtctatgaaccatgaccattttcagttgaaagttagggaagtctgccttatctcaaaagcccttgccttcaggcttctgttcagatggtatcagctggaacaaataagctgagattgcatttgctgttttttgtgctaatctcaagaacattccaaaaatggtttgtcagcagctgaactgagcacagaatctgtgggcatgaccatatttctcctcacaagaaaaatcactttttaagtttcttggaagttgattacaatgtgctttttgctccctcttcaaaagtaagataagtatcggaatctgtcattttctgctttggatgtatgcctaaacagccaaagaagcgcatcaaaaccaaggaaaaaaatgtggaaaggccaacctaaatgtatatagggtatagtccatccacagactatagctacacagacaaagtgaggtgaagaacttggcagttatctgagggattttcccagtttggttgatgcactcgaccatccagagttcctcttgttaagtaactttttgtctgaattttctgaaaaacagaaatagcactaaagatgaatcctgaactctgaataattgtattgtaagtcagaaaaaactttttgtgatcagccactaaaagggaagtcacaagaagagtccaccactactaccaccaccaccaccaccagagcaaacttgtttacagcctctctgagtcattactgtgctaggttttgaacacagagagcaaaaggactatattgcatgagcttatagactggtgaggagacaaacaaggaggtggacagttataatcaggatgggcacccatgttgacccccttcttctggtgtttcagccatttgatgcatcatctatggacacacagatgtttcctctgtatacactgtctcacaagtgacactgtgtattcatcaccactcttcaggttgcaaatgactgaaatccaacccaaactggcttatgaggcatttttgacaactttattgaagtataatttacattccataaaattcactcattttaagtgtacaacgcaatgatttttagtaaattgtactaagttttgcaactatcaccatcatctcattctacattattttcataatatttcaaagggaatctgctgactcacgtatctgaaaatttcagggtttgctgtatgtgctaagggaatatcatcaagacttcatttttgttggtttcattcttagccaatctattccctggtgaaacgacaaatgacccctagcggattatctaccaccttagtaaccccagcagaaaacatatacctcttttccagttgttggaacaaatgtcttaggatgacacacatttatcctgattggtctaggctaggtcaggtgtccactcctgaaccaatcgctttaaccaggagtgtgtgatgctctatctttggccatgtctgtgtcacatgaacaccccagcagccagagaatggtgttacagccacccaaagtacatggtctgaaagtggggagacatgatttcccaaaggaaaattgggattattattattattattattattcctagacaaagagaaatggatgctgtgcaggcaatacagtagatgtccaatccacaggaaaattgtgatcagagtgacgttgcttcttcccttttgaatcccctgtagtggttatcacacagccttttatatagcaagtactcaaaaaatatctgtggattggtcatggacaggctaaaacatagaacagaccaacaatgacagacttttactttcttattttattgttggggaaggctaaaaaattaggagtatgatttcaattattaaagctaataaactggggcttatctgagaggccacatgggagcatgatggtcagagagcggctggatgtgtgtcagaactcaaaagcagattgcagtcagactcttcccctgtgtaggcattgagtacgtagatatatacacccacacacacagacagttgacccttgaacaactaaggggttaggagtaccaaccctctgcacagaaagaaattcacatataacttttgactccccaaaaccttaactatcaatagcatactgtttttgttgttgttgttgtttgttgttgttgttttaagagagacagtcttgctctgtcgcccaggctggagtgcagcagcagcataatcgtagctcattttaacctctaactcctgggctcaagcaatcctctagcctcaccttcccaagtaattgggactacaagtgcatgcccccacacccggccgattctttcatattttttgtagaaacagggcctagctatgttgcccaagctagtctcaaactcctaggatcgagtgatcttactgcctcagcttcccaaagcactaggattataggcatgagccactgcacgtggactaataggctactattgactagaatgccttaatgataacacagtttataaacacttttttttttaattgagacagttttactctgttgcccatgctagagtggtgcagtggcttgattccagctcactgcagcctcgacctgctgggctcaagcaatcctgccacctcagcctcccgggtggttgggactacaggcgcacatcactacacctggctaatttttgtattttttgcatagatggggtttcacaatgtgcccaggctggtctcaaacacctgggctcaactaatccacccacctcagtctctcaaagtgctgcgattgcaagcatgaaccaccatgcccagccaattaacacatattttgtatgttatatggatcatgtactgtattctttattattttttttgagaccgattctcactctgttgcccaggctggagtgcagtggcgtgatcccagctcactgcaacctccgcctcctgggttcaagtgattctcctgactcagccccccgagtagctgagattacaggtgcccgccaccatgcccagttaattttgcatttttcataaagacagggtttcaccatgttagccaggctggtctcaaactcctgacctcaggtgatctgcccatctcggcctcccaaagtgctgggattacaggcctgagccagcacacccagcctacgctgtattcttacaataaagaaaataaaatgttattaagaaaattataaggaagagaagaatatattgactgtttattaagtggaagtgcatcatcatacaggtccttatcctcatcctcttcaagttgagtaggctgaggtggaagaaaatgtgtgtattagtggacttgcacagttcagacccgtgtatttcaatcccgtgttgttcaagggtcaactgtatatctatctatctatatctatatctgtctgtctgtctgtctatctatctatctatctatatatatatatatttggcctttcttattgctctttcatcagaagagtaatgctagtgaatgatctggaattcagtggtataccataagctggcaagaaacctggcaaattgtaatttatattcacaaaacatttttttcaaactatgcaaatctttacatctaacagaaaaacaataagcagaattctagaacctttggaataaataattcagtaccaatagatacattaaagtatattgtttatagaaaggatcagagttgaaaattgttaaggaacaacctgtattttaaaagtaaattttataccatttttcctaaaaggaatatggttcacagcaaatttcagatccataaaaactttatcttctagtgacttttaagattctctttcttgacaggaacttcaagaatggcaagatatttctttcttccacttaactgcaatgtgactatgaagatgctgtaaacatttgcaaattaggttgtaaatagcagcaatgaaagcattaactctcatagccacattttcggaagtgcactttacattatgtggagataggtattaagaaataaacctgaatgcttatataaaaattatgctggagataggtattcagaaataaacctgaatgcttatataaaaatccagcctcctattttccaagcacagtggtataattacagctctaatttatggcatactttgtaggattgctgattaattatacagacctcctgatgttttatattcttttcaactttgtttccctctgctatgtgaccactacaaagcgagtatccctaaatcacttattattcaggttacctaatttttaaaaagtgaatttgctattaacatcattttcttatatagcactgtaacatttatatgttaaaaattattgtactccttaatgttgcagctaactcatacacacacagacacatacactcactcctacacatacacatacagacacacacactcaaagattttaataaattcccgatatttacccaatgtagacatgtctaacagttctgcatgacttgatctgaaatattgaacacttcaacagtgcaacaaagcatgattcgttagggataatactaaccaatctcatttttaaactgattatagggatccaatttgaataatttgctgctgtggattatttggaaacagttgtagcacattttgtttgttgctcgaggttatcagtgttttcagaacactatcttcctttcatagttcttttgagtttaatagttatacaaaagccccatttaccagatttttcaataaatgtagtgtgctgatgattacaggaggatttgccagaaaactcctttacatatacatagtgcaatatcttcagatattatcctcttctttgctttaagtaggtcaggttcacaatgagctgttctccttaaacccctccccttcatatccttatcaaattccctttatcactgtcacatctaaattactatcttctgctttgccaccaagacatttttaatagtaagagcttcctgctcctttcttaagctcttctctttttcggtcatcaacttccccttggaattaggaaaaggcccttgtagatttgggctattaaataggagaggacccatgtatcaagtccttaaatgttctgtcatcatgagaattatttattggaacccattacctgtgcgacttcacagttctttttagatggtttgtctgaaaagaataaaggctcttcgttgaaatgaaatcgctttctttgctacctagggaagaaaatagttgagtctaattatttagaaacgagaggaggattgctgtaaggacttgagtcgatcatggaagtttctcctatgcaaaacagatctgaaggtacagaaaacataaaaataatatccctgggaagagaacacccaggtattaacttaagcacatagcaggctttattgagttttacagaaaaagtaaatacagctgacacaacctcgagactaaaatttttggtgacatctctgtttatcccagacactgatttctctattcagttttgtgatgtggagagtattccgaaggcctgaaagtgttcaaaaccattgtgcatagcttcattttgggggagaatgttataatttgcttctgaaaactaagtaatctctgacctctacccacacatcaagaaaggttagaaatcagtcctaatcccaggaattgtcatcaatgtctctaaaattctaaagactgaatgaattttaatccaataatcaacatatttaatgtgtgcctgtttgtatataaaggactgtataaaatgaaagggagacagagagatggatacgacctgggatttgagttctggaaatcatttgagtaaatggggtgatgatatattgaggaagtgtaacatcaatgccatgtgaatagattgggcagctttggaaggtcatgaattggccattatgcgatttgcccaacacagtttatacttattcataccattgtaagaggaagttgatcatgggagaaaggttgaaatagatgtgtgtttcacaaggtacaagattggcacttctccaagtactcagatcatcttggatggtacacagtatacagacattaaaaagcactgagcaacatagttctcttacactccttctgagaatatcaaggggaaactcatggttggtcctagcatatctgaacacttttgaaatcctgagtaatccctcttttactgaaacaaaaaaagtagttcctaggctgagaatcctgggagacaagtttacctagctggaatataataccttaggtgggtttttatcacatttatttttatgattaccactatttatggcaagtagatactggtttccatgtatcatagcaacaagtttcctttattctttaattttgaactttgaaacatttaaaaaatattgtgactattggttattagaatgatactgaaaataataacagaaatgatctttgcagctaacaatgaccagctgtttaccatgcaccatcacaggcttaaatgtttcatgggaatttttacatttaaccttctcacaaaaaacctatgaaattcaggtgcttgttaattatgacccccattttagagatggcagtctggagcccagaggggttgagactcccaagtcacacgtctagcagataaagaggcaaagatttaggctgtcttgtagtacatcaatgtggccgaaatggagagacgtcagttcaggaaagcttagaatggatgactgttggtgatgctgagtttctgtgcttcccagaaggcaaagatgcagctgttttagggacagggagagaccttggggattttaactggaccgtgacagtggtgttctatcatgatagtgaatgagctagtagattccactttcattttctctcttagaaatattatgaagttctggtattaggggttaaagcaaataaagcatgatcctgccatcaccaaagagttgcaaattggatgcataataaaattaaaacattttttgtttctggcatggccaatattgctatttgtcttatagaaacctcttctcattactaaattatatattctgtatagtgggcccccctttctaattaataattaatattgtcttccaggcattttagttaccaagtggtaaaggaagcttctgtgatttcaacttcaagttatttttcacatattctttacttttgcttctgctttcagacacattaatagggacacatatttctcaatattaggaaaagctatttcaacaagtaaaattagaaagcaaacagaaaaaaaaaagaactatttaattataaccaaagatctaatggtaaatttaaagaaaatctcttaaatgtggttacattttttacttcttgttttatttctttcctacaccctccaacactgcaggatagcatggtaggaagggtacaggctctctagtgagccctgagctcaaaactccactctatttcttgtaaatgacattgactttggatgttttaatttactcctctggatttcatttttcttaactgaaaaatcaggataatgatactcctcagaattgtgcagattaaatgagataatcaatgcaagcagccaacagcacccaataggatgttgtaagtgcttaataaacttcttaagcatctccatgcgcccaatactcaacttagtatatttacagtttttcttctgggtctcttggtccatttctgtccacgtcttctttatttctaattatttctagagacagctgcactttgttattaaactattcttttacaagctactctgctgttctgattttgttatataaagcttcctgagtgctttatatattttaatgtttttttctcattataaaagttatattacttattatgatgctttggtaaaagtatatggaagtatagaaaataacaaataatattgctttaaataatattactttcctgtccttacccccattcatcctcacaatgccttatggaattatgttgaaattgtctcaggtcctaaattctcagaagaaaggaattctaaatcttatattagtggaaacatggagatcttgcatcaatgaaatatagcaatttaagaaacaaattttaggcaaaatgacatccaaacatgtcctttactttatttccttttcccaaagacatggtgtttctagtgttatatgcttaccatgtgaataaataaaatcacaaaattttaccagcccaagaaaagcatttctcatgttcatcatgcactgtgtcacgaagaacaattaaaattaactctgtgatctttaatactcatccagccccaggcagagagttattgccaggttattttaaagggctttcaaactgttgttcagaggaagttaaacctgaatcaaaccaggttaaacaaacacaagtttattttctcttttgagcaatgctgcagacaagggcaatagggtctgaacgcagcttgttcttcaggtggcctgaaatgcacaggttgttcagcagtttattaaacccaaatcttacaacagaaagcaaattatctctaagggaactttgtcaccagggtgtctgttcaatagtgatgtctattgccaccacagagactacacggaaaggtcaatgacaggtttgcctgaaattaccccgggaggaggtgtcttcctattgacctacattaaatttgttatccaaaatacctttttttccttaagatggggagcaaagccatcttctagaggtctcaattgactctttgtaaattgcaattaccacaaaacaatctttctttctataattcaaaataattaattccttcccatcatgctgagaatttccacgtatcttttgaaatcaagtatgtaagcttgggcaaatttcagctaaaagttaaaataccttttgaattttatgaaaagagataggcaaggaaattcaaaccaaaacaagtctttttttttttttcttttcagagaaaagtcttggtgttatttgctatcaggtaggtctatagcatacagcctacccatgccaattaatctgccaggcttttctaatttctcaactggcacaaagccagagacccctgtactgtatccgtatgtcagctcttgcagtcacaggctaattctcctgttgataggttgaatatatgaatctttatctctgtctcttcattgtcacctctctactccttctacattgtgactatttcttgggcattgtattccaaaattatgctgtattgcttttgcctcaagggcaagtaaagacaatgcctttctcataagcagttcagctttcaggcagaacagcttagaataccataggttgccattttggtgtagatcctcctctgtcttattttggttataattttaataccaaagtaaatatttatcacttggccagagtaacaagaaaaagatcaaatgagagatgtagtttaatccaaccaacaaactgggttaattacagaagaaattaaaattgcaggcaggccctaatcttttttttcctactggacttttattctttgatacattacccattaccacccccaaactgtcttttatactcctcatttgattgttattatatcaccgagagagcaataattgcaagtctctgttagctgctgttggggaaaaggccaagccttctacaggctggaaggaggctgagcagtgggcatgggaggtggtgccaggcccacaaaagcagaacccctcctgcgtatcacttcctctgcccctcgtctaagggcttcaaacaaggtctaacagccctggggggtttcctctcttgatacccgttatgggttaaacagtttccctataaaaatcatattcacctagaatctcaaaatgtgaccttatttgggccctttgcagatgtaatcaagttaagatgagatcatactggattgcataggccctaatccaatgactgatgtccttatgtaaggagagggaaatttggatacagagggaagacaatgtaaagagacacacatccgcaccatgtgacgatggaggcagagattggagtgatgcctctgcaagacaaggaacaccaaaaaacaaaagggccaacagccgccagaagctgggagtgaaccaaagggtttctcccgcagagcctccagcagcaaccaacctggccaataccttcatgtcagactgccatcctccaccactgccagagtatagatctttattgttgtaaagcgcctagtttgtggtgtgttgctatggcagccataggaaactactaccacaccacacccatcgtcccctcccactgcattgctctgttctctctgtccagtatgtcttgagtggaaacattgaagaggggatagatcgtggcctcataaccacaggctaccctaaatcccggccccatgtactcaggcacatgctgctactggtttaaagtcagggttcacagtctcaaaggcctgcaggggcctggtaggaacattaaagagaggttcaagccaggcatagacgggagctagaaaacccaccatctgctcaagagggctgctgcccgtctcctccagcctattggtgccctaaggggatatgttgccagtattgccctatcttcccatatgtcacaattagccaggaatgggcttttatatgaaatcatacaattattagattgttattttaattgtgtagaaaaagcaagctcatctgtggctgtgaagttcctctggtctattaatgacaggctcgctgacacgtgcccaattctgtcctgccttgtgatgtacgtgagacctttggttgggggatgcctgtctaaccgccctcattctagggcatcgctgatggcccctggggtcagcagtcttcctttcctggagccaggcctcctgtgacagctctgccatcctcccctctgccatcctcccagtttgcttaagctgagaagtagtcttaccgaaatataagttagtcgctcaccccttgcagagttcaattaactggagtgaggtctggtataaagaaagcgatttattccaaagctagcttggggaaagaaatacagatgtcctgccttaagtataccacttcacttttggaacagaaaacgggtacttttcaaaggtagaggaggaagcaagcaaaacgtgatagctctggtggcttatctacgaggtgttcgagcttgtgactgccggcacctttgtggacaggactaggctgcaaacttaccaggtgggaaggagtttcctatctcttgaggcagtcacctggtaggagggagttttataaaattgaggcagcctcctggtgggggaaagtttctttctggggcgcctaagcacatagttagatgaacttgcccggtagggagtgtctggtgaaggggaggtaaaaggctatatttgcatttctaaagggctatgtaggaagtggggaaccaggggaatgagaagagaaaagagagagaaaaaaataattaaaccatcttagaaaaatggggctacttggtgacagtagcagtaattattttaactatgtttgggattctgtaataaattttagctcttcaggagtttagcctccctcgtaatgtgtaaatctattgtttcactttcaggctttcagctttcaaacacgttttctggaaccaatcatgtataaaagagagtagaagccttttaaggccctttgagttttttttttttttaattgcacataattttaagtgagctattttattcttgatctaacaataataaagatgatttaaaatttaacataacagtttgtcacttttttgtgtattttgtttgtttgttgaaaggaaatgatcactccataatttctttctttgcagaaggagagaagtggttttctaagttgtattctgaagggatttatttctaaggaagtgtttcagtgtgacttaaaggcaagcaaggatacgctgtctccctctacagcagttaggcttcctgctgaactgctcagaaaaatcataggtctccattttgggataatcctcctcttttgggtgatagagtgaagttggcagctttcatcatgtgttactaaagacccccccaaaagaaaagatcagcatttttaaaggtcctgtgtccccagactggttttgatttataggactgacaatgtcaacttttcaatggctgcaactcagagcctcatgtgaagaaagatagattcaatttatctcctgagtccagatttgttcctatcctctgtggatccaaaatctccaaatgacagtgagggaacaactgcttctctatgctctaggtaatttactgtgttgtgaattagatgacctcttttcatgtagggaaaattaagtcttgtgtcatgtctgtatttgtactacttgctgctttatcacctttggcttttctctgttgccaccaataatttaaaaagggccacaggtaggtcaggactaacctgttctaagccaagaacagatttacattttcaattcttttcatcttactccatcactattcataagtattaggaggagctcaaagttcactatcaccctaatagctacaagtcagtcagtagtctaaattgaggaaaccaagatgagatggaccataaaggaaactttgaaatctcatccagaaacaaacatgaaaataaagctattaaagcggcgctgttgtctgaggtaatacccgacgtttgacatctcatgccaagaaaattaaggacacgggcacacacaaggagtgagtttagagccgaagtttaataggcaaaagaaagagaaagaacagctccctctcctgcaagagagaggaacattcaaatgggacttccggcttgtgttggagtacaccagattttatagacaggcttgaggaggcggtatctgatttacatggggcccaaagattggatagaccaggtgtgacgtttacataactcgtggggaagctggctggaccaccctaatattatgcaaatgaggtctttgcctggccagcaccaccctgttgtctgcttcttgctgtacacgtggctggcaaagagaagggacgatggagccactattttaaacatgcctagtcccaggtagtcttttcctattggcacagctgccagcattcacccatgcacgcttccagcttgctttgtctatgtctgcagctcgattttacaagctgctctttgttagaaaagaaaatgatttaggggctgcttttcgttaaaaggaaaacctgggccgggcgcggtggctcacgcctgtagtaccagcactttggcaggccgaggcaggcagatcacgaggtcaggagatcgagaccatcctggctaacacagtgaaaccccgtctctactaaaaatacaaaaaattagccgggcgtggtggcgggcgcctgtagtcccagctactcgggaggctgaggcgggagaatggcgtgaacccaggagttggagcttgcagtgagccgagatcgcagcactgcactccagcctgggcgacagagcgagactccgtctcaaaaaacaaaaaaaggaaaaccttaccgaggactcccgtaccctcactatctgcctaaataatttctccttaactcctgtatcactatccttggactggatttaggtactatattcatgaaaaaaaaaaagaatgtaatattagtggaaaaaccgtttttctaagttggtagaagatccaaatggaaaggaagaaaatatctaagtatttatattgagttgcatttcaaatttttccttgagctagccaaatttgtaccccaaggccgaatgctagctttatagcttatttctggcttataaaaatcccataaaacattggccgagtgtggtggctcactcctggcatctgagcacttcgggaggctgaggccctcggatcacttgaggtcagaagtttcagaccagcctggcctacatggtgaaaccccatctctactaaaaatacaaaatattagctagacgtgggggtacatgcctagctatcagggaggctgaggcgagagaatcgcatgtacccaggagttggaagttgcagtgagccgagatcgtaccactgcactccagcctgggtgacacagcaagactctgtctcaaaaaacaaaaaaatcacataaaacacattaaaagcaacaggtcaaattgtatacttagcctttatatgcagaaaaatatagccaaaattatgtgatacagctgtgtatgaagaaatgtcaggtgcttttttcttcatattcggaactgtgtggttattcttccattatagatagcattcgtcaatcttctaccgaaaagttctatcaaggcagtcatcacggaatcatcttcagaatccattccttccattctacttttactaccaccgtcacctgaacaagttcagcaatttcttggaaagattgcactcttcctgttgtcagggctgaaaactcaatttctaacatcttatattattggcttatataactggggcgtccaaggtgttgacttccaccgtggacagaaatgggctcaaaaatgtcataaggtctctgcttctctttctctctctctttctcttgggctctgtttgtctttggatggcttccttaaggcatgctttctctatatggtaggcaaaataattgccaacaattctagattcccatcttccaaatttagcaatcccagcagaaagagattgttttctcaaagagctcctggttttgatggcatgcttctacacccatcactatagacaagagaatagggtctcctgactggccaggtctgggtccctgcccatctttatacctagatagtttgtcaaacagctttcccattgaaaacagtaatgctcattttactgtgtgcttatagaaatgtgtatgttattgtatggaacacattggcattatttctagatatataatcatcaaaagtaatgatttattatgagcttgagaacaaaaacaataattttcacatcactaaaaaaaatagcacaaagcttgccgggcgcagtggctcacgcctgtaatcccagcactttgggaggcgaggcgggcggatcacgaggtcaggagatcgagaccatcctggcgaacacggtgaaaacctgtctctactaaaaatacaaaaaattagccgggcatggtggcgggtgcctgtagtcccagctactcgggaggctgagacaggagaatggtatgaaccctggaggtggagcttgcagtgagccgagatcgcagcactgcactccagcctgggtgacagagcgagactccatctcaaaaaaaaaaaaaaaaaaaaaaaaaaaaaaaaaaaaaaaaaagcacaaagcctaatatataggaggtatttagtaaagaactatgaataaatgggttcaatatatcatcccccttctgtgtctatttggtgtcacccatatgctttgtgaggcatcataatgtgttgtaggacttcagagtggcagaactactcagcagttgtcttagtcttaacagaatcctttgtaattgcttgaaacagtgggtccaggaaggcacagagcttcacttaatagaacatgtggctaactctggtctattcatgagtgtctcactgacatatgcccaagcacctgtcccgcctggtgtattttacatgtcaggcatcgttctaagcaccgcacatcttaacaacaactctatgagatgtatatagttacttttattatcccatttttacaaacaaggaagctgagttacagagagattaactttcccaaagtcacacaacttctaagtagtagaagcatgatttgagcctagacagtttagttccagagtttatgttcttagttactacactatattgctgtataaaaaagtggttgagtttctccaaagaatagtttatcaaacttcatattacccccacatttggataatagtaagaataagcggtcacagcaatatgttgtgatttaatgaagactactgaaaattaccccttctacaaatgatctccctcactgtctttctctcatctggaattctaacagttagggtcttacctctcttacttacctctttgcaaataacagtgggagagttgagaccctaaaccaatatcaggcactgaaatatttaaaatgaatagtataatagtttataaaaattattttgtaatttcacaaggcccataggaaattggatagggaaactctgaggacaaggggcaaagagagccttctactacgactgtgaaaagctagctggcttttatgcaatgcagataccaaaagcaggaagcaggatggaaatgatggtggggaaaacatttgaagagtgtgaagcactttaagttaacgaaattttcacctatcttatctcattatagaagaagggattttaaaaactgaattagaccagcagttctcaaatggggtgattttgacccccagggtatctttgacaatctctggagacatttttgattgtcatgacgtggggaagggttagagctatgggagtccagtgggtataggccagggatggtgcccattatcccccccaggacaaagaattgttcagtccaaaatgtcgtcagtgccaaggttgggaaactctgtctcagagcttgcataagtaacttggctatgccatatacttgacaagtttcagagtcaaggctagaatccaagtaatctgatgacaagtcctttgcttgtttccgtattcatttccttcagcatgtcagagtttgatacaggcgatggctttaggtttttggaatgatcgtgatactgtttttaatggtataagttattaataggtgtttttgcttttaaagagtcatctcacccctcagaatgtttaatatgctccaagccagtgttacctcatgaaagataagtctgtacataaaacacaaatgtcaccttacatattgaattctcatatgccagtgtttcacaatttctagcaaattattttataaatggaatgtgactaactcctttaaagctatttttgttattattgaggtaattaagatttgttcaccactctgtttttgtcagtgcatctgctccttggcaaatgaggtatcagatggtctttactgagcaactgttatatgcgtagctgtgatgtgaatgaacaaaaggccttcttgtctgtgtcttttttttagccagagcttggatttagcttacgctaaattatttttttaattgtagatttgagatgttttattatgagaagttggtaatcatctgtgtaaactaataagaactgaaaattcatcatacatttacttatttttttaccttgatcttctagtaaatgtttagcttcatagatttaggctgctatgtaagaacattctcctttatctgagtgatgtgatttaacagagtaatttgtttatgagcatctcttattctttctttattggcaggaggacttgcacctctgcttctcattttgtcactttgggttcagacacctctgtaatagccatcactgggggcagatttcagtagactttgaaaaacttgttttccctgaggctccatatgcttcctggtttgcaaaatataatgacccgcaaatccttcaacaacagcaatggttaggcctagcagttaccacctcactggccatggctccagctcggctcccttgcctccaccagaagcatgggtcaccccagcccaaaggccaagacctccaacgccaggcctctaccagaaagcaacataggcaccgccagcaggtacaaactgcccaaccacaggtgcccttgtgccttgtctgcctcttgtaccttgattcgggatgactcagttaatttgcatattgatttcaaattgtcagaagtaacagtcaaaatacaaacagaaggcagaaggctgatgtaattactatattaaaagaaaatatattaaaatgatgttgtccaatttttcctatatatacaaatgaccaaataagagaatactttttttttttttttttttcgagacagggtctcgctctgtctcctaggctggagtgtagtggtgccatctcggctcactgcaacctccacctcctagattcaagccatcctcccacctcagccccccaagtagctgggactataggctcaagccagcacacctggctaatttttgtgttttttgtagagacagggttttgccatgttgcccagactggtctcaaactcctgagctcaagtgatcctcctgcctcagccccctaaagtgctagaattacaggcatgagccgccacacccagcctcgcaaacacaattttaaagatgaaagagaaccactgcctagtaaatatcaggaaacctctaggaaccttactgaccctatcttacctaattcttgctatcaatctataagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattcccatataccatagcctgggtgctttataatttttgtagcagaaagtcctttatgctcttagcaaagcacgtgagtgaaactatttcaatattagcttcatggcatgggctggaagtgctaagtaaccattgaaaaggagaaaatcttaatttacatttcatttgcatttctttcactttatatattgccctgtcataggatttttgagttgaagggatcttgacaatgatttgactgaagaagatgaggctcaggttggtggttctctcaaggtcacgagtagcaggagacctgaacccagatcctgattctgagttcttcttggtcctttatgctgcaccaggaaacaggaagcctttcctgtttctgagtaatttatacagatgggtcatatcatattatttccttcttgcccatttgtagttcccttggtgaagacagatgaaggcaaataaaaatatcaaaaaaaacaatttgcctttaatttaaagaagaaagctaaaaattacctaattaaatattttagggtcattagaagttggaaatgtactactcttttgggaagtctttttatcattaacatacttgaccatgcagatagaaaattggaagtccaagagttagaactaaatatatgtttagattgattacaactatttcagtctattaattacttcctcagagcactagcatcagtgtatgactgactgcttgttcactctgtttcataggcaaaggaaaaagaggttagataatatttgtaaagtgcagttctagctagaggtttttgctaatgtatgactgtcttggctaaaggaagtttagtaatcatttaggaccaagagagatctcaatgtttcagagctggttagacacagagctgggatctgttatagattatttgtgaattatggagatataagagaatattaggttgacatcttaaatcatagttaaaagacagggattcaagtcagagtgatctggatttgagtctcatttctaccacttaccagctcttagacaagacacttagcctgtgtggggataatagcagtgccagtctcatggagtcgctttgataactgtgaaaatccatgttaagtgattagtgtggtgcctggcacctaggaaatattaatagttgttttgtttataaacatgttttcataaaatgaggttgttctgatgactgtggtaatccatgctaagcgattaacagggtgtctggcacctaagaaatattagtatttgttttgttgtttatatattttcaaatggatatgcgtgtattctaaatcctgttgaaatgaacatttatgatatttccaccccaatagaataattagcatagagaagtgagcctataataaagaaatgactaagaatatgaaagattcaaaacagctaagcatagaaaccatatatatggtgtctcatattgttaaaagtagggtattttcacaggtaggaacaaggtatgttctgtattttattatcatccttcttataagtattggcttccttggctctcccaagagttggcagaaaggagaggcctctatttcccatcagagtttgcatcccagtgataccacaagccccaggacaaaaccgttcccaaccaactgtgcagatccctgctgctcatcttacactgaatcacgatgcaaagcctacaaatatatcagggattaaatacgttatagttgcctcatttttgtgtggttataaatattgctaagatagtaatttctacctattctaacaaacaaaataatttatttcttgccttctagtaaaatgtgaacaagtattcacccaagtaagtataggatatagttttaggcagtttacagttacaattttttaaaattttattaactatttgtttctttcaaggtatattaggagaacactagttttccactaacggcaataataacaacaatatttcaaaataaatttacgtaaagaagtgagtcggtacaaagaaaagtactaaatatgcattgttataggaggatatgcaaaaaatcatgaagatggtatatgtgaatgtctaaaactaggaaacatgacttgaggacaatttccaggagagttttagtggacttatagatgcagaattagtatgtcctgcctatgctagccacatgattcgctgaaacatgcacaacactttaaaaactgaaatttcctaataggtgagagaacgaggagggactgaggtaggaagagcctggcccagtacaaaaagaggaaggcagggatgtgtaggtatgagccatgaggttaagggatgatgtgcccaggtagcctgattgacaggtagaattcatgtgtttccaagcagagttatttctggcagtggctcctggttctgagctgcagttagtttctccacagaggtcctctgattcttatattcttcttctaggtgaggtgggggaaaaaagttttatttggccaatatgttctcaggagttaacaatcctgttactttagataaggtcagaagagatttgggggatcatttatctcccagtgtggttggttctcactcccattagcattaatgggaagtacgtgtgtctgcagaggggccatccacagtgcgaggtctccaagaaggacattaacataaactgagaaatataatttaaaaatctgccccataaagcacgatataggcagagaaaaccattctgaactccgcatgaactgtgccaagtcctgaatcccacatcaaaatgcttgagccctgcacctttagtgcaagtgtaacagcttagcccgaaatatgactgagcgctgtattttaattcaattttgagatctacaaagggactaatttatcagagaaggtgttctgtaaccttaaaatgtgcttgtattctttccgatttcctcatgtgtctgggattaaaacaccgtgaaggtcgggcgtcagaacatatcttttctaacctttttacaatagttctatcattaaccatgctttcaaaatccaattctctttctccctacccttgcccccatgtttcggagagaggctgaagatagtgtcaaacacagggtcagcaggtaggggaggagagggaggtggcacatctattccaccagatacaggaggtttagaataaacctctgacaagcaatcatcacatgaataaatattcagattctgcatgagcaggctcccaaactgcagaattctgacaggtgcccagggggctcttgattatcatcccatcatctgaattcctaaattttactggttttgtttttcaggctagttataatatacttgggatttggtttgctgtttcattttaagcaagaacagttcttaagtcaaaccctcaaatactcacagaaagcataatgttagacctttaaacaaaaatgtgcttttgtgatcattgacatcattaagaactctacagagggcagggtacatttatatgcaatattgtacttactaaatcatgtttatctctacagcagagttaaaggggtggtggtgggtggggattttgcatgacacagtgcctctgctatacaggtttcatatgacagatatttttaagtagcagtcctagagaagagcaatttagagtatttgtttggatgtagttcaacaagataactatgttaatagcaaccctcactcctattgattatctccaggactcaaaatgtagggcagtatgctgtggatgctgttaacatagtcatcgtgctgaactacatccaaactgaccttgagcaattttgcaactggtggttccagactatactttgggaaacactgtcctacaccaaagaacttcgtacatgcatgccacctagcaagtgacagttcagtagagtgcatattagaagtgcagatctcctgggcctcactcctaccctaacaaatctaactcctagggaggaggcctggaaaaacctacatttaaaataaataccccaattgatccttatacacatcagagtttagaacattgcattttcaggggtttcacactatgctctgtgggccaaatccatacctgttttatataccccaggggctaagcatggttttcacatgttagctggttgagaaaaaaaccaaaagaacaataatatttttgggcatgaaacttttatgaaattcatcttttagtgtccataaataaagttttgttgtcacatagccatgtcatttttttacatattaactaaggttgctcttgccttacaacagcaaagttgagtaattatgacagagactgtgtaatttttttttttttttgagatggagtttccctgttgttgcccaggctagagtgcaatggtgagatctcagctcactgcaacctttgcctcccgggctcaagcgattctcctgcctcagtctccctagtagctgggattacaagcagatgccacgacgcccagctaatttttgtattttttagtagagacagggtttcaccatgttggtcaaggctggtttcgaactcctgacctcagatgatctgcccgcctcggcctcccaaagtgttgggattacaggcatgagccactgcgccccccgagactgtgtaatatataagtacctatataatatcctcaactttgccacttctgcaaaaccttaaatatttactagtaagtccttcacagaaaagaaaaatacttatcctctctttgataactttttctcttcctcagatcttcaaaattctgtccaaggtatagtctggccaagctatacacaacttttcttgtacccctgctgatcttgcatgctggaaatttccacatgtccttgagtctgattattagctggaagtggtagggagttttctttcccaggaccttagcctcaccccagtatccaaacagttgactttagaacttggatacgagttgaaaatccagaggagagataataaatcattgattgagagggaggaggaaaattacttggcagacactggaacaataattcaatttgattctccagcatgtggggaggattcacacagctggaaccagaatagtaagctaagaagaccctaaagtaagaagcacatgacctggtgtttttttaaaacacttctctcttcctaaacctcccaccgtcaccagcctaaatcagcagaactgttccacctttacctcataattctcagactgcatgttcttcctctaatagcaatttttttttattttgaaattgactatataaagttttaccctaattctgtctggattttaaaagagttcttttggcttttctgtttatttaaatgtctaaattcagtgcatagaattacttttataataagaaaaaataaatttatactttaagtagctttaatagaaaagaagtctttagtggaaattgactaagatcacagatacacgtaacaagaaattattttgtattttcattcttcaaccctacaagccgaaaaggttcctgtggtttagctgagcatttaacggattcctttattgccagaaagagtgctcattgttcaccccatagaaagtttatttatgtttaaatcaacagattttttcatatatatatatatatatatgtgtgtatatatatatttgtaccagcaccaaagagtatctacagcattactattgcgcactatataaaattcttctgttttaactgtaggacattgggaaatatcaacctttccatgcatagcataatagacgcaataaagtagagtcttttcagttggaactttattttgcaaatgagtttgaagcagcccaatcttctatgtaaaactgttcaaggctttatacagatttgacaggggatcaatcagaaatcagtaacatacaatgacggttggctgctaacacacaacaaaagcttttaacattggtcccttataactgaatacatttcaacccaattagatatcttccactggaaccaattatttctgggtgataattaagggtatttctaataggattaacacaaattgtgaccctaggcatctagagtaggaaggaaaagtttgtcattagaagtgctaaatgctaattatggtaggtccctcagtagaagaacatctggccagaacatttcaatactagatcctgttagatctgagatctgtcaccctggagttggtaccagctatggtaggagaatcttaaaagaagggtaggtaattgtgcatcttgttcttcctgtgttcacaaagcgtgtgacataacctggaaatctgatgaaacagggtgtgattatttcctctgacattcttatggacatgtgtgagagccacgtagattgagcaaataacatgcctttggcgatatcaatcatgagtagaatgattccccttttgtccaaatctctctgtaaaaaccttctctccttttgtaatgctgattgcataccatgacagtctgccctgactccagcctgcccatcacttctccatccttggtctagagggaagatgtaattccttaactgttacatttctctatgccaactctgtctttcgtagcaaagcctctatgctgaagacaggcctcgtatttttgcttttggcataaaagacactctgtgggtcaagaagcttgtgtggtaacatcacctcattaataatcagggaaaggcaatgtaagcatctgtgtggtgtgatttttttacatatgagactggcaaaagagaaacatctaacagtaccttttgttggtgactatgtgaggaaaatggtactcacacactctcagtagggatagaaattgcaatagatactgtggagagcaagtaaaattgagaaagtgcaatctccatggcccagcaattccattttctgggcatttaacctagtgggattcacacgtgttctgaggcagacttgcaaaggtgttccttgtgttgttgtttgtaatgaaaagaaaatacaaggaaattaaagaataatacatatggtatcattttatttaatatattgtatgattaaatataaaattagtaatataaaataataccttataatgtttgcatacagaatacacatgcggcataagccctaactcagtatttggagggaggatgcctggagtgagattatgtgaaaggactttagctgtattggtaatatctgtttgggtaaatttttaatatatattcatggggggaaaaaggctggaggtacatgaaaatgtgttaaagccttctaattctggaagagggaatatgagcacatattggtaaatttttgttgtagttttatatgtaaaatatttcaaattaaaaagaatacctcaggtcagaatcctacatggtcagatattgcaggcaaagccatccagacaggaggtctgttttttcagttctctctcagatattgtagaagagacaccttttacctggtgatatttaacccatcccatacaaataatttctttcttgtaaggaaaaaactctcctataaaatgaattaatgaattcttttgtaatgaatatttactaatcagaataaacaaaacaaacaaacaaaaaaggcaaacagaatatgactctttggcttcattatatgtgaagcacataattaatttcttttccagcaattcaaagagacttatgttatactgattcagtttaattgaacttattaccacaagaagataataagaaatatattgaagctatccatctggcttgcattgaaaacctcacatgtttcattcttcatgactgtcataggccatactaattgcctcatttcagctgttttataatcagtatgatttagctatgaatgcgataaaattcttactccagaggaagttgatattaaaaagcatagatctctcacctagctctgctaccacttctgaactcatcctcagcattattacagttatatatttttgaaatacataaataaaaatctatctttttctcgtgcatatctttttaaagtacatctgtcatcttccttctgtcatcctgccatagagctattcctttactgaaggaaagaaatggtttatgttaagcttttcagttcattaaatgtttaaatctcaaggtaggttgttttcaaactatggagtctttaaaaataatttccatagctgaaatggagtttaaatggctaattgtgtaataaataaagagaaaagaaaacttaggcacttttaccttctgtctctaaacatctgaacttcctgtggcttgagaatgatgctttgtcatgtagactggttttatgtgcacatgatctctcagaagaagacgagtttgtggtatgtctatgtgtatgttttaaatcatctgtctccttgtatgttagaggtggtcccatggggggagccaacagttggtcccaggtctgaaagggaaagcttggtttcttataaagcttgaatcagaaaggagacgtgtcagaataattcatgagtgactctccccttcctgttttggcatttgttttctgtgccagaggcaggaggagtataactctcaaagaggcagtcctaccaaatcacgactgaatttctttggctgtcgcaggcaatcaaatttaagaaaactgcccaaaagactttaggcctttaggttaaatacagaatctgaccaagatgaaagcaagttaattaacattttcatcatctctctctgatttactgtagaagatccatttctaaaaagttaaaatggttgtctcttttatgtatccatttgaggaggtgaaagtaggttcctggttatgggagaggaaatgtaagcagaacatttagagttaacagtggctttttgcttggccttctagcaggtctataatcagtgtgcaaaagtgcaagacataattaagtgaagattagcaacattgctttgaagatttcccaaactggaaaacataccaactgtcatcttattaactttttccccttttctctctcttcaaaagtagaactgcttataaatgtaagtaaagcttggattctacctagaagaggaggatccaaagggtcaaatcagaactgccttctcctccatgtatactttaataagcctggcccacatctctcctgatagaacatgtatctgcctccattggctttgtccacagcatgggtagaacacctggtcactgtgcaatttgtaccaacacttcaacttcttcatgtgtaagacaaaggaaattaaattataatgaccagtatagttgatgaagggacactctgatgcagtccaaatatgagggaatagtcaaaaggtacaaaagacaaaactgtctcctccctgtaggccattgtgagccgtagaccacaagcatcagaatcacgtaggagtttttaaataaatgcatattcctggaccctacctctgacctgcagaaccagaatctccagggatgagacccaggaattttcattttcaacaagttcttcagggaatgcctacactcaacaaagcctgcaaacttaggagctcaacctttaggagtagatactgataaacaaagacacagagctgtgttcaaagtacagaaggaacacaaagggaggcaaaactaactaagaggtaaaggtgacaattgaacagggaattgaaatatgagtaagagtctaccagattaaaaaaaaaagtcaaggtaatcccaggaaaaagaaatgtatctaatggccccagtacatgaaggctcctagcatattcagggaaaatacagtggaaaagtgaggggaacacacccatagctattgctcatatttcaggaactgtggaaaataggcaaatactttgattccctttttaatggaaataaaacagatttcatgaactgtagctaagtgacatgacgccaacttcagtagaaattttgcttcttctaagagacattagaatgaaaagtagttatcaccagcatatgattttttaaaattatgttgtaattatattatttgtagaaatattagcaaaaagataatctcatcattcagagagatccacataaatattttttatattttcttctagaattacatccaggctgtattcaatccatatctacatctgtatcttaactgtgtatgtatctgttctcagatctgtaaataaatatccttatcacaaaaagatcatactgtatacactgtttgtaacttcttttttcattagtatctttctaccagcatagattattttgaacaataaataaggactagcctggtttctttatgaatatgtttctatctcctgctcctcaaaatagcatcagcaaaacaaaacaaaaagaacaactcttgtaatatctatgtggggaagatagaagaatctgggggatgtttaggaggattgtttcacatgtttcaccctgaaagtgttggtttggggattgtcttagtccacttgtgctgctataataaaataccatagactgggtaacttgtgaacaatagcagcttctttctcatggctctcggggctgggaagtccaagatcaaggtgctggcaggtttggggtctagggaggggccaattgtcagttcctagatggcaccttgaatactgcatcttccagaggggaggaacactgtgtccagaggggaggaacatggctaatttgtcctgacatggcagagaggatggaacagcaaaagaagacaaactccccacacgaaggtcttttataatgacacctaacctcattcatgactcagtcacctcctaaaagccgtacttcttaatagtgttgcattaaggattatgtttcaacatgaattttggaagggacacaaacattcaaaccatagaagggatttatgtcaatgggggaatgaaatccctagccattctctgccctttcctcaaacttttcctattgaaatttcttatcagttgacacatgctgttactgataacatgctgagtacattctctgatcacatgaatcattagggaataaactaaatatcagaagtagtattcaaaattagtttgaaagataatcatgtgaaccaagtgtaacaagatacatcttaatagtgataaaatataaagatttgcatttttcttcaaaactcaggatgagagagccaaattttagtgtcaggttgtgataggtcttagatgactataacatcatttatgagtctacaatatatatactctttaaaaaaaaaattaaatctagaacataatagtgtccaaaacaagagaggggggaaatatagagatctactgataaaaatacaactggaagaggattgcttttaagatagacattaaaatttgaaatcaccttaaagagtgacaactgggatgataggaacagctgtagaaactgaggctgggtaatccaaggaagagaagacttatagagggtgggaggggaggggtggtcagtgttttcaaacatttaaagagatatcaaactctatgtgacatcagagggcagtaccataagagatgagcaggaactgctggagcagaggatattacttacgtttgataaaaggaaaattttcaaacaattaggccattggcctattatgtatgacattcatttccagactagacatctactctagggaaatatggcagaaagaattcatgtatcagatacaagtgtgtggtttgagtagcctgtagggtcattttctattcatcttagcgttctcagggtctgccctaagtaaatgttgactcatatatcccacccaactctgaaatgttatcattctctgattttatagcttggaaaacttacttctgccctaatgtgcttctactccagagcaaaagcatacccctaggttgaattctgtcacactgactttgttttcttactgtagagtctttctttctttcttttttttttttttttgctttcaatgtgaatttatccataatcagcaatgcagtatgggttgaaaaggttattccgctaattttgagtaatatattctcaagtaacctattctcaaaatagagtccaataaaagtatccgttttctatttaatcatatgttgggatttgaaggggttcaataaacagtaccttgttcagtgcctgagttttgaaacacttgagaagtaagttgaggcagttgggcagatgaaaatcaaatgtcagctttgctagtgataaaggggaatgtggctcagggacatagcaataatgggcttcctaacactgaactccaaattaagcagacttttaccgctacacaacctcaagtctctctcactacgaaaagaaaaataaggagtggaggatcaacgcaataggtgtacatccttcactcttccaggagaaagaatggcactgagccaagaattcctcattgttttttcccagatgcatcactggataaggagtgagtaagaggaaaaaagaggacaggcatgttaggaaacatcaggtgtgtttaaatgtcagctatagaccaagggttacaaactggtagctctcatggctaatttgacttgaacccacagacttgtattgtttggctgtcagagtgtttaaaccttttaaattagaatgcctttagacagggggcatgtattctctaaactgaccccagacctaattattccgtattatcttatagctctaaatcacatgcttaggatactgccacatcctctgtaagcatttgacacgcagtattaagtgggtctcattgctctatgaaaaaaagccagctcttgattatttccaatttttaaattattaagtagatgcaaattgaccatgatggggatttgagaagacgactactagagaagagaatgtttcaaatctttctatttataatgctgtacatgattctacactgaatctgcatttcactcccatatctataccagaaggttatcagtggaagagaaattcagttatctgaatggacatgatcttctcaggagcagtcagtggttaattgggacaagaaaacacaagtcattatcattgagaaatctgaagcaaattgaggcaggttgtcacctttcaccaggaaacaaattagccctgtctttaaaaagacttctttctctctctgctgactggggattcctgtcaactgccaatgaaatagggagagtgtagattaatggtactgtaacagtggccatgaaacaaccataaagccgttttctaatttttatgaatatttttaattgattcgaccagtgtgtttgaatgacaaaatttgtgctaagcttcagctccagaaaatcagggtgccatcttccagctgaaatcagtaggtgcaccagtctgtttggggaaagttctgtgtataaagaaaaagccataaaataccgacaaagtagctcttcctcttggctaatttaccttcatgaactccttgccaactagggacgaatataattcaggtttagctcaaaaaagagagaaacagagatagagagagagagaaataataaaatagtaggtaacatcctgagttataagggttgcaagtaggataaaacttgagatatgacctactttttctacaatttgtgaatatgggaatcattgcagtctaatgcaaagaacagtgaactgaggtcctgtacatctgggggctggttcccagattccagttttctcacctgtaaaatgaagagcctttaatcgagaaaatgaagtccccttctaattctaaagttctctgatttgatgaagaagaagttggaataaagcattaaaacattccaatttcaaatttatttgttaacagtaacaacaaatttatccagagatattctaactcaggcacccccaaaaatgagatgaaatttttcatgtgcaagagatttctattttatgaacatttattttacatgcatcaggttatggtcactcaaggaaagagaaaaattaccatttaaatcgtgtgggcagttttaccaaccagctcatccacgaatggtcatgcgatgaggacctgaaaggacattggactcggtttgcctcgatcttcatatacctgtcaaaatgtgatgatcttgccaggctgaatagaactgatgacattgattttacacagtatggccaccaaacacaagcaagccacttcaaatggctcatagagaaagggctagagagaaaactggttcatttgaacagcatattgattccaaggtggtgccttcctgggagacttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaaaaaaaaaaaaaaaaaaaaaaaaaaaacaaaaaaaccccactgaattgtatacttcttaaatgtttatttatttatttttgagacagagtcttgttctgtcacccaggctggagtgcagtagcatgatcatagctcactgcagccttgacctcctgggcacaagcaatccttccacctcagcccactaggtagctgggattacaggcgcacgccagcacgccaccaagccctactaatttttctgtattttttgtagagacagggtttcgccatattgcccaggctagtctagaactcctgggctcaagtgattctcccgtctcagcctcccaaagctgtaggattacaggtgtgagccaccatgcccggcctgaagcgtatactttaaaaaggtgaattttatgttatatgtattatatcttcaattataaaaggaaaaaataagtaatgatctattttgcacacttaaaaaaaaaaagaatgaatgaagacaaaaaggaagtaatgaagcaaattcatcagctgtgatctccagatgtcctagatgtcctagagcttgacatattcttaggggtcaccagcttttctcctctcagttactttggtgtttttcctgatccagcctctactctgataacagccctccactctattcctagaaaacactgttggagaatagtccccccatcagtcttccacccactgtagctctacaaaatctgggcacccttcctctctatttctgtgacaccgtacctgatatttaaggcagagttactggacagagaaggtctctgacagatccattacagtccatctgttcccttttcttctaatgtattatagagggaagaatataggctttgaagatagacaaatcaggttctaatctcgacattaccacctataagctgttgaaagtgcgtttgtaaaatttatataatagtacctatttcataggatagttgggaagactaaattagatgatgttttaaccttaatcagcacacaccagcactcaaatagttactctcttctcttgctgtactgttcacagcccaccaatgagaaccccagtgtctggccaaatggccgcattctgctaacatcttgtctatgccattgtgtacttggcttcacaataaagcctttcagacccactggggcagtggtcctgtacctgtagctcttcaggggtcagctgggtggctctatccccatgcctttgggtggaggctgcctggtcggtggaagcaagttgaagctccttcttttaaaattcaagaggcagccctgatgatctctgaatcacctttagcgtcattcttcccttgtcttggaaataagcacacattcactgccaaatagctttatagtcttctataaaatcgaaaaattctggtagcccttcttcagttcttcccatcttcttcctcttcagtttaaattggaagttttcctgctggggtggctgattaagtcagtgattcacaccgaggctaatctccttacccaaaaatcacttggccacatcctttgtattctcttcagaaagtgcttttccctttttatttttgtctttgcaatatggataggctgagatttttttcaaatgtttaatttctacttcctttttgcttactaattctgtcttctgatcatttctctcttctcacattttgctataagcagtcaggaggaaccaagctactccaaactttgcttagaaatctcttcagctaaatatccagtgtcatcacttgcaaattctccctgccagaaaacactagaacacaaacacaattcagccaaattatttgccactttttaacaaggatccccgtttccgcagcgtaagcagaaatttatttctcacagttctggaggccgtggtctagagagttcaagaccaaggcactggcagatccagggtctggctagggcctgcctcctggtttggaaatggtcatttaccactgtatccttacgtggcagtaagagaactagccggctttctttcctcttcttataagggcactaattccattcatgagggatctaccctcatgacctaattatttcccaaagaccccacctcctgataccatcacattgggattagagtttcaacattggaatttgggggttggggaaacaaacattagtcaattgcactctatctcagcacactgtgtagaattttttttttttttttgagacggattctcactgtgtcgcccaggctggagtgcagtggcacgatctcggctcactgccagctctgcctcccaggttcacgccattctcgtgcctcagcctcccaagtagctgggactacaggcgcccacccccacgctcggctaatttttttttgcatttttagtagagacggggtttcaggatggtcttgatctcctgaccttgtgatccgcccgcctcggcctcccaaggtgctgggattacaggcatgagccaccgcgcccagcccacgctgtgtagatttttaataatacttttgttatctaaacgtacttttggttttggttatttgaacttcatgtcaccctcatgggaacataaacttcacgatcagaacactcacgtatactcatagtctttgacacgtctggcccatattaggtgctctgtaacaatttattgaatggatggaagaatgaattaatgaaaggaccacatgaccaggtctccttttgcagtgcattggaatcatcctatctcagagttgattcataaattgccccaactagaaggtccctttgcgatttttgaaagagatagtgatcatctcttccagctcattctttttgcaaaggatactagaaagggaaaattttatattcaagctaaggcccaataattaggccttttactataccttattgtctcacagaggaacttagcaaattcttgttattcaagtaactactgagcaaattagtaagcagcagaccaaggaaaaacagaggtcgtcaatggggcatagtgaaagggacatgggctttggtgtctgccaggcccgatttcatatactaactccagacgttcttagcagctctataccatggaacaattaatctctagaagtttccgtttttcctccttaaaatgggaggtccaacctgttataagaattagaattttctctgtcaaacatctaagagctcctggtgttgagtgtgtacctttaactgataatcaatatcattgtgtttgtattccttttgctacctccccgcgccatcaactccactaccatttatccaagagcaatgtctccaagtgcttaactgtgtgtctcactgtgtagttccctgaaaacataccaaatcccagcagtgtttttgtagcagcactgaagtctgagaaattagtcactctcctcctagaaaaagtaaatcattactgtatatctacttcttatatttatgttgtttactattgtgcatgtattatagaacccacaaatcaatgctctcagcagacaaaactgttcaaatctgcagcacgtcttgttgtgtactaggtatttgacaaaacagtatatatctgtcctgaattctgttttctgaaggatggtggtgtgagcactggagtctgtgattgatttctgagtaacttgtactttatcaaggaatagatgtgatttctcatgtatctgattaaccctccctgtaagattaccatcatttctataatgccagtggattattctgtgcttggaaagatgtatatcagatcattttaatcaatagcctacaaaaggtgtcacctggctctgcctgtggttatctataatatctcacccaaagggtgttgtcatttttcaaataacctgtttaacttaaagcacctaggaaatgaagttgcctttattttgaaacagtatgcagaacaatatgttaggtgaataaaatgtatgcttgttttctgcacgttaccctattaaaaagagagaataccagtgtggtaaaatatccacttatccatctccatcacacaagactggcttggtaacccatagattggtatgggagcaagataaaagtagggtatgcaatagattctgtgctggcatagcaaaatgggagcaatgaggaagtgacactgggctatcatataatcttttatcccaattagaataaatggggtgctgcagataggctggaacaacagagataaacccaagaccatcctgggcaagcaaggacacatgtcaacaataaagtcataccctgttttgtaatttaggaaactttctcatgatgttgagtaactgggacatttgggattaatgatgtatctgtgatgtactcctctgttggattccctgagaaaaatcttttgagatataaactaatcattgcttactattcagccatgtagagaatgtgtgtttccatacttaagataatgagtcctactaagagagaagaggtattaattcttgggagggataattttatatcaagtttagacagttttcagtctgcactaagctccttttttatggccagtttaggaaaaatgctaatgcctcgtatccagacctgtttggagatagagcaagtcaagcagaaaaacgccattctcctaaatgagcgttaggccacagaacacgaaatctgtcaggcagcattttacctggcatggatccgccaaagaaaacaaacaaatcagagttggattttttaagactaaataacagcaagccaaagaaagagcatttacactgaaaaaactgtaaaggttgacaacatcctcaactcattaaatatgatggggaagagtaaaatatgtagcacttttgctccttagtgtgggcttttaagcctctccttcaatcgtgatttcactacttcgtctctaagctatagattctgcctttgcaaaaagagaatacccacctccctaagtcgttccgtgtctaagaaaggtaacattatgcagagcattaaacatgtaacctgacacagagacactctacataataataggtcatttcccttctcaaacgacccagatttctagaggcaactagctatagcttgatgcaaaagtgttgcagtttttaccattacttttaatgcaatttaaaacgcaactacttttgcaccaacctaatataataggaatagacaacagcagtagcaggcattcgggtttcccattgtcctcggcattctagggcaaaccaccaagatctaataagctgtgagattccaaaagaagggcgccaaaccttgggctgcacggcttcaaacttcgtcattacagaatcaccagcgtctttcttggtatgatctgcgggctagaggacaagcctggtgttattagcacagtgagcaagtggcaagagcaccacctccggagccacaattagggaagtaccatgccttgccctggcatgactggagagtaggggccaatgttagactataagagttgactaggattgattgccataaacagtgggccatggttactttcctcggagcattgcagagagcctctttctctgggaggccagcctacaggagatcagtcttagacaagttaacctttacctttcaattatcatggcttaaattttcaggaactctcttctagtatctgaatgttccttatttgtagcacccttttcttgtttatgcaaataaacaagaaacacccttttcttgctactgtcaattcaatatctaatatttctctgaaaataataatgacagaatttcttttttttttgagatggagtcttgctctgtcgcccaggctggagtgcagtggcgcgatctcagctcactgcaagctccgccccccgggttcccgccattctcctgcctcagcttcccgagtagctgggactacaggcgcccgccaccacgcccggctaattttttgtatttttagtagagacggggtttcaccgtgttagccaggatggtctcgatctcctgacctcgtgatctgccctcctcggcctcccatagtgctgggattacaggcgtgagccaccgcgcccggccagcatttctttttgcttgccttgaaattgatcttttgtgttagttgtcctcacatgtctattgactcacagttgttggcccatatttaagagtgtggcacgaaaaagcctatgtgaagccgtgaacatgtagatgaagttcattgactaagaactgggccatttccttgtggaactccccatacccacattaatatttcggtgtttccttttcggctgatcgctacctagagaaagaatatctagtacctagtctcatttggaagaacacagaactcaacagcagtgtcctgggagcctccttggggaaggagactgagaatctcagcttcactgtatgaacactcactaaatccctgctatcctcagttcaacctggtgtcctctggcccagagacctacctctgtattacctgctcagaaagtaaaatcccagaatacttctgggatggggagggttagtcacctggatgcatggaataagggagagcaaatagggacctaattgattttaaacagcatcttccagtgctctgttacctgacttcaagtaatacccgaattcccaaatctttgggcatttttctatagagtaagtcagactgtttcttgtctttccccactgccagtttaggattcagggtttcttatctgctaatcatccagttgctttccagtattttaacagtaatacctcccaaccattctctctgtctttataggcttatgccattaaaaaaaaaaaaaaaaaatccttgtactactgtttaaaaaagttttagaaggttcctaggactctaaaaggatcattgtgacgaagaaatggataatttaaggaagccagcacaatgcctgacacataattgtagtgattatttttgttattttgttaatattcaatccttgtaaaatcatccaagtttataaattatgtactatatagccaaacagcatggacgaggagggcgctgtgaaattaagacctacgtcgttcaccttcccagtggtgtcaggtcatctctacaaccatgagcttttagtatggttagttcccattccatttcatttagaataaccttgtaaaagaaacagggattgggtgtgagtgacacctaaccactaacatgataagcattctaaatctatgttcagcatcatgtaagtacaccctcattgaaatgcagatctccactactggtaattccacacactcctattgaagaaagaattgctcctctgaagtttgctaccccatcctctcacgtttatcacttctgcaaagtcatgcagcatgcctcaggtgaccctgtgaggtaagcaatcttgcactgtatgtgggcatttgcgctgatcttcccagaagcaacccttagtccttgcataatttctagcctcaggagaattataagatagaagacaagtgggggaagaaaaggtttaaaaagattctgtgttctttaaagccagatacttctcagctaagcttttctcagacctttcatgtccctcaataaagtatatttttggctatgccccataaactactccaataatccattaagatagctgtagaaatcagcatagcaaactatcagtgagctggtttagttattcaccggttattaatcttctcagctcagggtcatattgtcctgtcttcagcatttttcacagtgtctgatgatgttcagagagttaatggaggtcctgaaatgtggatacaacaagcatgataatcccttgacttgatgtcattctagggatcgttttcaaactttgtgtgttgccctggcaaatgagcaagaaggcacctgtgtcacttatctggatgtttgtacactgttctggcaaataaatgtctatgtacaatgataatttccttatgatactttcactagcaacaacttgttttgagcatttgttaccagttttagtagctgtcatttttgtttcttctttagcttccttgtaaagtcgaggcacattttgtcctgacttagagtcgcgatatttctttggagattcatgtgagcgtcttcctctcactaaattttcctctccccgccccagtctctgcatgtttggagaagttatcttcctctgaagcttcctgcacttaaaacagacccaggcacaagagacttccatgatgatgatggtgatgatgacagtgatgatgaggatgaggatgaggatggtaatgatatctttattcaaacactgaaaccattcatcatgttatatgcaaccacaggaatattacaagttaagaaacaaattaactgacttacaagtcaaataactttcccacaatcagtcaactagtaaggggcagagctaaaatttgcatccagatttttctgacttcaaaactcagtttcttagctacttccagtctgtaagagcagctttctgtctagaatctgtacaccctcaccacaagaatctagatagctggttttcctttggatctgcatggtacaggcatctatctttacacctggaagaggttcttttacttaggatgtctgtattcaacaaaatatcagttgagatcacgtagggcattcttgacctttgcaaggattttggcatttactctgaggtaaacgtggaggcatctttgtttctgtcacattcttagtaatagctagcattttttgagcactttttatgtagcaagctctattcttgtttgtttgatcggtttggttttttgtttttgtttttgtttttgagacacagtctcacactgttgcccgggctggagtgcaatggcgtgatctcggctcactgcaacctctgtctcctgggttcatgcagttctcctgcctcaacctcccaagtagctgggattacagatgcacaccaccacacccagctaattttttgtatttttagtagagacagggtttcactatgttggccagacttctattctcaaaactttgcattggctgggcgccgtggctcacgcctgtaatcccagcactttgggaggcggaggcgggcagatcacctgaggtcaggagtttgagatcagcctggccaatatggtaaaaccccatctctactaaaaatacaaaattagccaggcatggtggtgcatgcctgtaatcccagctactcaggaagctgaggcgagagaattgcttgaaactgggaggcagaagttgctgtgagccgagactgtgccgttgcactccagcccgggcaacaagagcgaaattccatctaaaaaataaaaaaataaaaaaaaccctttgtattaattcaccttagaacatcaccctcttcttactctcgaaataagtgtctctttttcctttcttccccgtgcaaatctttggcatcaatagtaatggtaataatagtatctcatactctgtagctctttatgttttatgaagcatgttaaaatccattaactcattttgaatttcatagtcatcctgggatgccaaataccatctcctccaaattatagataagaaaactacagctcagagacgtcgaatgacttgctggtggtttcatgcctaatcagtgctgtatggccaaacctagaaactaggcttttagacactaaattgagtgttttatatatttcatcatgatgacatgtttagcaaaagctaggttagtatcagagagtcagtaagagaaagtcctttactccctgagaagacatccagcaactatttctgagatgagctctagacctgggctgatttccagtgaacggagtcctgcttattactggtgctccagcattgtttgggagctcctgccatgggaaaatagcagggtatcctattgaccgccagggtgcccaagtgaacattgcatcctgcatgaaaagtgccctccgggattgtaaaaagtgtcaggtcctgttatggtaactaaatgcaagataacctttctgtggaaagcaagcatatgatggataagaaatgattttgtaaactatggaatgatctacaaatgcaaaataccatatgccttgtacatcttgcctgcttgagtaaatgaatgatttttcttatgtatctctctgtgaatattggtttattcgatgctgcagcagtttgcaaactctgttcactcttgcactgcagcccagagacacaccctagggagttggcatgtgtcatacaaataatgtgtacctatttgttataacctaggcttgggtcttgcctcactatctttcctaccaatactgagctattagattctaatggataatctaggaagtgaatacattcctgtaaactttaacaaattttattgaggaacagacatttaaatgtacacacacacacacacacacacacacacacacacacacacccctaggggttttgtttgttttaattcaagaaactaacacgtttgtggaatgaggaagtcattaatgttttttgactaaccaagacctagccaaaaatctatttctctttctgcccttaatctctttctgaagtatcctgccaatttttaatgctgaccgtttctcaatactttcagtctgtagtagtactagagtgcttcacttatcactgtggcaaaacctacttgtcattttagagaacagtaaatgtggatttggaaaatgtgggactttgggtcacgtcagaactctgacttaaatttcaggcaccctttagttggaagtggcaagatacagcttatctgcaaatgactgtaattacaaagatagagcttgcccaacaaagggtttctattttaatatcataaaaaccaaaaggtggaatggtgctccacaaaagactgccttttcactttctaaaaattcttttctggctctgtgtactccacttggtgtgaatgtcatttattagcatgtgatgtctttgtggagtagaggattctgccgctctctgcttgtctgtcttgctctgtttctctgcattttcatctccttttccttgtctcttggctttaacattctttccacctccattaccctttatattagattagatctaacttttaaattatttgatgtatctttaaattttgtgttccctgtacctaatttaaaagacatgaaaagttgtaaacatctctctgaaaataaactaaattaagttgctttatacttgcgtgaccctcgattggttttttttttttttttttctctttgggtcagcaactctcaatagaaaagtttccttatctctagtgtggaagattggactaaatgtccagtgaccttcaaacctgctccagagagtagttcttccttacaagagtgagttttccaatgatttgcctctttctctccaaaatgaaaaacagtaacaaagtcttaattcagggctcttcagattttcattctccctcctttaaatttcactgaatgtgtatataggtctcactatgaagcaagcaatgcagcaggaagaagagtctcttttagttaaactcataatgccttacctagctgcacacaaagggggcatttcaacaattgcaggggacctaatatctattaatagttgcccattctgaagggtttcaggaaaaagttcacttagaattacagacaagtcctcaaacaagctagtcagtggtggaccagactgttgggggtgggggagggaggattgtttaaggttttgttttgcagaaagcttcatcaatcaatcctatctacatcaaataaagagagggtagctaatattgtctaccaagatattaataccttctattttaagcttcatatgctcctcggtgacctcatctcaaatctataagcaaacaaagaagtactgctttagaatatgcgaattattgcttctttcccaagatgcagtccttaaacagaggaatctgaaaacatgtagaaaattgctgacaggagcaggttaaacagaaaaagagggacactctccttctgctgaggtttcagcaccatctactgtccagaatattaatccttccccacattgcactgtgtgtgaatggcacttggtttttcttttgcatgtaatcacaatggaaggcattgtctttggaattcattgtccttgcctcaaggtgtacatttcctttcttttatagtttaagtaaatattcgcttactttttatcagtagatgcagcccgatgcccagcagatgcaatcacacattcctttaatcagcaaagatcttattatgccattcttacacattgactatgatgaaatttactgtatttcactgatactaatgggattttggggggactcttttgctcagtgagtcataagggagagttacttatgtgcagtcactgaaataaacagaaaacattctaattattatttgatgaaaatgtttctccgtgggtaaaagatatctgtggttcccatttatgattcttttttatcttccatcacagtcaaaggcacgccatagagtgattttaattataccttgactcgaagatacaatgtatttaatttgtcattgacagtagtcttttcctagtcctttcagattgtcatttcttttgaatcgtaaagaaagcttcaaaaagaaaatgtgagagggcaaatttaacatataccccccttccctcttctgttattacttgctattttgcttgaggaagtattcttattcatagtgggaagcttaggcacctgcagaaaattctttgcatttagaaagacttcccagatgagaaaccctgctactgaagcatggcacaaatccagaccccggaggtttgctttccctggtcatgggtaaaaataaaaacaaacaagttgacggtgaatgactttaagacagattatatcttgcttattaaaaacaaagaaacaaaaacctccttattaatcgttgtgaccaagttagagacttgggaggcaaccaagagcattcgagcatcattagaaccgtcttcataattaaataggtgctttatgctacacattttgaccaggcagatctaataactttgattaccacctgactgattgtttcccaagtacctatacttggccaccctcaattggcttgtgcatagtagtttccatttgtggcagtcaagcttattaaacagctctgctttgcgattttcccccagtccttgaaaatagatcagtaagcattccactcaggggcgatttgtaaattgctttacacaaggctccagtttgtgctcacgccgactggggtcaaaatttgccttgtgttttcttctgatgtcatttgtcaagttgcacacgttgttccgagaaccaggtcacaatactatgtggctgtgcctctcggtatgaatcgatgaaaaaccttgacttgtgaacgtgccctatgctacttctgtgttttcttctgccacctaaaagggcagacttccttgtcttcagccaaaatacacttattgttctttttccaattggttcctcttcccttcttcttaaagcaaagtcacattttaattatgttaacaaaaagagaggtaagataaataggggtgctattgagagaactagcctatgttttaaaactgtaaaaattctcaattcacagacataattcctcaatggaaaacaaatcttagagaaaagtaaatgtgtctaaaagagatcaaatgtgtaaaggattttccaaagagcaaaattataagcaaagtagacacttaggaacaaactacatatatagatgtctgatattatgtgagtgatgataacctgaacagattttatttcatcaggatatttcggcagttaaagcttacccctaaaatcaggacttggagctgagctcccttccaggaacctggggcagacaaaaaaaattctacccagatttgagacctttaaaggacatttacctgtggccagaatgggcagcaaggccaccccccaaaaagagtcagacctgtacagtattgggtgcaatgtcctttattttgctatgccgtgaagtgcaaactgcacatttttcacataacctgatacaggcctttacagccacacaacagggagaagtgggtgctcacgaggaagaaaaaacttcgcttataagatgaactcccaaaccaaaattacaaagaccttgaggaagtctgccaccataagagacaatcagcaaatagaacaaatggcaccttcaaaagtagcaataacggaaccacctgaaaaggacttttagctaagtatatgtagatttctcaaggataacctcaccaaccccatccatcatttcctacttccctccttaccttcctaacagaatggatttgtttctgaaaagtaactcaggaggaacagaacaaactggaaactgtggtgtttccatttgtttgttttgatagctccttcaaaatgtagatcctaatgacccagcggagaatagtaattataaaattaatgtttctcccatttaaggatgaattattctctaaaaactaaatataattttaagtaatgtcttgctcctgacaataggtattttatgaaagtattaattcaggttttctccctggtgtgaaatgcagaaactcaatgtttaaattttagggaactgatacattttctttattcattcttctttttataagtagcataaaactttaatttttaaatggcatatgctctagaattagtattcgccatcttttttattttattgttctgtggagtattcattttaaatatttacattttaagtactaaagcaatctgagcaaccctccctttcctgtctggcacagaagagtaatcacagtgagtgaggatgcagaatggtgaggtaggttggagagctctatggagacatggctgtgggtgggtatagaggtggtgggcagaggagacagctggcaatgttggcagattggttatactgaacaaaatgtaagttgattaagcaaattaggaaatgttttcaggataagatacagaaatacttatagatgtgtaggtattatacatgtatacacacatagatatttcccagctctgttgctgagaaggcctaggatcaatgaccctcagtaacaatgagcacattgggtctccacctcttagttctcaaagccatcctccactaaaaagaaccagagctccctgacaaaatgactgattctgggactattgcaggaaaaaaagtataatgtgaaccttactggaccagaaagtaaagaaacacttaatgaataatagtaaaatgtaaaacatacgaagagcccaacttaaaaggactcccagtggccaaaatggggacaatttgagcatcagtgtaaataatgatagtaatgtattaccacctgtcaaaagaagccatgaatttatcctaatgtaagtaagtatataaataaatgggggagaggggaacactcttccttagagtagaatgtcagctgatatatgtagaaggaaagatagcaatggagaatcaccgtttgacaaccatcataaaagccactaattcaggaaggagtctttaatggattctaaggctggtgggtacaagtttgatgaccatcaggtactggtgtaatctttgaatacctccccacaaagtactcattatttatttatttattttagtttattattctttttcagacagagtctcactctgttgcccaggctggagtgcattggtgcgacactgcaacctccacctcctgagttcaagcacttctcttgcctcagcctcccgagtagctgggactacaggtgtaccacactcaactagtttttgtattttttttagtaaaggcaggatttgaccatgttggccaggctggtctggaactcctggcctcaagtgatctgcctgcctcagcctcccaaagtgctaggattacaggcatgagccatggtagccagccaaaatactcataagttacaagggtgtaaatggtaagaataagatggagaagccaggcaaacaccaccatatatatatatgtgtatatatgtatatgtgtgtgtctgtgtgtgtgtgtaggtgtatttgtgtgtatatggtagggagaaggggtgtgtgtgtgtgtacacaaatatatatatatatatatatatatatatatatacacatgcatatatatatacatatatatatttacacacatatattgtatatgggggagaagaaaataagcaaatacagtaaaatattagctactgaggagtgtatatgaaggtgaaagagttctttgtacttttctggcaaactttctgtaagtttgaaattatttcaaaataaattactttttaaaatcaagaaaaaagtacaaaatgtggccttataagaaaattcagcaataaacacagatgaagggccagtgcttgcatggtgagtgctgagttagccttcaggcagttcctttttaaaattccatattcgacataagtctggataaataataagaaatacttaatatagcttcctgatttatagtacttcaagattcaaggccttattttcatcagtctcccacagggccactcacagattgtccataagttatctttaaccaactctcatgagtaggaacagaactaggcaccagggacttataaaagtgtaagatctagtccgtgactcccagaaagctgatcagttacagggggagaagcagggcacgtgtaaaaaagacaaatgattttgcacaacaatgcactagcttaatgtcgaagaaagaaaaacagttaattccgatgagcttcatgaaaggataggatcaccagcgaacagggtggccaggaagggcatgtggggaggtggctcggattcataggctcttcaagacagtaggctttttccagcctggctggccactagcagaacttggcatcccctctctgagggcgcccacctccacctgaatacctccagaaatggagattcatgttcttctgtggcagcctatttccctgttggaaaggtcaaattagtagaaagttcttccttctacagagccagaatatgcctgtttgtagttactctttgctttctactttggggcaatgcaaaataaccttagcttatcttctgcctataagcccttcacatatttgaggactgttgtcatgtctctcctaatttacctttctcgtgccaaacactttcagttattttagctgctatggaattattagatctttcactaacccaggtatactaatgtattaatgaatccaaaacacgttcctagtaagctgtagtctgactaatgcaaaatacaaccagattattacctccctaaattggaacatcatgtgttatttatgcaacctaagatttcattccctttctttggcagctgcacagactccatgagcactgaaatgcttaggtattatccatgtgagctgccaatcccccagcatgtacttagtagctgattttttaagtgtagttttttgcctttatccctattaaagtttgcctaggtgaaaaggttggtcccacttgaaatcactatgaattttgattctcatctaatgtttagggtatgccttttagatgtgtgttttatgcagaattgatacagtttatcttgcactgatttttattgaaaaaatggtgccaactatagaatgttgaaattcatccgtagagatgctacctcaggattattgtcatcattaatcaacactctttgctgtggcatttaaatatgattaaaaataattctctgaccagtccccttatgtcatctgaggtttgcttgctgtctgctctttgaccagctccaggcctttgaagaatcccacttttaaattgtccctataaaaactaatttaaggaaaaaagatacaactctactgaaaggcatcatcaaaaccattagagtcaagaaatttgttaacaaaagggatgtgtctccttccacaaatgaagatggctgaaacacacattaaatactatcctgataggcaccaagtgaatatcttggcactgtaaatgaaagataaattatacactaaaatggaaggattggtagggtatcaggaaagcaacattgaaatggaattcgtatcctgtggacccaaaagcacttatttttgcagataataagaactatcagccaggtatggcggctcacgcctgtaatcccagcactttgggaggccaaggcgggaggatctcttgaggccaggagtctgagactgacctgagcagtatagcaagaccctgtgtctataaaacaaagaaataaataaaacattagccaggcaccagtggctcatgcctgtaatcctagcactttgggaggctgaggcaggcagattgcctgaactcaggagctcgagaccagccggagcaacatggcaaaaaccctgcctctaccaagaattcaaaaaaaaaaaaaaaaaaaagaattagttgggcatggtggtgtgcacctttggtctcagctactcaggaggttgaagtgggaggatcgtttgaacctgagatagggaggttgcagtgagccaagattgtgcctctgcactccaacctcagggacagaatgagaccccatctcaaaaataaaataaaaataaaatactagctggacatggtgttgcatgcctctagtcctaccttgatgggaggattgcttgagcgcaagaatttgaagttatggtgagctttgatcatgctgctgcactccagcttgggcaacagaacaagaccctgtcaaaaaatacaaaatataaaacagcgtagtgttttaaaaaatagaatccttatccaatggaccccaaaacacttcattttagagacaataaaagctataaatcagaaagtctttccaccagcagtgaaagtgagaatgtaataaggcttggataagtgttgtatttatacatctaattgtggatctgattattaattgagtagttaatattattaaaaataatggttaataattaactcttcctcatggttataatccttagaacaaagcagttagtttgccttttgtcatttatacgttatagaaaacactgtagaaagtaaaagaattttttttttaactctaggagaattaagcacttggtaaatatatagatttttaagcatcagtcctctggagttcagaatttatcattctacacagtatgaaccaaccacaagtaggaaagtttagggatgttgttggtcctatttattgttgctatttaattacatccaaatccagccgtcagttcacatcttcagttctaattgcctttgagagttctatgcacggaacaatagctgaagtgactcttcagaacagaagtcataaatataggttcttcctgatctcgatgaattaaaaccaaaggagaggagacagtttgttttgcaggaagccatctgtttgtttgtatacagggtttgtattcaaattttaggaaattaatcaagtaaaaaacatcaaaattcacaacacagaaaacaagagtactgaacaaacatacactttgagaaaaccaagtcgctaatgagattttgaacctctttagtttaatcttttcttgtccctaggagacctctctggtatgtgtacagtgcatgacgttgcattgattcttgctgctttaaggctcagaacatgaatcggcgacaagtgctgagttaatgaatcagcagctgtcagcacaacaactgcaccaacataatccttgactcagggaacttctctggtccttgcttaaaagacagctaagtttaccaataataaaaatctgtcccagatccctacatgtgcataaagaggtgaacgtttctttaggaaagaaatgtcattcagaaacgtgagccagaatttcaaatggctctaggctttggggtatgtgccaactccttgctgctagcccaaaagttgtcaggagataggaagacaagacagttttagggactggagcctgggcatttgactccacactcataagtctgatgtgtaggcttagagctagagccaccattttaggcataaaatcatcactgcttgttacctgtctaaggcagtaactacctgacacgtgcagtgaagccctctgcaaccatctgcaccccatggcagaaattctctgaattcctcctgcgtttgaatatcttcagttgactacacataggagtgtaaattgctgtattatgcccttagacttattcctgcatgatttgcatgtggacatcgtgttttcagtgaaaagaaaggcagaatcgcacaacagacaatatcttaatgactcttagacatcagtctgctcatttgttaaatagggatgataatagtacctatttgttaggaataaatgaaataatccatgtaaagtgcttaacagtgctaagggactcagttattatgaatgttcttattccttcagcctctgttatatgtgttatccatgtaaacacaatccatgcttggcggataaatcaagaaataaatgaattaaaatgaaaatctaaattgcagaatcagtgggcagctgtttaaagtagaactaggcaacatctttatcaaataaaacccatagaggtatatcattttagcctgggatctgtttcagtcttcattttttcttgaggaaaatgtaaatttaaaaacgtcaaatgacatgttaagtcaaaatggggctattccttgatgtttgcttagagtaagatttgtacttacctcttttcctcattaaaaaaaaaaaaaaaaaaaaaaaacaacttcatcactatctattcctgatggtaagtgaatcaatatagcggatttttattatgtagtcctcaaaagcctcggtctttcaaatcaggggttttctatcccattacctctttgctggcagtacctgttgttcacttctcatttcatggacatcactcatttaacagtgactaaaagcacattaatctacttatcatgatcttttcctatttttagaaaacaacaaaagtatatcccactactagattataacctatttagaacagagatttcccttttgtaactgagagattttctttctgtagttggataaaaggatagaaaaaatgttttaaatactctctttaaagaggaaattttagcatgggttatcagcaagtaagactcacaaaaattctcctgtcagatataattacaaaattcccagcggatattttaatcccagaggttccctgaataaatatttatgtacctcacagcctgaaatgcaatcccgcgactatgggagaggattagtcagtgttcttttattatttggtttggttttggtttgtcttctttgtaattgtttgattggctcggtttggtttagtatgtagaaatttctggaatatggcctaattcagaattttattctttaggcatgtatgcggcctttacattgaattcaaactgcttctcactagtgtactctctgacaccatttatgaaatcatgttgcagaaaaataaggcactatgggtgtgaatgtagttttggagttcataaactgtctcagctaagcaagcccattctattcccagtttaaactataatgtaaagggtgaattttaaagcgaattgatggtccttatttttaaaaagtaatatacctgtatcattttgtcagtgatgttcattacagcattatttattatttctaattataaatattagaaaaatgtctaataaaatttgctaaaatgccaactagtttcaaaatggttaaaactgtaagcttaaagcagattataaaattatgttgacaaaggaataaacatgcctatacaatattgaggagaaaaaggaaaatcgtatttgtctcatttttataatggtgtaaaacaaaacaactgaaaaactgtgaaccaaaaagactgggggaaattataccaccatgaaaatagatgttttatctgggtaggatttgtttttctattccttcttttaattttcctgaatttcctaaattacctgtgctaaaacatttattacttttacaatagaaaaaaagagcctaacaaacttcaaatcaacatggatttttcctgtttgcactcagctgaaatgtagctttctagtgaaactggagagagacgaaaaccttttcaaagaggcaattcagagcaggctgccagaaagtaagcccttccacgagcatctttagagatctcacctccatgctccctggctgagttctgttgctctgagaaggttcacataatgagtgttttcatcttttcatattaaaaatgacctcctggcctgagtctgagcttcccagatgactgaggtttgctggtcacagcctcagaaaaaataaagcaaaattacttagtatttcatcctgctcttggagtctacattgtatttccacacaagctcacagactttgttgttgttattgtttgttttgttttaactctccagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggtaagtattaatagcaaaaactgactcaaactaacttgtttagaccaacttaacaatatatttaaagttactattttagaattttgttcaagtaatcttatggcaagaaactcttggttaattcctgctcctttttgcacaataaatgtggcatcactcattgaacaactctatatggcaggactgctccctaactggcaccaatcctacaggttaattattcattcctgtgtatggattagaaactaaggctcacaggcattggatgacttgccttggcctcatagctactgaattgtggaactcagcttaaaacttcaaatcccaaactctgtgtcacatatcatatcatatatcctagaatctgaccaagaaaatagcttaaggatagtttccttctgtttttaggctgctaattaaactccctttgaccttgtagaaggcacgtcattgtgaatttagggttttctttcttgaatttgaaagtctgatggggttatttactatctccaggtaatttgaattcaaaatgattggattttcaaaatgccttcctttccataacggtatattatcattgaacacataacaagaagaggttaaatctgggaacaattcctatcaatcacaatcattgtcaaaaaatttttttctgctctaacgcacctctgtgatcccattgacaataaagatggactccggctgccatttttatgatggagtccagccaaaacatagcggaatacaaaaatggggccctgacttgaaaagctctccccacttcctaggctgctataaaaatctgtccaccccctttacgttgagaataagtggcctaaagtcatccatgtgatatagtgagagcatattttccacccaactacagtactagccctgttcatcacagtcttactacctttatcaaacagggtttttgcagttgagtcacagaatgcccaaaacaatttcaatgactgttgtctcagttctatgccaagagtggtatctgattggtacaactttagatggcacaggaaagaagttaattcgttacatcagtggatgcctgggttcactagggattatctcttgggaccctgactgagaaaggctggatgaaattgccagcgtaaaccattctggacctctttcacatggttcagcttaataactttggctaagtgaaagaaatattaactacttcacaaagacattggagatattgaatatcctgaggtctaggaaagtacatagcccaatgtctaccacaaaagaagtacttgataaactttaatggtggtattaattgaaggaagggtaacattgattgtaataacaggaaagtgtaaatcgagaacattcttcataaattaagcagaatgttctcacattaaaaccaatttcttgggcaggagagatattaaaaatgctaaatctcagaatggcgcaagcaccaaccaatgaaaacagatgcccgaccaatcgaagtggacgtcctaccattcagacacatgtagcctttatgccagaatggtgccagggctaaggcagaaacagggacacctaatgaagtcaaacactgatgactaccttttgtaaagacagctgtccgtagagctgctcacattcatctttcatatggaaaatgtctatctcccctgttaaactagtgctaacaccaatcaacttctgctgagaaatacatagaaaattaaggacagcacaaccacatgtgagatctaagtgtactagccactaggatcattaatgtctgtggagtcaggacttgacaatagaagagataagcaagcgcaattttgaagtcaagcctatttcagcttcgacttcctgggtcagcatggtggaaatgatgcttggtatagagttaacctattgaggttttataaaagttattatttcattgtcctctgatacaccccatccccaccgagtattctgtcaggaacacaacagactgcggtggtggaaaataagcagatgctgttgttttctttggtaggaacataaaaaatgtagatcttagttaatagttgggtctgggtgacttcaaagggaaagagaaagttattgtggtctgctttgatgagactcttacctcactcctcactctatttttttctttgtttcagttttactttaaaaacacaaatccagtcaaaatgtgtaaataactacagtacttctgaatcgcaaaatcaaaattttctattaataggttgctgtgctctgaaatatccaggctgcaagtttctttgacatttaagcccttcatgaataaagtgaattagatagatggtataggcatttccctaaggccaatgtggcttcccaccttccctgcacgcatcccctggggcatattttttatttaaacctgtattcgaagtccccatatgtgaaatttcttaggtaaagtatcaataatcttaataatgatgatgataatagtgataattcctgatacttgcaaagtgcctaatcatttatcgggtactttcttatatacacttgacccttgaacaacacaggtttgagctgtatgggtctacttatatgtggattttttttctaccacactcagattgcaaatacaatattcgtgggatgtgaaataacccacatatatggaagactgacttgtcatatactcgggttccagagggctgactgcaggacttgagtatgtgtggattttagtgtactacggtcctgagtcctgagtccaatcccctgtgtctaccaaaggatgactgtaatagctccttaatcctcacagaaatcttgtcaaataggttaacaattattttcccattttattgagcaattataagacttgatccgtaaacagtggcatctggatgagaagccaagtgttacaaacaaaagacgttttgggttaaaataccatagcttttcctgaattagatttaacatcttggacatgtctgtttcacaaaaaaatggatcatggctgtcagtaataccagtttagagttaatctacgcttcaaggtttcagaagattttcacataacacagataatctcatttgattttcacaacctagcatgaaggtcaataaaggtcttttgaaagtcagtaaatcaaggccaagagagattaagagatttagatgaaatcacacagcaggaatcagcccaagacaactaagcaccaaaactgtagctcttccttcactccatgctttggcatctcttctaatcgtatttctaattggcaattctatctcttccattatcctgtgaatgtgacactctgtactgaaacgatggagataaccaaatacatattaattttgaaatagaatgaggatatggtctttccggatgctagtctagtgttactgttaagaacagggactatatgggttcaaatcctggctctgccattttctagctacgtgactttaggcaagactcctaacctctttgtgctggaatttcctcatctgtaaaataaggataacaagaatacctgcctcagaggacatgtgagtatttagtgagtttaatataggtaaagtacttggaagctgcctgtcatatagtaaataccattaaacatcatccattactattgtcattggagaaatagcaacacaagagtctgtgtcaatttcctgttgtatagtttggaatgggaaaatgaaggagggccaatataccctaaattatcttgtcatccattacgggtttagaatgaagtgtactttttcaaatctggcctctagggtggtctcttcatcaagcagctattctccaaactttggattaacagggctatgaaccaaactccaaggtgtagcagtgttcttcaggtaaagtgctgcctttgtgatagcctgtggaatcatctcctcacatttattaaaagtactgtgctggcgaatgctggagaaatatttctggggcgcatagacatccaaaccaggatgtaattagtcccattcttctgctaatcaaacatgcatttggcatttggaaaccaaatgagcactgttccacactaggtgatgcgagatttccttggagaatctggtcttcctaatcctttcattccaacctgggagcaataacaatgctggctctaagaaagggttgagcaataaaatgcagatacttccaaatgtgggcttgcttccgttttccaaatacagagttctaaagtatccgaacgccaaccaaggccataggctgagggcatttctgaagaaactcacaaaactagatcgagagccaccgtagtacgtaggacttatgtagcatgtaacttacgtccttccgacatgggtgccaaactgctccagagactcagagaagccagacacctgaggtcttgtcgaagatgtgttctgaaaacgtcggtgttcccatctctcaggcaggctcacatatttttaacaggccatggtttgcatcactaatgctttcatcagccagtgtaaaataaatccattagtcaccgtgtccttcatgtgataatgatatttagagctcattaaaaagtaattgcagccactttcccctactttatcagcaggattcagctggtgatttgatgatccgaaacatccaactgaagcatgctgggaaatatgtctgcatggtccaaacaagtgtggacaggctatctgctgctgcagacctgattgtaagaggtactggattttgttgttattgttgttcttgaaatattttcatgatatctactgtagcgcagagttccagaaacctcagtggtttagaattatgggaaaaagtcaggcagaagctgaacattgtaaacagtggctaacagtccacagaagtttctggttcatatacagttcctcagtgcggcttgtcagaaaatgcaccgaacacatccagtaactttacactagaaggataattgagtaaatcgagtacccgattacggctgttggagttgatatgaccttctagaacaaatttaggtgaacaaaagcagatagtttaaagagggattaaactgtccctttttatgtttcatctgggccaaactgaattagtatcctaggccactggtataacagcagcttaagtaaagtcatcatcaggtttatccgagtttccttttttccctaaacttcacagtgctgttcggttcctaaaatagggttttgggagaggacacttcctgactgcctgggatgtagtaaatgagctgagagttgatgtaaatactaacatttttgagattctcttgaatattatcagcatgacctaatttggacctaagagctatgacccccccggctgagcaacaccaactgagtacattccaagcctcaccaaaccggttggcaaaggaactgtaaatggacttttaagaaatatttttaaatgaaaattaaaatcttcactaaccagtgtacataccagaatccaacctatgcatgctcaggggttttctatagcattaaaatagaggccaatccagacatcaaaataatatcttagctagaatctccttcatcagaatccctgactgttggtgttcaggcatctttggccggctggcagagcgcatggcaaaacttcgaacgcaagaaaataaaaatttagggtatgagcgttggaggcagggttaatctgcatgcacagagaacaaggtattattggaagccataaagagtgttgctgtatcctctaggcataatgtaaggggggaaatgtgtgggagttaccaacttaaactgattgtgaagagagggttcaagagaaatagcaattccaatgtgtctgctttgttcccctttcaattgcctttaaaaaaactttcagcaacagtgcagacaagggctggaaatgagaaaaaactttcaaccgaggtagatctgcccacagaataacttatagaaatgtgtttatttccatttgaaaatacaccaggctggtctgccctccccttgggaacaaaagaattctgttgctgaaaatttatcctctatttaattaggataatgttcagatcagcagttaaaacaccaataaattagactaataaatatttaaatcagcaatacttgaagttcttaaatgatattgtatacttcatttcacagaaaataacattaaataccaggaggaatttgcaaacgcagtctaaaagaaaatctagtctaatcagttaataaggccaataaattaatgtgccatttaaaaccataatctttcattttatctccttctgctctgcccttgcagcttttcttgcacattacagagggggaggcaggaatgtatttcaccaccctgaaagacattttcatatttgaaacgtatagcagctttgagtcttggctccagattctttgattttctgaggcctgttctatttaacctatagcactgtaatggcagccagaaaggccacccttcctgagggagaagcagaccccagaatcaaactaatcttccctttgccattgcctgaaacaaaatcttctacatgcccctgagtgtgttatcattttgttcagaggacaaacatttgtacatttttcattttgaaagagggagtccacttccctaaaacaaagttggtaaacattctgtaaggtcgtagctatgcatcggtaggagagggtggcaggaagataaaaaaaagaacaaacaaatccaggaaactaccatcttctctccagtgtccaaactcataccagcccttcattttcttcctatagagaggccaacaatggactcagatatttcctatcgatttaattctttgaagagttcagagggaaacacttttctatttgtggtacttagattttaaaggacatcagtgcagcatccattaaaaaaaatggtggggaatgctaggatgagaaaactagtgaaaaaaattatattgtcttctagactttatctggttaaaaggggtcccaagaccaaaggttacatcagctctatctaggtgacattagactgacatgctgaaatgtcaccatggaaaattaatcagttccagcatacagatttccagacatttcattcaggagtgggagggagaagataaatttagtctcacctgtgggtctataaaagtgatttttaaaaaaggaaagggaatttagggcatcacgtaaacggtgaaggagtgaatcctagaacaaaggctaacttcaggaaattgctgttaattttgcactgctctgtgagaggtttcttttttccctgtccctgtgacatggcctgatagtatttgggtagtacatttgattgctagactggggattagcaaatccttcctaggaacatctccttatgcccgtctaatgggcatgaggtttgtcattatgtcccctcaccatcaccttccctcctgaggtggtcaattgtaccttgttaaaaatgcatttaactgcctggtaagagattttcatgttggaaagtgggatagctgcgggtctttgctctggctctgttgatattttgtctttacctgccagctgctttccatccctctatttctttattagtttcaagccttcatttaaatctgatttcctcccctttccatggtttaagtacatggacagaaacaacgaacatcaggaagagaagtagaaaaatacgggtatgagttgcagaaactacagatgagggtctttagtatctagcctaattttgaaattgctttgaagaagggagcgccttgactcttgcgcaccggccattttcacagcagttcccttgcacgcaagtgtgtgctcacgtgggaagcagggttggatgtgaagagagtgctagtaattacagtgcagcagaatgtgcagagcaacactgtaaccttcaaagttttaaagccatttgtgcttaaatctatattctcagtggtagaaataaccatttccagcagactatactctttatgaaatcaggagcaatatctatcttttctcactaccgtatcctcaaataacactgtctgacccatattaggaacctataaataaataatgaattaatgaatgtgggctcttatggtaccccaatactctctattaacattaagtattcagttgtaattatttgtttacctattagtttttcatattaaactgtgggcccctagaaggaaggggctgtgtttcattcacctctgtggtttccaagcccaggaaagttccaagcacgtagtaggagttcaaaaaggatttgacaagtgatgaatctgtgaatgggtagataaatgaatgggtcaatgccccattcaagtatgtggctcctttacttgggtgtttgaatacactgctccaattctgggggtcttgctctttcccaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacaggtaccatattggatgcttggctcagagacattgggaactcagcatactggacacagcactgtggcaaggaacgtctaagttctcattcagacactactacaaatgatatattatggcagtgtttcctaaacctcggccaactgtactatcattaatatttttctttatatcaaatcacagttgggtttttttaaactcatcctaagcaatagtatctgtgaaatggtaatgtccaggccagatttggtggctcacgcctgcaatcccagcactgtgggaggtagagttggatggatcgcgtgagcccaggagttccagaccagcctgggcaacatggcaaaaccccctctctacaaaatatacaaaaattagcctggcatggtggtgcgtgcctgcagtcctagcaactcaggaggctgaggtgggaggattgcttgagcccaggaggtagaggttgcagtgagccaagatcacaccactgaactccagcctgggtgacagtgagactccgtctcaaaaaaaaaaaaaaaaaaagtctgttgtgctggttgtatatgtattttccgtaacacacattaaaaatatattagttataaaaataaaatgcatcaatctgtattacctaaaatcatctgtgtagcactgtggttcactttggaaagcagcggattctgcctgactatagtcacttaatagtcacagacttcataaagtttacacagtgctctcaaaaaccaataacagaggattatagggagcctcttcacttgctgctgtgttttttgagacagggtctcactctgtcacccaggctggagtgcagtggtacaatcacagcacactgcagcctcgacctcctgggctcaagcaatcttcccacctcagcctgttgagtagctgagaccacaggcgcaggcccccacacccagctaattctctaaaattttttgtagagacaggtcttgctatgttgcttaggctggtctcaaactcctgcgctcaagcaattctccatcagcctcccaaattgctgggatttcaggcgtgagccactgtgtccagccccatttttttagatggataaatttggggataaaaagacatgagatttctttttaaccaattttacaaattcttaaaaaaaaaaaaaacattgttagcagcaacacttccatcctgtttccctttattacatgtatacagcacttcctattttttaaaagtttcacagttatttctctttgcatgtaaaagaattcttataccaaccccactctgtcagtacctccaaattgactcattttcttatttagatttcatttaaggataaattggatgaacaagtagttattacaaacaaagatacacactcctctagacagcaaaagtaggctatatggccttgatgttttgaaggagaatatgcccagtgttgagcaattcatataaatcttgttgattttaacccatttgtttttttcactttagtttactaatccttagaaatgggtttctgtgtttccttctgtaatcactgagtcacaggtgtgctttaagaaggaaatatgagaaaaatatagaagttaggagatgaattctagacctgactgctaatcagctgatctctatacatcttcattttcctcttctgttaaatgggcacaataagaattgtttaagaatgaatataggccaggcgcagtggctcacaactgtcatcccagcactttgataggccaaggcgggtggatcgcttgagcccaggagtttgagagcagtctgggaaatgaggcgaaatcccgtctctactaaaaatacaaaaaaaaaatagacaggcatagtggcatgcacctgtagtccctgctactcaggaggctgaggcacaagaattgcatgagtctgggaggtggaggttgcagtgagccgagattgtgccactgcactctaccctgggcatcagagagagagagagagagaccctgtctcaaaaaaagaaaaaaaaaaagaaaagaaaaaaagaatataatacttttacctttctcagaggatagttgaaatagtgtgtctggcactatacaataaatgcggaaacacatgtgaaggggtgatagtaatgattgagtcaggtagtttggggtcttgtggactgtgtgtcttttatgatgtcatctgctggtatctgattagagtgtgttagtttaacatacagagatagttctgagattacctcactgaaacaactgttgatgcagctaatatcagaacacctacactgccctgaatacaataatgatgaggatggatggatgttcctatcttcctaacgtaatctctgcatttgttttctgagaacctatgaaacagcccccaccttttgttgtctttcagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagtactcactgaaagtgagtcacctctgccaggcaaccttcctggccctcattcgcctttgccgcctgacataacttgttttttgtctccttgtgcagtccccgaagtcacaccagcgaatgtcagtggtggcggaggcagcaaatctgaactggttataacctgggaggtaaatgaatcacagaataaaaggaacgtacacgcatcgaagctattttattattttcctccatgttagacatagctgggaagtttcctcctctgtttttaacagtgaaaattcatttgggttcagacactccctctcacgtagctaatggctagcaggaaggacggcacttgcccatccattgttgaggcaagttttaattcaatccatcacagtaaaaacaattatgaagggaagacaacacacgttacaaaaaaaaataaagaaggctgtttcagagaaaactagtttttcttttcttcctgaattgctgcatggccaattgatttaaaacgtctgccagcaatagattcagtgcaccagcacaatttcctggcaattggctttgcttctagaaggggccctcttttaggaggtattttttaaaacaacctggaggaaagttagtcaccaatttattaaaaattggctttgagagaagaggtgggagctttagaaagggttcttcatgtttttgaaagattctaaacagccccagaaattaaaatctctcatttacccaaagcacagcagtgaaagaaatcactcatccctccagctgaactcttccctctgagagggaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaaggtatcgtttatgctgcctagatcattgactgttaatatttcttcaattctaaaatgtggattgtagcacgtacaatcaatttcgcatggtacatgtatcttgaaggcatacctgatttgagaagaggataatgtaaacaatttggttcgctgtccaccatgaatctcttgaaaagatagcgactgctctgtatatgaaaacacttggctgtccattattgattccattgctaaggaccagaattgcaaataccatataagatcttcatatctatctatatgttatcattactttcaaaagaattttatttttgcctttaagtgaatatcaaaatataatttgcattttcttaccacttgtattttcataaagcatatggtacttgtggctcacacctgtaatcccaacacttttgggaggccaaggcgggtggatcacctgaggttgggagttcgggaccagcctgaccaatatggagaaaacccatctctactaaaaatataaaattagccagttgtagtggcacatccctgtaatcccagctactcaggaggctgagacaggagaatcacttgaacccaggaggcggaggttgcggtgagccgagatcgcaccactgcactccagcctgggcaacaagagcaaaactccatctcaaaaaaaaaaaaaaatctcacttattaaagaaaagagtaagtcatgaagcagtgtgattgcgctcactgtcatccacaccatcattatgtttaacatttctcacacattattatcacctccatgctatccctgctctcgggatgcctctcacacagtcttcgttacctttggagttcgtctatgttgttttaaagatgatgctcagaatgggaccatgttaaaacatctgaaaggtgaatcattgatttagagtcagtgaagatgcaataacttattcccaatcagagagatcatccccttagactcagtagccctccatgatctagctgctgcctctctgtctgcctcagctgctgatgcctttccctgcatatttcatgttccaaccattgccaaaggatttacaattattcaaacaagcttcagcccttttcatagccttcaacttctcttagataatagttcatgtctctggattatgaaaatgagaggaaaaggggaaaaggacagtcagctgacttgactaagattcaagagagctggatgacacttcaggttcacactgcaatctgtatgatcttggataactcaggtatactctgtgggcctcagcatctttggctgcaaaggagaggctagactgactgtttcccaaatttcagttatttttgccagatttctgccatagctgtgtaccatttgtatatgttcacatttttctttcaatagtcttccttaaaaaaaatttagtgggcaagcacagtggctcatgcctgtaatcccagcactttgggagggggatgtgggaggatagcatgagcctaggagtttgagaccaacctgggcaacatagcaagatccaagtctttacaaaaaaacattagccaggcgtgttggcacatgtgtgtgtggtcccagctacttgggaggctgaggcgggaggatggcttgagctcaggaggtcaggctgcagtgagccatgattgtgccactacattccagcctaggtgacagagtgagaccctatttcaaaaaagaaaaagagaagcagtttagccatgtcgtaagcaataacatttgtgagatgctaattaagaaggatctgtgttaagggaattgctggctatgaaaacttggtgcttaaacttaagtggttcttctcttctacccacacctaaattcagaacccaaacactggacaaatattcactaccaccaactccagctattaatcactgcccctctgcaaaatgagggtttggcttacaatcattaaggacgattctataaccatgaattattttaccttataatgctagtatctacaatcctgtcctaatatagctgatagagtaataactatctccatattcatctacagaacccaccaaaccaccagccagtatctttgccagaagtctttctgccacagatattgaagttttctgggcctccccactggagaagaatagaggacgaatacaaggttatgaggtaggcaagacatatgtgccttgggtctgaaagagagtctatgccccttgataagtcctccaagtcacattcttataggaagagacccacattcccactaagaggcattggttttaggcctggcttccagctgaacattaatggaagcattgaatactcagctgtgagactaccctttttctatgttatattctagaggtatttttcgaattatatgcaaatctaagcatttacgggatggttggcaaaatgagctttgacttctgatatgcccaggatcactttgactcaaaacaaacatgggaaaaaagaaaataatgaacgacggttgtgtcaatgtaccgtctcactaggaagctaaggacaaaaaagggacccttcttactttggataatttctcaggatatacagagtcctttgtcctgatagctctgctcatgatgtagtatagaaaactaactccatcataagaatctgcgtacaaaattacctgatgacattgcaaatatccccattgggtatggtttccaaggtctttctgtttatcttcttaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccacgtaagaacagacttgctcagaaatattttggggattcatcacacatatcccaagtttattccttatccccacctcccaatgatcatttgcatactaattagtagcatgtggattcaaatttccctcagcattttaactgaacctttccgtataccacgcaaaattcattgctgtggaggacagaaagataaatgtttttctcctcactgggaagggctacttcttttagctataaatgttaggcgaccaactgaatctttttccatttgcaatgctgtatctcatcagattttagtgaccttgaagacacatattagtgcaatagcccattaaattgcctccactctcgaattctagtaaggagatattcctcagaatccattgagacttaataatctgtgacttcgtatatcttaatttttttatagcaccaagtcaaccccccggaaacatcatatggaattcatcagactccaaaattatcctgaattgggatcaagtgaaggccctggataatgagtcggaagtaaaaggatacaaagtaggtaatttcttttttgcaaaggcacctaatcgtgctgtgagtgggggcagtctcctccatgaattatacagttgtctgcattgtcagtttccctggtgatgctctcctaccctctaggaatcgctgcctccaacacggtttgatctgagttgtataaatagtctatggcaattggtcaggatttagacaatcaccttaactttagtctcaggcagcatcaatcagaaatggataaagaccctgtgtttgggtctccaaaaataccctgaagaaccactttttaaacattcctactgtcagcttcgttttgctcctgtctcggtttatatatattttttagtcaacttagtagcctcctgatattaccaatgattaatcatttttgttcgtatgtttctatagtcaagagttatataaagaaaaagagaaaagagagaaaaagcaggaaaagtggagaaaatgtttgcctgaccccataaatgttggcttgtctttaatgagaaaatgaaaagaacatgtctgtagccttcttgcagcaatcaaaaagggttataaatatcttgcaacgtttccagctacctatttgctacctaacaaaccaacctgaagctaggggctaaaacagcaacagtgtatcattttttatgactttgcaatgtggatagggccagaatggacagattttagggctggaataactaagatgcttcttcacacacttttggcttcttggatgggataggtgggaaagctgaggctggccagtgatcatgctctctatgaggcctttccccacggataacctgggcttcctcacagtatggtgacctcagagtagtcggatttcttacatagttgtcagcttcaagaggaagaaagcagaagctgccagcccttttaaaagctaaggatggacgtgggcagttccaagatggccaaataggaacagctccagtctatagctcccagcgtgagcaacgcagtagactggtgatttctacatttccaactgaggtactgggttcatctcaatggggcttgtcggacagtgggcgcaggacagtgggggaagtgcaccgagcataagctgaagcagggcgaggcatcgcctcacctgggaagggcaaagggtcaaggaattccctttcctagccaagcaaagctgtgacagacagcacctggaagatcagggcactcccaccctaatactaatactgcgcttttccaatggtcttagcaaacggcacaccaggagattatatcccatgcatggctcagagggtcccatgcccggctcagagggtcccatgcccacagagccttgctcgttgctagcacagcagtctgagatcgaactgcaaggcagcagtgaggctgggggagggggcgcctgccattgctgaggcttgagtaggtaaatagcggcctggaagctcaaactgggtggagcccactgcagctcaaggaggcctgcctgcctccttgccctctgggggcagggcatagccaaacaaaaggcagcagaaacctctgcagacttaaatgtccctgtctgacagctttgaagagaatagtgtttcccccagcacggagtttgagatctgagaatggacagactccctcctcaagtggttccctgacccccgagtagcctaactgggaggtaccccccagtaggggcagactgacacctcacacagccaggtacccctctgagacaaaacttccagaggaacgatcaggcagcaacatttgctgttcagcaatatttgctgttttgcagcctccgctgctgaaacccaggcaaacagggtctggagtggacctccagcaaactccagcagacctgcagctgagggtcctgactgttagaaggaacactaacaaacagaaaggacatccacaccaaaaccccatctgtacgtcaccatcatcaaagaccaaaggtagataaaaccacagatatggggaaaaaatagagcagaaaaactgaaaattctaaaaatcagagcacctctcctcctccaaaggaacgcacctcctcaccagcaatggaaaaagctggatggagaatgactttgatgagttgagagaagaaggcttcagatgaccaaacttctccgagctaaaggaggaagttcgaacccatcccaaagaagttgaaaaccttgaaaaaaggttagacaaatggctaactagactaaccaatgtagagaagtccttaaatgacctgatggagctgaaaaccatggcacgagaactacatgacgaaggcacaagcttcagtagccaattcgatcagctggaagaaagggtacctgtgatggaagatcaaatgaatgaaatgaagcaagaagagaagtttagagaaaaaagaatgaaaagaaacgaacaaagcctccaagaaataagggactatgtgaaaagaccaaatctacgtctgattggtgtacctgaaagtgacggggagaatggaaccaagttggaaaacactctgcaggatattatccaggagaacttccccagcctagcaaggcaggccaacattcaaattcaggaaatacagagaatgccacaaagatagtcctcgagaagagcaactccaagacacataattgtcagattcaccaaagtcgaaatgaaggaaaaaatgttaagggcagccagagagaaaggtcaggttacccacaaagggaagcccatcagactaatagcggatctcttggcagaaactctacaagccagaagagagtgggggccaatattcaacattcttaaagaaaagaattttcaatccagaacttcatatccagccaaactaagcttcatcagtgaaggagaaataaaatcctttacagacaagcaaatgctgagagattttgtcaccaccaggcctgccctaaaagtgctcctgaaggaagcactaaacatggaaaggaacagccagtaccagcctctgcaaaaacatgccaaattgtaaagaccattgatgctaggaagaaactgcatcaactaccgagcaaaataaccagctaacatcataatgacaggatcaaattcacacataacaatattaaccttaaatgtaaatgggctaaatgctccaattaaaagacacagatggcaaattggatagagtcaagacccatcagtgtgctgtattcaggaaacctgtctcacgtgcagggacacacataggctcaaaataaagggatggaggaagatctaccaaggaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaaaatatatgcacccaatacaggagcacccagattcataaagcaagtcctgagtgacctgcaaagagacttagactcccacacaataatgacgggagactttaacaccccactgtcaacatcagacagatcaacgagacagaaagttaacaaggatatccaggaattgaactcagctctgcaccaagcagacctaatagacatctacagaactctccaccccaaatcaacagaatatacattcttctcagcaccacatcgcacttattccataattgacctcataggtggaagtaaagcactcctcagcaaatgtaaaagaatagaaattacaacaaactgtctctcagaccacagtgcgatcaaactagaactcaggattaagaaactcactcaaaaccgctcaactacatggcaactgaacaacccgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaccattcaaaaaatcagtgaatccaggagctggttttttgaaaagatcaacaaaattgatagactgctagcaagactaataaagaagaaaagagagaagaatcaaatagatgcaataaaaaatgatcaaggggatatcaccacccttgagagtgggtaacagggttagaccagatggtaggaaaggacactttctgagttcttcttaatttccagctcagtcactcccccttctttttaggagtggtactggaagagccagacaccctacacctcctcaactacaccccaaggaaggtcactgtaactggctatacattttgaattgctacatatacatgtgaatgtttagagatacataatttaaagctacaggtatccacaggttccatactctcaaatgtggatcaaaaatattcaggaaaaaaaacacacaaaaaaatacaatgaaaatgacacagattttaaaaacaatacagtataacaactatttacataccatttacattatattaggtattatgagtaatctaaagttgatttaaagtatacggaaagatatgcttaggttatacacaaattctataccattgtatatccaggacttgagtatccacagattttggtattttagggaggtcctgaagccagttccctgaattaccaaggtaccaatgaataactctctctctttctctctctctctctgtgtgtgtgtgtgtgtgtgtgtgtgtgtatttgtgtgtgtgtatgtgtggtacctcccgtgatatctcacgtcccatgatagctcaggaaactctccctagtgtcacttttagggtgagattagaggctgaataaaaagcggatctgattgcaacggaagagttgacctttgctagagaatttgacccattaaatatggctattgtttatctcagactgaccctttccaaaattaagttttcctcccaaatactgaacatgttggggtgtgggtttattttcccttcttcactaagttgtctgaattctttagatctcagcttaggtagacagtctcaacaagaagctgactttagaaagtttaaggccccaaatattttgtcaacacaaatccttaagctactttatggcattagagctaaaaggagagcatctggttttagtatcacaaattaaactacctgcagggccaggcagataacataaatgagttctgttcagtccattcagaaactactactaatacgtctactaagcactgttccaattcatcttaactttatattttattttgttgtattttgagacagagtctccctctgtcacgcaaggtggagtgtagtggtacaatcttggctcactgcaacctccgcctccagggttcaagcagttctcctgcctcagcctcccaagtagctgagactacaggcgcccaccaccacgactggctgatttttgtatttttagtagagatggagtttcaccatgttggccaggctggtcttaaactcctgacctcaggtgatccgcctgcctcagcctcccaaagtgctgggattacaggcatgagccaccatgcctggcctcatcttaactgtataataaccatgaagataggtacagttattattgctagttttacggatgaagagctgtggcatagagtttagtcacttgcctttcacacagctggtatgttgaagacctgggatccgaatacagcagtatggatcctgagttctacatttagccacttggtgcttctgcctaccagccataaataaatagaataagtgataacaaagtactgcagagaaaaagaggctagagtgaggggaatagagaaagccatggagtggacaggagagatgtattattttatagaaaggccaaggaaagccacttttaagtggtgagatttcagttgggccttggcacctctctgggaatgtcccaagtactgcaaaaaaggaagtgcaaaggtccagaggtaggcatgtgacaatgtagcaacattggaagtgttgggactatcaccaactgcagagtttgtgattgttcagaatgagacttctcaactccaaccagttgttggcagacaggaatatagatcactggcttagtctattttattctggatcgcacttttgtagagtcttactcaggaacagaatacctgagactgggcaattaatatgaacagaagtttattgacacccagtgctgggagggagagggatagagagctgactcgcccttttacaacagtgctaattccatctgtgagggtgagcctaatcacctcatggcctaattatctcttcaaggttcacctgttaatacagttaaaatggcgaatttcaacatgagttttggagaggacaagcatccaaagcatagcaaccagtgtggccatatcttccagtttttcagtagaacccacaaatttttaatgtctaatttctcggtttttaaatgttcatgtctaactcaaaaaaaataacactatgacagccaaacaaataatatatgcaggctggttatgacccatgggccactagttttttgctgtctaactcccttggtttgtgttcccaaagacagatgccagagagggaaagcaatttgcccagagccctacaggtggtagccaaggtagtcttcgttaaaaatccaggttctgaggccgggcacggtggctcacacctgtaatcccagcactttgggaggccgaggtgggtggatcacctgaggtcaggagtttgagaccagcctgaccaacatggtgaaaccccgtctctgctaaaaatataaaatcagcagggcatggtggcgcatgcctgtaatgttagctacttgggaggctgaggcagaagaattgcttgaacccgggaggcggaggttgtagtgagctgaggtcacaccatcgcactctagcctgggcaataagagtgaaactccgtctcaaaaaaaaaaaaaaaaaaaatccaggctctggagccagactgcctaggtttgaatgcaggatccgccacttaccagtcatgagaccgggcaattgcttcacatctccacatctcaagttctcatctttgaaatcagaataataacattgccttccttaagaggttatccacataagcatttagaacaagcttgtacagcccacagcccacaggctacatgtggcccaagatggctttgaatgtggcccaacacaaattcataaactttcttaaaacatcgtaagatgttttttgcaattttttaaaagttcatcagctatcattagtgttagtgtattttatgtgtggcccaagacaatttttcttcttccagtgtggtccagggaagccaaaagattggacacccctgatttagaacacacagtgttcagacattaaatagtggaagtagtctataatatttgctattatcattattcccacaaatccattctttccccttgtcttccaccctagattatatcaaatgcaagcacagccttcaatcagctcaagcaagtgtttggtgtaaataaaggctttacaggactttatttgggttctgctgcagtccataatactgcaagactgataagcagtgctgataaaagtgctgctttttcctggaagtgtttcttttggatttatatttgaaacaagttgaatcctctgagctcttgcaaggaccagaggtaaatcaaagcagcaatttattcctcaaagccagatgtgaccttgcatcccatcagcccattctcctggagggccgtgatgagaagctttgacactcctgaatgtgcctgaggatttatctgtgcctaatcatcagcaaggggatgctgggtctgatacaactgatgctgcggagaagaaggggacacttatgaatctttctaccttaaggaaattgtgttttccaccttgtgttagagagatataaattaaggtgatgaaatgccagggaacagatgggttctaaaccattctaaaggaattttatgaatttcacttgtgtctggttttgtcttgagacacaagagtgaccttatgtctgtagcctcagcagatcagaatttataagggatcttagggaaggatgagctaatctcgtgcttctcaacgcatgatccctggaccatcagcactggcattagctgggaacttgtcagaaatgcagattttcaggtcccatcccagaactaatcacaaactccaggaatggggcccagcaatttgtgttctaacaagttctccaggtgattctgttcacgcttgaatttgagaactacgcgtctaattcatctaatcatgatgcctatcccatattaacatctcctgatgatcttttagaaaacaactacagcatggatcccacctctgtgcagtcttaggcaggctagagtggaactggagcggggttactgacctcctcacagtcaacactttgagctagagagttctttgttgcggggctgctctgtgcattgtagactgttcagcagcatccctggtctctctatccactacaacaggaggacatgttttgacaaacatgtctgcagacattgccagatacctccctgtgaggcaaaattgctcccctgcccctcccaccctgttgaaaaccactgagctacagcataagtattttacaagcaccccaatggttctaacatgcagccaggaccaaaaaccactgacctcatccaaccctatctttttgtcaggggaaactacagaggatgagctttagtggttctataggtaaaggcacactttcccagacctgtatattttgttcctgattggagtaaatccaatcacagcaggcaatcccaggtaagtgaatgtgtttttaggaggctagttggccacctcatcaaatgaatccacctccaaactcagaacccatggggggcccaagatgaaaacaggactgttgcaagctgcagatatgtccagggtgacaatggttgcctcttggctacctagccccataaagtggggttccagaggaaaggaatgggaggttactactcttgcctttccgatatcttctccctgtgctgaaatgtcctgtctctaagagtcgtgatcataacttattgtgcctggcttgtgctctaacctttgccatgtatgttctctgattatctttaagccttcagagatactatttcttacatgcttcctctaagctaggccatcaccagattcaaaccttgtgcaatcttttgtatttttatatttttgagacagtcttgctctgtcacccaggctggagtgcagtggcttgatctcggctcactgcaacgtctgcctcccgggtgcaagcaattctcctgcctcagcctctggagtagctgggattacaggtgtgtgccatcatgtctggctaatttttgtattttttgtagagacagggtttcgccatgttggtcaggctggtctcaaactcctggcctcaagtgagtcacccaccttggcctcccaaagtgctgacactataggcatgggccactgcacccagcctccttgtgcaatcttgaaaacacactccagaagactgggtattattgtcccccttttacagatgactgaagtgaggctctgaaaggtgaagtggcctgtgatcccacagtggccaagtttattctgatgccaaagcaccgatgtgtaactgagcactgtacatccttaaggagctactcatattttccactttcccaagagtgtcaactgagcctccgagaggctaggcagtaggtagaatcacgttgctgatgcccctgatataatatcctttcagctctttccttggaataaaatggtagctgcagtcatggccctcactgcaaatgagccttccaaatgcaagtgggcagccagacaacctctacatccctgcattttgctcgtgcccagaggtgaaaacaaatgaatgctccatatttgggacctttgtgaagacggcaggtgacacctgttctttctgtattggcaggtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaagtgagaatgcctttttttctcccttttctcctgcctgtcttatcttatcagccttccagatgagtcagggcttgaaagacattcagcctgcaaaagcagacttaaaatagaaatggagaacactaccccccttctccagatgtttgctggccataggcagtttcatgcaaaaatcagtttgcccgtgttgactgatctactcagttgctaatcaaaaatcagattaaagcagacccgaattagtcactaaggtttttccgtgtcaacctgtgtagtttgcattgcatctattgtagccccagaattacagtttagaaagtgaaaagcattgactcagtcagaaggaacaaggacaagcattgttaagtatgccgtagcagtttttctccagtgaaacagtgtatgcagttcagtatcttggaaatatttggaatttactacttattttcaatgggtatatgcaacatgtgcatcaatgtgtatgtctctctatagtcaagattatcttcactttcaaatgttgttgaatagcatgggagaatagcatattctttttgagcaaatacattcaattctgtttttacaaataccatgtttgtaagtatcttaagagcatgatttttttgttgttgtgtgtgatctcatttatttaaagaaaaaaaacaaaatagccaaatccgtggagacagaagtgaggctagtgattggcagtggctggtcagtggggaatgggggtttaggcactgggtcttcatttggggtgacacaaaagttatggagcttgagagtggtgctggttgcacaacactggagtatacttagtaccactgatttgtacattttaaatgagttaaaatgctaattttgttatgtgtattttacagcaataaaaaaaagactgtggttagatatctaagtgtagactttcacaggctttcagatttcagtctggagattaggggagcagtgaaggctggaggtataaattttcaagacattggtaaaaagatgatattttaaattatggacaaaatcctcaccaccatcctgacttttagccatgtgacatccctctgctaaggggtgatatgccagtgtttctggatggagtttatatttactgcatcttttttgcatacaaacacaaaaggcatttttgtcttaaaagggggacaattggattatactttatcaaacaaagcctctaacttctatcgaaagggagctagatttttggtgagatgtggaagtaaaatctccaggccacaaaaatacaagattggggcttatctcgcttcattaaaaatctgactttatacttcatactttcttatcattgcagggattgacatttttagatagactgatgattcctggttttattcattacaaaaacatatattaagcaattatattggtgtaattattagataacaaggaagtgactgtgaaccaaacatgatctgtttcaagagatttttcatcatgttggtcaaagagaccttacaagattgaagaacccccgaatgacagttgatagcttcttactatgaaaagtgtaagacccataagaaaatttaaaaaaggattgaggctattttgtttgcagaaaaggggtagatttagacagacatgggtttgaaccccagtttagccatttactagctgggtgatcttagataagttactttatttctctgggcgcaaattaccgccatctgttaagcgaggtaataataatacctggccttcatccagtttttgcaagatttaagtgtcatattcatctgtgcccagcagaaagatagagttcaaaagggagcagcaattttcattttgttgaatcatcgacatagcatgctgtttatcagtattgttactagtaatattgaagtttcttctcacattagataggaacctccttactttacaaatgctttgacagaggtacagggctgtcctataccctactcccaggtttgtagcttggtagtcatagaactgatatttaaaagccattaagaccttgatcatcatttccagtagaatccatgcagttctgctgtttcaaaaagccccgtggcccctcttccctttgaagccgggatggggctgttttgagtgaatttgttctctcttttcagatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaaga

SEQ ID NO: 1602 - DNA, 165748 bp, Homo sapiens; identical to SEQ ID NO: 1600

SEQ ID NO: 1603 - DNA, 40891 bp, Homo sapiens
ttactgtaaaatgtcattttaaatgtttattttattttgcacaattttaacagtagagtaattttgctgtggaaaataaaatttcatcttgcaagaaagagaaaactcaagaccaccaactggcgtctttatttacatattagagcgggtcagccaatgaaaatcctagaaaaagaagacaacaaacattcagtcaaaagaaatgattgtctcaaattatatcctcattgtttcacttgttctaaaacctaaaagtcctacacaatggtggcaaaatgaggtttgtctttgttctggtgcttttcccaaaaaggacctaaaaacctattagtgaatcttcctgctgtgtcctataaaacaacctaaaatggcattctgggtcctcttccattcacagtaatcagagcacaaaaactatagtctaaaagaaccagaagtacactcagaaggagaagggagatgaaggaggcccacagagggctgagctcccaggtctgaggacatgagtaggaagaactgtgcacggaagtcttttccagaactaacaccatcctatacatatggcctggacacaggcacagatataggcattcccatattgaggcaggaagtggccagcctacactgagaatcaatgataaatggcagacggacagaaagacaaaaatcaacagtttggaaagtataatgtatgtaaattccactggaatgaaaataaataatttcaaagtgataaatgtaagaaatataaaaataatcctcatagaattgtaaaagaggaagacgagaactcatatttctccagcaatatccagcaatatccaaacaaaattcatagagaaactgtagaacagatcattggaagcaaatcaatagcatgaactcactagcagagatgacagaatttgttagggcttttctgtgattaacataggtctcaagatgatgatgatgattattattattttgagagacagtctcactgtcacccagattggagtgcagtggcacaatcttagctcactgcaacctccacctcctgggttcaagtgattctcgtgcctccacctcctgagtagcagggattactgacatgcaccaccatgcccagttaatttttgtatttttagtagagacaggtttcaccatgttggccaggcaggtctcaaactctcagcctcaagtgatccgcccaccttggcatcccaaagggctgggattaccgtgcccagccatcaagattatatgtattcattaagcttcttacagtggctttagtttccccagggctctgatggcctgatgcccggaggagggtgtttttggttaccaaactaacatcccagtcactggaaagtataaacctagttataaatccataaagtggcatgagatgaaaaagcctgtctattgagtgtctgactagcataaatcattttaaatagaacttaaaaaaagaaaaggcaatccacaaacccacaggagtacagatagattctgaaagtggcagaccctcccttaaaacagtctgcctgcttgctccacagaaatccctgctaatgccccctgcccttcagcttactaggctagtttttctgcattcatcttcctcatcactaggtttcttgagtatctcctctctctgctaggaagtaaatgccaaagtcattgaaatctgtttttacacaaatagaatttcaatagaattctatatattttagtgtctaaattagttaatttatatttcattgattatccaggtatctgtttacccattcatccaccgctttgttcacaaaagaaagagattccatatatataagaaccaagacagaaagtacttgaaaaaaatatctgctctgataagagtggctgatacacaaactgttcgcacggaagacaggttatatgaggcggcaagtggcagaaccaggatggcagtagaaaattaagtatgaaatgcaacttactctgggataggagaggctcatgctatgaactttgtcatttactttactgctgtaatcaacactgcagtttcaccctggaggtcaaagtaactaattttgaatgtacctgcacaaatccttgtattacagttgcatctccctcttcctcagacttgccatgcttcctctttcctcttgctacagagcctgttgcacatctcttccctctcccctttgccgagttagtctctgcttatccttctgatctccgtttaagaatcacctcctctgagaagccttccctgtaaccccaacataaatctgattcctttgtggtacgtttgctcagaactggattcctttccttccaagtaattgcttcactctgtcatagtgtgttcagttgtgaggttaccagactgtccctctcccctaccagactacaaaagctccatgaagtcgtgaggaccgagcctggtttggctcaccatgctattcgtagcacctaacacatatctcaatattcactgaacaagtacatgaaactgccaaactcagaaatggtttagaaagacctctgtggatgatagagggtgttctgtttggtagatactttttggagggggataggggaagcagatgcatttcttgctttctgcttagcaactgtatttacctgggccttccgtgtggcttgtggctcaatcatgatgttgataagagaaggtttagttgtgtctgctaggctctgcctcagggatttttggagttcttctggtgtttgtacaaaataccctttgcctccaaatgcagtcatgacttgctcataatgtgaatttggcagcaaacacattggagggaccctgaaaaacaaggtcatgagtcaatgaaatttaaatcttaaaccttgtagaaaaaaagtcattctctgaaatacttcattaaaaaaatttcagctgaactcaaaggcatacttttatcttcaacacttaagctgagatgccagtacactgagtttttcctatatttataattgtctatatagcaatgtccagtagaactttctgtgatgatagaaatgttttaaacctgtgccatccaagacagtagccactatctacctgttgctgtgagcacttgaaatgtgactaaactgaggaactaaatttttaatttcatttaatttgaagtaatttaaatctaatttgcaacagttgcagcatgcctagtggctactatactagacagcacaggctacattatcaactattatgaatccagaagaaaaacatgaaaaaaaaagattactgcaaaacaacaaataataagaaaacaacaaataaagttagtgaggcataaatagacacacccataccctgttccaccccaaggctggctcacaaattcatatctgtctcacattctacggccagctacaatactgtcttaatctggctctgccatcagatgatcaagatttagctaagtggtgaaaggaaggtagacctctggaacacaaataatacgtaaacatccacatttccaaatggtgtaacaggaatcagtagtcctactattgctcccagtccagggagcattttgcaataagccttttcattaacaaggctcagacatcacactcatttatctgagtcttcagtggctccctgattatttactgaagcacctaatcatggatatttgtgcaaagaggaactaagacaggattccttctctttagaagggctgacaatcgaaacggacaatactcataccatgtaggcacattactgccaatatagaagactttttaaaaagagattaaaacgggaaagagaaagtaaacagacattggtcttggttacttacactgcagtagcatcttgaaattttaacatttctttccaagtatctgtatcaaaaccttggtaaattccattgttattcactaccaacagtatgattggcaagttgtacctaaagtgagagtaaaatatgaaggaaatcattcttcattttaaagtaatttcttttctttgggttgaaactttaacttaaaaatgaatagtttcctataagctttttgtattattagaggaagactaaaaatcaagcatttattatcctaagaaagaatatcaaataattaacagaaacatcatggaaaggcagaaagaatgcaagattaagagttgttagtcctggctgggcatgatggctcatgcctgtaatcccagcactttgggaggctgaggtgggcggatcacaaggtcaggagttcaagacaagcctggccaatatggtgaaaccccgtctctactaaaaatacaaaaattagctgtgcatggtggcatgtgcctgtagtcccagctactcgggaggctgaggcagaagaatcgcttgaacccgggaggcggaggttgcagtgagcagagatcacaccactgcactccagcctgggtaacagagcaagactccatctcagaaaaaaaaaaaaaaagttgatagtcctttagctattagctatgaacctcagacaaatcactgagcttttctgaatctgggttttcataagtctagatggtatatgaagaacaccttccctatttaatactctctaaagtaccacttctagttggttcctaggaacagtgtttgaaacgtacctttctatttactgagctccccacagacacccagctcttgctagatgctgtggaagatacacaagtaactagcacacacaatctgcactcaaactaccacacacataatcagaaacacattacatggtgtagtcagtacagaaaaggagtatttaacagtgtgctaaacagtatagcaaagacaaaaaagaaaaggttgattaaatgttattgactgaaaagaatgtaggttttattttctaacataatttccaagggcaagtggtaaaaacaaaactaaactgcatactgttaaataacaggactgtggtaattatttgctctccatgctcaaaaggagtcattatccactaaaaggctaacttccccataagtcatcttttttgtgtatatcacttggttgtcaataaagacactctaacagacacatacagtcagacctcattatctgagttctgcatccgtggatttaaccaattgcgggtcaaaaatatttgggaaaaaaaattggatctgtactcaacatgcacagactttgttcttgtcattattccctaagcaatacagcacaacaattatttatatagcattcatattgtattcagtattttaaagtaatctagacatcattaaaaatatatggggggtatgcataggttatttgcaaatactgcacaattttatatcagggacttacttgagcatccttggattttggtatttgaggaaggtcctggaaccaatcccccactgatatagagggacaactataccttcccaaatcttgaacgttttatctaccaaagctttgccaaccccaaaacatgattcacaaaagccctaataagagccctggctaagaatagaatggttttactacagtttaaatatagctggaaaaataaaacccccatccttctatagtgaggatctacaattcatgagtttctccatgaattctcataactacacacatgatccaaatgactcatgttcactgagcatcacctcagaatttagctggggccaagcatggtggctcacacctgtaattctagcacttagagaggccaaggcgggtggattgcttgagcttagaaatttgagaccagtgtggccaatatggcaaagccctgtctctacaaaaaaatacaaaaaattagctgggcatggtggtgcatgcctgtgatcccagctactcagaaggctaaggaggcaggatccgttgaacttgggtggttgacgctgcggtgagccgcagttgcgccattccactccagtctgggtgacaaagcaagaccccatcttgaaaaaaaaaaactgcttggattacctcatttgtttttcataatcatctttctaaggtaggaactattactattcctactttttttttttcaaggaatttctgcctaaaggatactattcctgctttagaagagaggagactgaggcttggttaagtgactttttttttttttttttttttgcgatggagtcttgctctgtcgcccaggctagagtgcagtggtgcgatcttggctcactgcaaactacacctcccaggttcaagcgattctcctgccttcagcctcccaaatagctgggactataggcatgcaccaccacatctggctattttttgtatttttagtagagatggggttttaccatgctggccagactggtctctaactcctgacctcaggtgatctgcccacctcagccacccaaagtgttgggattacgggcatgagctaccacgcccagccttggttaagtgacttaaagtcacatggctctgacttgatagaaccagtatttaaatccaggccatttgtcccacaagccatgctgccttttttttttttttttttttttgagatggagtctcgctctgtcacccaggctagagtgcagtggtgcgatttcagctcactgcaacctccacttcccagttcaagcaactcttctgcttcagcctcccgagtagctgggattacaggcatgcatcactgcgtctggctaatttttttttttttttgtatatttagtagagatgggatttcaccattttggccaggctggtcttgaactcctgacctaaagtgatctgcctgccttggcctcccaaagggctgggattacaggtgtgagccaccatgactggcagaagccatgctcttcaaccaccacacttgctatttcccacaggaaacaagcttctttcagtccccaacatttttttctcagtgacctcaaaaccactccccacagttttacaggtttttaccatacagtgaggaggccagaaagatacggttctggaagagaaagaccgtgggttactgccactagcatcctcaggacagaacacagtgctgtgcacagggcacctggtgaacgcttcataagtatttgtcaggtgactgggtcttgtgtgtcatttttcatattctagagaatcaaatgctctgattcaggatgatgttttacctgcagatggtttctacctccatgccagaaaacccaaatgcactgtctccttccacacagatgatccattgcccagggcttctatctttagccaccacggcagctgcaatagcaaatcccaaaccaactcccattgttccgaaagtaccagcatcaagcctgttggagaacaaagttaaaatgaaaccctctggggcatgtcatagaggatgggattggcacaaaccttctagtcatatttacatggttgatggaaaaatgaagaaccataaaaacattctctttcttcaatataaaatctttagactgctaggaactaatttgtcaaggatagaaaaaagccacccatgtttgcttggaagactataaacatattcctagaatactaagtaaacaattatcatgataccaagaacacatcaagcataaaaactctacaaaacctcacctaaggatacttttatgaaatatgtccttacatactaaacatgtattaattctcaaacgtcttcttaatctgcactattacagtttcatattaaacacattataatgaattacgacttctttcttctttagaagtcttacctgtgacgaggaaggtagttctgaagcacagtccgtccaatgtccatagtatttgctccttcacttaccacgaaacagtctctaggtagttgttcttgaacatggtagaatactgtgtaataattcataggcagggattttttagaagctagttcctgaaaagtagatgggaatataatcaaattaaattgggatacaatgaaaataaccaatgttaataagatgctatcaaacttatttggaaatacgcaacaactacaagctacaaggtttccaaatggctataaaatggccactctgagaagttggctgacctgtgaacagccctgggggacatgtgtaccacagtcccagttgggaacacaattaaataagctcgggaatatcccgcctcttggagatctgcaatgcacaggagtgtattaaagacattgagaagtcctacagtaaagacagctgagaagcactgggttacataaaactaaacgttcttatttgagcactcttaggaaaacggtgccttagaaaaagtgaaatttattccagaatattttcatctgaactatgaccctaaacttaaaatgtcacaattttagaatacaatctgaaaatctagtttttcccccaacacacttaagagttaaaggagctatcttacccccactattctaaagagtccctgaatggagagaaaaacagcaaggtaaacgcctttgtctagccacatgcctttcagggctgagaaaaagccatagagagctttagcagcaacagtcccatctggccccaggactgcctcttcacctatgctactttgttctgctggagattatacacaaggtaaagagggaccctcctatactcctgcactaaagaagagaagcaagtcccttctatcttaaaccaacatcgttcctatgcgaaagaaaagattagtcatgatatgactcaggaaataaaattgagactggtggccaggcatggtagctcacgcctgtaatcccagcactttgggaggccaaggcgggcggatcacgaggttaggagttcgagatcatcctggccaacatggtgaaatcctgtctctactaaaaaaaatacaaaaattggctgggtgcggtggctcacgcctgtaatcccagcactttgggaggccgaggtgggcaggtcacctgaggtcgggagttcgagaccagcctgaccaacatggagaagctctgtctctattaaaaatacaaaattagtcaggcatggtggcacatgcctgtaatccagctactcgggatgctgaggcaggagaattgcatgaacccaggaggcggaggttgcggtgagccaagctcgtgtcattgcactccagcctgggcaacaaaagcaagactccatctcaaaaaagaaaaaaaaaaaaagtagccaggcatggtgccagctacctgtaatcccagctactcgggaggctgaggcaggagaattgcttgaaactggaaggcagaggttgcagtgagctgagatcgcgccactgcactccagcctgggcaacaagagtgaaactccatctcaaaaaaaaaaaaaaattgagactggctccagatagaaacagtcattgattaaaattctaatgtaggccaggcacggtggctcatgcctgtaatcccagcactttgggaggccaaggcgggcggatcacgaggtcaagagatcaagaccatcctggccaacatggtgaaactccatctctaccaaaaatacaaaaattagctgggcgtggtggcacacgtctgtagtcccagctacttgggaggctgatgcaggagaattgcttaaacctgcgaggcagaggttgcagtgagccaagatcacgccattgcactccagccctctagcctggcgacagagtgagactctgtccccaaaaaaaaaaaaaattccaatgtaagacagattcatgtacaatcaattctgctataatgtttgatgcgaaaatgtgaatttattctaagacaattgatatattagggaaccaagtgagcataactcaaattttatatttgcttatgcgtgattccaccagtaagaaacactggtggaatcacgcataagacacagaaaactgcacccagctgaacaaagatacatatgaatacacaaaacaataaaaaaaaaccacctttctcacatagggaaagcacaatacacacacatgcacacacacacacacacactttactagaaatcgccaaatcctgcagcactgactcattttagtgctagtagtagacagtttgatggtttctagtatcatcactacaatttccaaaaccttagctaccaggcaaagccaagagtgcaaatgagagcgctgcaaaaaaatttccagcagtgataaaaatgttaaataaaaaagaaggctatacattggatcaaaatttcaatttttatgaaacagctattataatagcacgccctgaaggacctatatcttaaaagcagaaaaacatctcaacccaagatttaaggattcaaaaaaaaaaaaaccacttaatagttaatttgtttttcttttagagacaggttctcactctgtcacccaggcttgagtgcagtggcatgatctactactgcactgccacctcaactcctagagtcaagcaatcctccaacctcagcctcctgaggagacaagacaacaggtgtgtgccaccacatctggcttttctttttttttttgtagagacaaggtcttgctatgcccaggttggtctcaaactccaggcctcaattgatcttactgccttggcctcctaaagcactaggattacaggtgtttaattgtgatgttctatgccaccatcaaactgaaggcacacccatccacttccactattatgactttctatccaatgtccaatcaccttccttccaccagctcacagtaactcacaagctacaacctttcagaaacttcaggtctttttcaaggtaaaatgctatattcattggcatatatttcttaaccatttaacacgtttaaaacattaggttcttatcttatttttatgttacacaaagtttttgagagttgtgccactaaatccctttttccatgagacctggggttttcactgcacaattttgcacatcaaggtgatttttaggaatgcacatgtcacattacggcagaagtaactgaatcatgagcctgacctgttattgagcgtcagtaggtccgattttaccttggatgcagcttcattgctcttcattttttctctcagagttttccaccacttgctctctggaggatactgccatggtgttttatcaagttcctctaaaagcttaaaaaaaaaaaaacacacacacacaaacacataaactttttctttgccttttttttcttttttttttttttttttttttttttttgagacgaagtctcgttctgtcacccaggctggagtgcagtggcgcaatctcagctcactgcaacctctgtctcccaggttcaagcaattcttctgcctcaacctcctgagtagctgggagtacaggtgcctgccaccatgctcagctaatttttgtatttttagtagagacgaagtttcaccatgttggccaggctggtctcgaactcctgacctcaggtgatctacctgtctcggcctcccaaagtgctgggattatagggatgagccaccatgcccagtctgctttttaaaaataaatttaaatcatattaacacggaagtatcttcttaaagaagactatacggccatactacccttcacattactcagactctttttttcttccagttagtaaacacctgatagaatcaatgggaaacatggaaggcttttgtttggtcagtgtgggtgtctgccagatgctaacacctgatagaaaatcaatgggtaacatggaaggcttttgtttggtcagtgtgggtttctgccagatgctgggatgcccataggacagactggagtgctacctcctccacacctcaagcaagggctctgaaaccctcctcggtctttgacactggaaggaaaaccactccttccacagaactcttgcaggaaaaccaacaaataaccacggactcctatggtacagaccaaatgctccagagtgatttaatatgtgattcaagattatatcctatattgtgtaatcatgacaacaataccaaattgtatcatccaaaatcaagtgataaatgtgactatattttatctcctgtcacagtgaaatgtacaaactatgtacaaataataacaacctgtggaaaagtcactgattagtttgaagagtaaaaagctcttttttacctaaagaaatacttttagatttttccagtgctaagccattcttgccacttcttggcagtaagttcagttcctttggaaggtatactttttcagatagctggatgctatttaataaattagtaaatttagtatattactgtttgcctactgaaagatgttacattttcaatcatcttccaaaaatgcttaacttacataaaaatgagctatgtaccagaagttggacttaacaagttccaaagttgtatttaagaatagttttcaatcatacattttgtttaaaacagatatgaatagtagacccgttaccaagtgaatcaagattaaaacattttcaagaattgactattccctaataagcactccacataaactaaaacaaaagttctcacctgcttagtgacagcatgtatgtttcctagcaaagtaacagcgggctttacattattccccaattcttctgcacagatatcaacctaaaaaagagacaaggctaaagaacaacccatgtttattctgaaaaatatgtaagaaggcaattacgattgaataaatgaactgtgtatatagaacacatgataaagaagatttgatattcagaagttccttaataaaaaaagtaaaagtccatagaactatattagtatcatagctagtatagagagcctcattatcttccctcatttaaaaatctactctatggaattttggtattgcttcattatacccatagggaatgcatttgacctgatcaattatagttttgcatctaatcagtaagttctattgaattacatttggaattcctatctagagtgtgggttctcaaatataagcatatatcagagtcacctggtatattctgggcttgataaaccataaactgtaggagtctacctcagagttttttattttaataggtctggcgtagggtccagaaatgtgcatttctaacaggtttcgcaggtggtgctgatgcgcctggcccagggaaccacatttagagaacaattccaagaacatggcacgattacttctccatttactcagaagttccatgtctggatggccatggacaaatgatggcttctgcaaggaggaatactttagccaccccaaaggggatgtatctcattctataatcaagagggcaatcaagaggtattggcatcttccaggtaactctgtcttgtttgtctgcagttttagttctcaactggctcagctgggaaaggagcaattagaagttgactccttaagaagtaaaaggtagactgggaaaagggcaactgtagctggctcatcaaacatcaagcaacccaagcacagtggctcaagtctgtaatctggcattttgggaggctgaggtaggagaattgcttgaggccaggagaattgctgagaccagcctgggcaacatggcgagactttgtctttacaaaaaaattaaaattagccaggcattgttgtacgcgtctatagtcccagcatgtcaggaagctgaggcaggaggatcacttaagctcgagaggttgagactgaagtgagccattatcgtgccactgcactcctgcctgggtgacagagccaagatgctgtctcaaaaacaaccaagcaaaaacatcaagtaaaatggggcgaatccgtgtagggcaaaaaggtttgcacaccactatgcaggtagtactttccacaccagtaaagaaaatggcttataaggtgggtcataatgatacaagaatcatcaaagacaggtcagaatacattccggatgctgtttaatgacttgtaaaacagtgtcatttagaaattcccattggaagggtgaaagttttggcatctgaaagaaaacctcactccctaacaaggccaaatgttttgttctagtctaccatcctacttaagtctcttttctctacctttaaatatacttgaattgtgaataaaagacaaattatgctttctaaactatttgaaacttgattttgaaaggttttctggctagaagtggcacactatatttcataggctagaaaaggaagcttattttggtacctataattatgttagacaatttgtaaaattctacttgtgtaaaaagagaacagtttttttaatagtaatcaagaagataacagagctgattacggctgatagggagaataatgaacatagacatttctgattttaagttcctcctctctaagtacctggataaacttcacatctggctgatatcttggaggcagtccaaaatgtaaaatccaatttagtctggcaccaaataacacaattacatcagcaaattgcaaagccctattaaaaaaattgatatgaaagtataactacatttcttatttgaattattcgaaaattcatctctgaagtatttgaaaagtctaaatcatttggagcttacatcagacttcagaatcagcttctagggtatatttgatctttcaagctaaaataatttataaaaccattctatataaatagttatctaaaatataaattaagttaaaaaacattaccataagctgtatctacactcttttattacttttttataattagaaaaattagtacaagtacactgtaggcaatccagaaaaaaaacagaaaaagtataaggcaaaaaacaaaatcaccccataatactttcaacttataaactattatgaatatactggcaaattttcatctacttttgttttctacgcaaatacatttttacatagttgagcttatatactataatactgtctcatacactttttttattttgttttgagacagggtctctctctcttttgcccgggctggaatgcagtggtgcagtcatggctcactgcatcctctcctctcaggcttaagcaaccctcctacctcagcctcctgagcagttgggactacaggcacgtgccactgcacctgactaatttttaattttttgtagagatggggttttgccatcttgcccaggctagtctcgaactcctggtttcaagtgattcgcccaccttggcctcccaaattgtttggattacaggcatgaaccactgcacctggctgtctcatatacttttgcttacataaatgttttcctggcctggtgcggtggctcatgcctgtaatcccaacactttgggaggcagagataggtggatcatgaggtcaacagatggagaccaccctggccaacatagtgaaaccccatctctactaaaaatacaaaaattagctggttgtggtggtgcgtgcctgtagtcccagctactcaggaggctgaggcagaagaattgcttgagctcgggaggtcgaggctgcactgagccgagatcacaccactgcactccagcctagtaacaaagcgagactctgtctcaaaaaaaaaaaaaaaaaaaaaaaggtttcctttctcattaagttcttaaatacaacttttaaaggctacatattttgctgaacacaatataccaaaatttatttaatgttttctcaattgctagatattttgttattaatagtgctggcttgcacatcttcacacttaagtcttaatgcactcttcacattggtccctagaagcaggttatttttaagactattgattcatattccagaattgctttctaaaatattacaccaattagatttctaagttttattttatatattttaatacttttgtcaatataacttctaatcttttaatgatttctactttcgtaaacaaccacccttgctttctttttctttacttcacatatctttgcccagtcttgttttaaagctgtatcattacgtttccgatgtggctcttataacacatacagttgctgttattactaatctaatctaatctgaatgtctgcctttttccaggagagtttattatcataattgtcataattgctgtgggttttgttttgtttttcacttctcatttttctgctttttatctgtttcccctttttcctgtcttttgccatacaggatctgtatctactgcttttgtcttcttcagtgataaatgcaatttttcacagaaattatatactcataaattgagtacatactcaaaaatcatctttaatattgtattagtcctatgagacccaatttaacaaacagataactgcaatcagcaggacggacttgcttactgatactctaaaactcttgaaatcattgattcaattatttatagtcccttgtaaccttttttacactggtaatgtcattaatattatcctcttaaaatctggctagactgaagataaacttcatttcaacctaagtataaaaaaattaagtgtaagaattaacttggttactgtatatagtaatataaataaaaatacaacatattaagatagcattaagtgaggaacaattaaagatctagcagcaaacattacatttaaaaagccctcagaagccaggtgctcacacctgtaatcccagcactttgggaggccaaggtggaaggatcacttgagcctaggggtctgagtccagcctgggcaacacagtgaggccctgtctctacaaaataaaaatcaaaaaccctcagaattaattttaacccatgaatgaaaatatgaagaacaccaaacacatgacagtaataaactacagaaagggaagcaagaaatggcatcaaaaaagatatttaggggactgcaaatgaatccataattttttgcttcctaaaaagaaaaaaaaaaaacaccttaggccaggcatggtggctcatgcctgtaatcctagcactttgcgaggcctagaagggtggattccttgagcccaggagatcaagaccagcatgggcaacacggtgaaacctcgtttctacaaaaaatacaaaaattagctgggttgtagtggcacacacctgtagttccagctattaatacttgggaggctgaggtgggaggattgctttagcccagcaggcagaggttgcaatcaggtgtgattgcaccactgcactccagtccaggcaacagagcaagaccctgtctccaaaaaaaacccaaaaaccggctgggcgcagtggctcacacctgtaatcccagcactttgggaggctgaggcgggcggatcacaaaatcaggagatggagaccatcctggctaacacagtgaaaccccatctctactaaaaatacaaaaaattagccgggtgtggtggcaggcgcctgtagtcccagctactagggagggtgaggcaggagaatggtgtgaacccaggagacagagcttgcagtgaaccaagatcgcgccactgcactccagcctgggtgacagagcaagactccgtctcaaaaaaaaaaaaaaaaaaaaaccaaaaaccctaaagcaatataaaacaatgttaataactgatgcaatcctacttcttatacattactgccaaatgaaacctttttttacttagagattcatctgtctatattttttatgttgatgctgataaagttgagtggtggttatgtaagtgttcattacattattctctcttcctgtgtgtatagttagaatatttcataataaagacatttcaagaaattaaaaagaaaaaagttatagtatattaaaaagcatgccttaaaaatctaaaaagaggaaacttccaatgccagccaagattggctaagtttgaagaagcaacccacacagagggtaagtttccaaggtatttctcccccgtgttttgtctcctggctttgactcaaaggcagccctagttgcagaactgcaagcagcgaaaacttgcagagaaactgtttttttggccaaaggatcaggaaaagggccactgcaagctggagagtatggggggaaatgtcagattttttttctttttttctttatctccaagctctgctctgagggcagccttactgcagagctgcatggtggtggctcccaagcagctgaaattccaagagaaacgtcatctttgaggcaagagggattgggaaaaagggtccctgtggtctgaagagtatggggacaatccccattatttttttcttctgcagcttgttcagagggcagctttagttatgtgatactataagggagcagcaagagccaggaaaaggggcaactgagaatgggagagtgggggtgtggagcctacagaggagagaaaataaatccctaattctgggtatgaaccagtacatgtctggggctcacccctgagctggacatgtgcagacagactcaaaacagcacagcaaaggctctgaaactgaagtgaccctggaactacttatatatggttaagttcacacttcgatttgtagtcaagctaatctaatcacgttgactgattgctaagagaaaccaacaaaaatcaacattctacagaggattttaatatgacccagaatctccaaatacaatatccaaaaatccaggatacaatccaaaattactcagtacaaaaagagccagaaaaatgtgatcaactctcaaaagaaaagataatgaatagatgccaatctgagatgactcagatgttggaattaataaacaaagactgcagaaactattataatttaccccatcatgaagtatagaaaaatattcttaaaagaaatgtaaaaatagaagatctcagcagagaagcaaaatataaaataaaaggattaaaaagaaatgaacagatagatactcggggacatgtcagacagtatcaaaatggatgaaggttgacatagaaaaaatatttgaagaaagaatgatgaaaactttccaaatttagagaaagacaatttagagaaagacataaatttaaatattcaagatttgagaatcccaaaaggctaaattaaaataaaccatttccaggcacatcatacttaaactgctgaaaacaaaagacaaaggaaaatcttgggaacagccatggaaaaacaacatattacatacagagcaacaataatttgaatgactgcagatttctcatatgaaatgaaagccagaagatagtccaaaaataaacaggtatgcttaaaattccatgattctttcagaactccatcctagatgaagatcacaaaataatttaaattagcctaaaatctaccaagccattgtatttaaaatctggaatgccacacacctggatctggctgcacctacacagtatggatggttgtcagggacaacacccttccccataggggtgggcaaaaatggcagtttatattgctccaccaatttcttgatactctcttctgcatgagcgtaagcagcacctataagaaatgcaaatgtattggacaattcagttaagctataggcactgtgacccttaaaaaagttcatgtgaaattgctttttacttatttatattttgagacagggactcactctatcacccaggctggagtgcagtggcatgattttggctcactgtaacctctgcctccctggctcaagcaatctttcctcctcagcttcccgagttgctgggactacagacacacatcaccaccgcactcagctacttttaaaattttctgtatagacgaggtctccctatattgcccagctggtatgctggtcttgaactcatgggctcaagcaatcctccttccttgacctcctaagaaattacttgtagatcttctcaaatactctccttctgcctatacctgggcttaaactcaaaacaaattgtgattacagtttttatcgctggtattttaaaatgcttaacaaagtaagagttctaattttccaccaataacactctcaattatcctgaaggatgtctatcccaaaacaaaagtcacatctcacagctcttgctactgtcacttacccattctatgctatggtcctactaaactacactctacaagtccctgaacacactatcttcattgagaggcccaggtggccagggaaaaatgttgccctgaaagagaaaggctctctctaccctcatatgttggtcctcatctccagtaaacctcctctacacaaggcctcctagtccaggcatggaaattctaaggtgcattaagtttctaaagatctgcagatctttctacaggctctgtaattctgtgattgtaacagagctaaccccagtgggacacattatcttttttgttgttgttgttgaggcaaagtctcactcttgtcacccaggctggagcgcaatggcgcgatctcggttcactgcaacctccacctcccgggttcaagcgattctcctgcctcagcctcccaagtagctgggattacaggcgcctgccaccacgcccagctaatttttgtattttcagtagagacagggtttcaccatgttggccaggatggtctcgaactcctgaccttaggtgatccgcccacctcggcctcccaaagtgttgggattacaggcgtgagccaccacactcggcccacgttatcatttgttttcacagttatgtgcctgggaataaccctctgccctattcccttgatgacattaaaaataccttattgttcaaatgttccatttctaatgtcatcaagaccactatttttttttgctattttataatttttcaaggctagtatattattccatattctgtatatataattctctactgaatcctagtaaacagtatcatgcacttgcagattcaatataatgctccactctacaaaactaccttaaaatcccttctcatacatgtatgatgaaaaatagttccttttctttaatccagaaagttttcttgtattctccttcctgtctcaatgtctttgtacactcagttctctcttcctgctttgcctttggtctctgtccacttggtgaactattgtctgctttttcaagatgcagctgttgtgtcatctcttctggatagtccttccatactatctacacaagcaaattgttgctgctttccttgaaaacccacctcaacctctctgtacacaccacgcaagaacataccgcacttacttgttaccaggtctatctcccctccccaataggtaggaaccactatttctctgtatccctcatgaatgttttgtgtaatccctgccttatcataagcattcatcaaatgtttgttaaaagaagaatgaaaactagcatccactgagtgctttccacatattttgctatttaattatatcctattgaggtagttaatatccctattttacaagtgaagcaatctgagactcaaagcagttgtttcccaaagtcacagagctaatacatcatacaacacattccactcagttctgacctcaatttttttgtcatacactatcaaactatttttagtttctacagatttagttcctaagcagttgataattgattagcatggtcataggtgatcccagcagcctcagttccagaacacgaaatggatactataataaattgctgacaggagtataaattggttggtacaacacctccagagaaagcaatatgacaatatacactaaaagtcttaaaaatactcataccctctaacttttctttctaggaaacttaaatcctaaatatagaaaaagctttaggcacaaacatgtctgccacagctactctaaacagttactggcaaagatttaaatatttgccaggaaagtaagtgttaacgtacacatgaagagacattaaaaattatatttaggaaatacttttaagatgaaaaatattataatcttaaatgaataaggtagaatataaaacggtctataatatgagcacagtacataatctatgtgtaaaaaggaatagaaatgtactaaatattaaaaagttaccttagatgaaggaacttctacttttcttgatttttccaaaatgttttataatagaataagcacatttcactaataagaccaaagaaattaaataggtagtatttccttaaaagggtgaaatctctgggcattaaagaataagtctgtaatttcaaaacaaataatgctaaatggatgaagagaattcttattccaatctcaaacattagaatagacattaataaacaatgaaagtttgtaaaaagaattggcactttcaaaagcctagcaagatttagagttctattcatgctacctttcccgatgataagaaggggttgtttggcattcctaataacagaagccgccgtgcacacagcagaggtttctgccatgctaataggaggtgacatgcagcgttccatgtacctggaaaaaaagagccctattaattaaaagaggccaactatgatctttttattgtgaaaatttcaaatatatagaaaggtagaaaaaatagtacaataaatctccatacacccccatgtagatctaacaacttaatatcattttaccacatttgtttcatatatacacacataaacatgcatttatttttcatgaactattttaaagtaaataggcatcaagacacttcacccttaaaaatttctccatgcagctgtgaataaggaccttctcctatattcaactatcacatcattatcacatctagtaaattaacagttattccctgatatcatctaataaccagtgaaatggccaattcattaacagaaaatctgagttaatggctttgtactgtagtagcagcagtagctgtcctaacagtaaaaacataataaaatctaatatttgctatgtgccatttattctcatttaactgtcaaaacaatgaggttaggtattaacatcatctccatttcaccactgaggaaaaaaagactcagagaaagtaacttgtccaagatctccagatggcacgtggcagagacaggactgaactagtcattctgtctccaaagtccatgcttttaaacaccttaccacatttctcttttttttttttcttttctttttttttttcttttgtggagacagagtcttactctgtcacccaggcttaagtgcagcggtgcgaacttggctcactgcaacctccatctcccaagttcaagcgattctcctgcctcagcctcctgagtagctgggactacaggcacatgccaccaagcctggctaatttttgtatttttcgtagagatggggtttcactatgttggccaggttggtctcaaactcctacctcaggtgatccacccacctcggcctcccaaagtgctgagattacaggtgtaagccaccgcacccagccccactacagttccactcactgggtgttaatattttagtatcataatatgcattagtaaaagaaatattcaaactgtcacagttaagtatttctggacaccaagtcctgtgctatttcatttattctaattaatataaattatactgtataaaatttagacatattgtcaaaatatttagacatataataaaaaaggacaatctgtataaaatttagaagaaggcttacagagttaacttacctgagcttaccctcctccccttagtagtattttgattatcatgttcaggtattaggcagaataaacaagtgtcttttttatctgactctccgaaataaaaaatcactcctggctgggcacggtggctcatgcctgtaatcccagcactttgtgaggccgaggttggtggatcacaaggtcaggagttcgagaccagcctggccaacatgatggaaccctgtctctactaaaaatacaaaaattagccaagcatggtggcgggcgcctgtaatcccagctacttgggaggctgaggcaggagaatcgcttgaacccaggaggcagaggttgcagtgagctgagatagtgccactgcactccagcccgggcaacagggagagactcagtctcaaattgaaaaaaaaatcactctttggtacacagagtatacagtaagacccactgactctctgtagtcactagagaaccatttggtccacaacagcagaaacgcactaaacagtacccatgatgctttaaccctaagtacctatctctatcaggggatgatttagataccagtgaaaaatgctttttgtacttcttttcacttagtgtttatttaagaaatatgagaatatgagaaatcatagaaacctctatactggaatatttgttaaccacagagagagacagctagatgttttttatcctgagtcctaatactttttaataatcacccaacctcttggcttacattataaagattctcaaggacccatattacattaacgagggatgtatatttatggttactggaggaatattttcaacgaggagttcaggaagttctaagtatttggtttagtaattaaatccataaataactactaatatcattttaattaagaaaattaaccctttggctaggattcagtttaattactaaataatcaagttaagacaaatggaaattaacttataaactgctgggtaaattcttctaaaaaggtaggcattatgataatacatgtacattgaagaaagaattccagcataactattactcactttatagaattcacattcacctgaaggttcacaaaatctgctggtatgtcaacatagcaagcacctggacgaccatagatactgcttctcactgcctacgttcattacaagtagaagaaaagatttgtaaaatctcagtcttatcatattctactcaaagataatttaaaactggaaaatgaacacttttcatttttctggacatccttgtggagaaaaaaataattatgatgaaaatcgaaatgtcctctattgactacatttttaaagattttttgtttaaaagggagagagataagaaagtattcatttagggctttaaaattcatgttctattacactttagcttgggaaattattcacccggctctgcctgccaagtttttgcactgtaatatgtactttcatctgcttcctaatcttagtaatctggcagtgttttcagaaactgtgatgctgttacacgtatcaaatggtttctgtaactcctggttttgaaacagctaaaatgtaatttcacgtataaatgctgattataatttataatacaggttgagtatctgtaatccaaaaatccaaaatcttccaaaatgtgaaacttagtgtgtgccaagaagatgatacaggtggaaaattccatatctgacctcatgtgacagctcacagtcaaaatgcaggtgtctaaacagtttattcagcatccccaagggaaaaataatcatcagactatgtgtataaggtacatatgaaaaataaatgaatttcatatttagacttgggtcacatccccaagatgtctcattatatatatgcaaatattctaaaatctgaaaaaatctgcagtcagaaacacttctgaaaagcatttcaggtaaggaataatcaacctgtatgctgtattaattaactaacggagggtcttagagggttttggtttaatcccaattttcaaaaataatcttttgcaaaagcacaagagaaaaggtactcaagggttcattataaacctttctctttacttttgtataattaaaaaggtaattttaaaaactaaaacacaggagaaactttttccaaaaataacttattttacctctctataattaaatgtaatgacagtgaacactaaaatgtaaatagctttctaacaatgccatttttaactgcctgggtatgttcctaattgtcactcattcttttgagaataaaaataacagtaagtatgagcaactgagaaaaatcagttgacttggagagcttgttattaaatactgtaccttttcaataacaaaaggaatagcttctatgctgcttgggcgggcagagaacttggtatataatctacaagcttcaacctacatggaaaatgaaaatcacttaaaattcagctcacaatcatgttactctcctgaaagaagacaaaatgttaagtcattaatttcttttatgtttagaggcaagatggagaaaatatattgcctagactgtcccttaaaagcctattcaaagtacaaagttttgccttggtatgattcaggaagcgtatcataccaaagatgcaaaatcttttggcaaagatgcaaaagtctgataatacccaccatctaacacaacacaggaaaataggcacttctataaactgctggtgagactataaatgggaaaggaagttaaaatctacaaaaaatttaaatcagcatatctttggatccagcaatttcacagataagaatataaaacttcatctgttagattttgttataataataatctattcttacatttctgccagtgttccttttatatactttcttgctatggtgtttcgaatatatgaattcagtagtgataatttttcactgtttaatatatcttgaggcattatatagaaactgtttctcttgatgttttagtatgaaatctatgaaaagctgatagtcccacaggcatgacaaaattaagatcaccctccgattttcagtctatgttcatgccctttagttttaaggacttccacaaaaaccagatacttggattctttctcttctgtttttaaatttgatctaataaactattattttccatttcaggaaaatgcctcagatctatatatcttgaggcattatatagaaactgtttctcttgatgttttagtatgaaatctatgaaaagctgatagtcccacaggcatgacaaaattaagatcaccctccgattttcagtctatgttcatgccctttagttttaaggacttccacaaaaaccagatacttggattctttctcttctgtttttaaatttgatctaataaactattattttccatttcaggaaaaaaatatgtagtggacatttatcctgttttctttttcacgtatatagtttctgcagtaactttagatttccttttaattaacttaatctgctctacttattttccaaacacataagcatcttttaaataactgttatcgtctactattaactaaataaaacttcgattcccttctaagagtataaaaatataacttttgcattaacttatactagagttcagtattttagtttatcatatatgaaattttattttttgaagttctcagtaatgatttctgatttacaaatagactttgtctaatgattttatttatgtatttatttttgagatggagtttcactcttgtcacccagactggagtacagtggtacgatctcggctcactgtaacctctgcctcctgggttcaagtgattctcctgcctcagcctcccaagtagcgaggattacgggcacccaccaccaagcccagctaatttttgtatttttagtagagacagagtttcaccatgttggccaggctggtctcaaactcctgacctcaggtgatctacacgcttggggctcccaaagtgctgtgattacaggggtgagccaccatgcccggctgtctaatgattttaactttgtcctgtaaatgctcaaatatatttatatcttaagtgtcaatcattcactttcagctatttgtttccaacaactgttttttctaaagacacggtatcttggatgggtgtggtggctcacgcctgtaatcccagtactttgggaggccaaggtggtggatcacttgaggtcaggagttcaagaccagcctgggcaccatggcaaaacactgtctctgcaaaaagtacaaaaattatctgggcatggtggcgtgtgcctatagtcccagccacttaggaggctgaggtgggaggatggcttaagcctaggaggtaaaggctgcagtgagccaagactgcgccactgcactgcagattgggcaacacagccatatcctgtctcaaaaaagaaaaaaaaaagaaagaaagaaagacagagataagacctgaatatgttgtacagacatatgtttggtctcaaacatttgggctccagcaattctccctcctcagcctagtagctgagtagctaggaatacagttacgaaccacgtgtccagctttattcttaaaactgtagcattttgttgacatattctttcaagtttcttttaattttgacatgctttctttcctccttctaaaataaaaatatacttgtccagagtctactgataatcattttgagtaagttttttcctcttatttccctaaagtctgggaggcatagtccaaaatcatttttattcctacatcttcttgactcctttaagagcctattttcagagcttaaaatcctgtcacaaaggtgtatttcttgaaagcttgtttctaagcagggcctaagctcacccttaatatccaccctgaagttgtcttatagtagctcaagataattacctttaagttacttcaggtacttctaatttatttattttattttgcaaacaggaggcttttttatatcttctctctacctcttaatggtgtgtatgtattgtgttactaaaatcttaagagttgcaggccaagtgcggtggctcatgcttgtaatcccagcactttggaaagctgaggcaggtggatcgcttgagctcaagagttcaagaccagcctgggcaacatggtgaaacctcgtctctacaaaaaactcaaaaattagccaggcatggtggtgtgaacctgtagtcccagctgcttgggaggctgaggtgggaagattgcttgaggtcaggaggtcaagactgcagtgagctgagatggcaccactgcactgcagcctcaacaacaaagcaagatcctgtttcaaaaattaaaaataaaaaaaaccaaaatcttaaagttggatacctgaggaaactcctggaaagctcccattgtttcttggtttctttcagaggaaccaccaatcacaagcaagggcctgaaacaatcatttttttaacaagataattacaaattagatcatcatgtaaaacactaaacacagtgtctaattcacaacaaataataaatgttaaagggagagaatattatatttttttcttagaaactgtagattaaggctgggtgaggtggctcaccccttgtaatccagcactttgggaggccaaggtgggtggatcacttgaaatcaggagttcaagaccagcatggccaacatggtgaaaccccagctctacaaaaaatacaaaaattagccaggcgtgctggtgggcgcctgtaatcccagctacttgggaggctgaggtagaagaattgcttgaacctgggaagcagaggttacagtgagccgagattgtgccactgcaccccagcctgggcaacagagcaagactctgtctcaaaaaaaaagaaagaaattgtagattaaaaaatatctaagaagcaacctgatatgagagaactttccttaatatcagaaaaagacaaaatgtatagtaaatgttttccttcccttcttccccttccccttttggatgctgacgctaagcttccaggtatattgacataaaataaatttttatgcctttcttattcttgggataaggggaagaaaaattttacactttcctaagtgaatctatttagaaattgcaaaataagtgacattcctcagcaatgaaattcttatccttcaatgtggaaaaaaaaaagatatgggaaaccttaaggtacttaaaaaatataacaccttaaagtagataaagaagagaaagatcaaaaggaaagtaaagaagaaactataagaaacacagggcaagaaagaaaacaatgtcctttccactagaaagattaaatatgttccaaattgattagaacctaacccccctcaacctgatctcactggtaaagtgccagagacggagttaagggcaagatcagagaataagtactaaatagtttatatataaagcaaactaaatgaatataagaatttcaaatatcttcctacctatgcaaaacaaggtgaaaaattagccacattttacacactgagcttggatctttaaaaaaataattcttcacttaaagtaaatagaactacacatacgttcacacatacacacacatattaggaactctaaaatgttaaaagtgtttatggcagctgggtgcggtggctcatgcctgtaatcccagcactttgggaagccaaggcaggtggatcacctgaggtcaggagtttgagaccagcctggccagcatggtgaaacctcttctctactaaaaatacaaaaattagccgggcgtggtggcaggggcctgtaatcccagctacttgggaggctgacgcaggagaatcacttgaacctgggaggcagaggttgtggtgtgccaagattgcaccactgcactccagcctgggcgacagagagactccgtctcaaaaaaagaaagtgtttatctctaagtaactaaattactggtgctttgaattttcttcctaatactcttttttaagttatatctatttaaggtataccatatgatattttgatgtacatatagtgaaatgattactacagtcaagcaaattaacatattcatgttactttttttcctaagatattgtagaaatagtcactttttttggtaaaagtacctaaaatttactctctttgcaaatttacaatacacaatattattaactatggctttcatgttgtacattagatctccaggctttatcgtacttgactgaaactttgtaccctttgacctatctccctattccccctcctcctcctcattccctccccggtaactaactctactttcagtttctaagaattgaaggggttttttttttccaagtctttctaccctagatcagcattagctctactcagtaaaatcctgcagtgacctttttaagaaaatgttttcagtaataataatgtcattaccagcagttcatgtttgcatttgccataccgcccaaggcatggatgagacctgggccagaaacaacaaggcagactcctggcctaaaagcaaaacagaatttattaaaatcaggtcaaatgtaacaactgattcataacactttagtgtgaaacatggcaatcttggacttcaaaggaaggacatacaagtctttactataactgataaaacaattattagaatatttttaattaaaaaacaaggcgatatatatatatcgcgatatatatacatacacacatatacgtatatagtgtatacactatatatgtatatagtgtatatatacgtatatacgtgtatatatacacacactatatacatagtgtatatatatacacactatatacctatagtatatactatatacgtatatatacacacactacatacgtatatatacacacactatatacgtatatatacgtatatacgtatacgtatatatacacacactatatacgtatatatacacactatatacgtatacatacgtgtatatatgtatacatacgtatatacgtatacatgcatgtatatatgtatacatacgtatatatgtatacatgcgtgtatatatgtatacatacgtatatacgtatacatacgtgtatatatggatccatatatacgtatacatacgtgtatatgtatacatacgtatatatatgtatacatatatgtatatatactctgggcaccagagtatactctatatatatgtatacatacagacacacgtatacacacacgtgtatacatgtagacacacgtatacacacacgtatgcatgtagacacacgtatacatacacacacgtatacatacacacacgtatacatacacttgtatacatatacacttgtatatacacttgtatacatatacacatgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcatatgtacatatatactctgggcaagagtgagatgctatctcaaaaaaagtgtatatatacacacacatatacatatatgtgtgtgtatatatacacacacatacgtatatatgtatatatacacacatacacacatacgtatatatgtgtgtatatatacacacatatatatgtgcgtgtgtgtatatatatacacactttttttttgagatagcatctcactctgttgctcaggctggagtgcagtggcatgatcagggctcactgcagcctcaacctcctaagctcaggtgatcttcccaccacagcctcccaagtaaccgggactacaggcagatgccaccacacccggctaattttttgtatttttttttggtagagatggggtttcaccatgttgcccaggctggtcttgaactcctgggctcaagcaatctgcctgccttggcctcccaaagtgctgggattacaggcataagccagcatgcctggcccaaaaaaagaaagatatcggatttcttgtgagaaataaggtacctatcattttcacaccttatgtctctaaccacttattttgatctggactacatctggactaaatcaagttaatggtatacagaagcaaatttttgactgctgagttcatttttgtatgaaaaaaggtttttttttcatttcttaacaaataaatataacgtcgactgatctttgataggaaagtaattctgaatgcagtgctctgcccaaaatgttttgtgtttttttttttgtcttttttttttttttttttgagacgaagtctcgttcttgttccccaggctgcagtgcaatggtgtgatctcggctcactgcaacctccgcctcccggattcaagtgattctcctgcctcagcctcccaagtagctgggattacaggcatgtgccaccacacccggctaatttttgtatttttagtagagacggggtttcaccatgtttggccaggcttgtctccaactcctggcctcaggtgatccacccgcctcggcctcccaaagtgctgggattacaggcatgagccaccgcgcctggtccccaaaatcttttaaaactgaatttgaggctgagcacggtggctgacgtctgtaatcccagcatcttgagaggctgaggcagatggatcacttgagtctaggagttcaagaccagcctgggcaacatgatgaaaccctgtctctaaaaaatataaaaactagctgagtatggtggtgcacacctgtagtgccagctacttgggaggctgaggcaggagaatcgctggaacctgggaggtggagtttgcagtgagccgagatggtgccactgcactccagcatggagacgacagagtgagactccaaataaataaatattgaacttgaatgttttacccttcagtgtgactttctaagcttaaaccactcgggaaaaaggtatctcaatataattcagttcaccattttacacttataaaataatttcttaaaaatttctgtttaagacagacttgaaaataagtaattaccaccaagtaaactaaacttctagaacagtactatccaacagaactttgtatagtaatagaaatgttctgcatttgcagtatgatacggtagccactactgacatggttactgagcacttgaaatgtggctactacaaactgataaactatgatttaaatgttatttaattttaattaatttaaatgtaaacaagtcatacggctcgtggctactatacttgccagtgcagctccagaagttcattcaaacagcaaaaatgttttaaatatgaacttttcggccgggcatggtggctcacgcctgtaatcccagccctttgggaggccaaggccagcagatcatgaggtcaagagacagagaccatcctggccaacatagtgaaaccccatctctactaaaatacaaaaattagctgggtgtggtggtgcatgcctgtaatcccagctactggggaagctgaggcatgaggatcgcttgaacccaggaggcagaggttccactgagccgagattgcaccactgcactgtccagcccagataacagtgcaagactccatctcaaaaaaaaaaaagtatgaacttttaaccattctcttaatcattgttctagcattttttacattaaggcattaattaataactataatttaaatgctttccaagctaaatgaaaagattaaaatatttgtcatatgtaaataaagcggcagaaaacagtgacaatagtgttacttgatggcctatttttttcaggttcaaattcacaagttccttatcacagaaaaaaaactattctggtgaggtctagactttgagaatcttattagtttgcatttcttagcaactgaattactagtttcatttttggaaataaaaaaatgtattaaaactaacatatgtgaaaaaagtatgatacacattcctgtgagagtccaaattctgcttaaaaaatacatagataagggaaaaaactggaagaaaatgaccaattcttaacagttctgagatcataggtgattttcttcatcttttttcctttttttttttttttttttttttgagacggagtctcactctatcacccaggctggagtgcagtggcgcaatctcagctcactgcaacctccgcctcctgggttcaagccgattctcctgcctcagcctcccgagtagctgggattacagacgcatgccaccacaccagggtgatttttgtatttttagtagagatggtgtttcaccatgttggccaagctggtctcaaactcctgacctcaggtgatccacctgcctcagcctcccaaagtgctgggattacaggcgtgacccaccgtgcctagtcgattttcattttcttctttgtgctttctatattttccaagttttccaaaatggacattttaaaaatgtattaatttttaataataaaaagggggtggtagttaggtaacatggatacacactaaaaaatcagaacgtgtggaacagctctcaacagtcacattttgaaccaagcatttttgtattaagtgtgctggggtagttgtgagatccaagacaaggtatcatacatcaactcactatctgatcaccagtgattcactctacaaaatggcaatgtgttccactctgaaacacttctggtatcattattcttttgatgtggtcctcagagagttttaaatgttttttatcctttgttatttaatatatttttctataatctttccaaatgaactcatccttcagctgaaagacgtaatagttctaccccaaaatattaaagtaattgaagtgaaacaaattttagtttacctgcttgtcagatatccaatcgcggaggcagcataacaagcctacgagaaaacaacactgggacttgagcatattgggatccttatagtacatttatgacagcaacttactattaaataatagacaagaacatagtggtaaaggcagaattaaaatatttccaaccttagtaataaatgttctacacataaatttcaaataatggttatctaaattttagtttttcaggaaatttgttcatatgtatgttattcaaaacatcctcttacaattgcttaaatatctgcaggatcaataggaatgtcctcttttattaacaatattggtaatttgttttctttcttttattcttcatcagtctcatgaggggtttatcaaatttatccatcttttcaaagaacaaatttttttagttcttcgaaaatttttgttggtttttctctattgtttgttttctatttcattgatttctgttcttgtatttattatttcagtcattttgaatttgatttgcttttctttttctagcttcttaaaatacaaatttagaacactggtttttaattttctttactaataatttgtttaaaatgattccaagaactgctttagttataggttacaagtttgagttgcatcttttcattatcattctattcaaaatattttctactttccattgtgatttcttcttcaacccattggttaattaggatctgtagtgatacctcctttttcattcctgacattggtaatctgttttctcttttattctcaatcagtctatcttgaagtttattcattttgttaatcttttcaaatatttacaaaataccaaaaagtatgttgcttaatttccaaaggtctgagattctttttagtgatctcttattgagttccactttacttccacatggtcaggtgacatatactgcacgctttcaatccttggcgatttattgagatttcctttatggcctgcatatggatagtttttaccttgtaactctacttcagctcataatcaggaagagagggggcactaaattaaatgcacacaagataacctgggaaaatgctgagtgctctctcaaattcttcttagtctgggacatcatttttttcccagtattatttcttctcatttctttagaaataataatgaattgcgtatttcctagccttcattcagctttaaatgaagtagtatactgtcttaaagaactccacattaacgacataaatgtggaaaaaaaaaaaaaggaaatgtttatggatcataatcttaactggctctactatcatacacccactgagaacctgcacaaagactctgctcttttcctgtgtcgctattctctactggccccatctctctttccttttgcacataaggccaaattcacattaggagaataagacaactcctaagaaatgcaggcatgtaaatacctgctgcaataagaacactttatttagacacccaaaagaattgcccacttatgatagctaggtaagaaatgttgctaggcaatgcaaaatatacaacaacacgtaacaaaaagtatattcctctggtaggaaatgtcaaaagttgagaggtaactgttttgttttgttttattttgttttgttttgttttttttttttgagacagagtttcggagtttcgctcttgttgcccaggctggagtgcaatgatgcaatattggctcacggcaacctccacctcccaggttcaagcaattctcctgcctcagcttcccgagcagctggcattacaaacatgcaccaccacgcctggctaattttatatttttagaaacggggtttctccatgttggtcaggctggtctcaaactcctgacctcaggtgatctgcctgcctcagcctcccaaagtgctgggattacaggcgtgagccaccgcgcctggccataactggttttatgaccataaaagatctgttcctctactaaactacctccattcacaggcagaacagtgtacatggtacttagagagtggactctcgagccaatctgttttgatttaaatcccagcttccccactttctactgtgtaattttggcaagttgctctaaatctctgtttcttcatctataaaatgaaaataattcaaagcactgctgtgaggatgaaatcagttcgtatgtgtaaaacactcaaaatagtgcccacacacagtaagctctcaagaacaatgaacttgctgacaatctgcctacttgctggccaattggtcagtatgtcttgattactctatggatctaatcaaagacaatgaagtcacacccaactacatctttctctttatcacaaacatgtcctgaatgccttagcctgttttcatgttccctctgaatcattctgtcactacccttagttcaggtaccatttaagtcttcctttgactaccatagagtcaggatgcttgagggacatatgcactgggatgttccaccaacatctcaaatgcatgtgttcaaaattgaacatcacctttctcctccaagctggctcttccctctatattcccagtctcagtcacagacaatatgatctacacaatcaatcaagtaagcccaaaatctaggaatcatctccagaggagcctgcctcctctttcctaactggttaatgcctgcttatccttcaggacagctcagacatcatctcctgtgggaagctgagcctgggtactccttctctgggctttatagcaccctggatatctctctatcacagcacttaccaccttataatacaattgtctgtgtctgtctccacagcttggctgtaagccccttaaagccaggaactatcattcatctctgtatccagcacccaacacagcacatgggacctaaagaaccctcaactaagcttataggggctgaaataaaacttagagacagaggtcgtgctatgttgcccaggcagcctctaattcctggacttgagtaatcctcctgcctcagcccccttcgtagctgggattactggcatgtacaaccatgcctcgcatcatctttctgaagtacaaatctaattacatcgcccacctgtttagaaaaacctttagtctcccccattgcctactgttaaaaaaaaaaaaaaattcaaactctttttagatttcccacaacctcccctcaacctacctaccagtctcacagctcaccatgcctttacctaccttgagggaaccacatgaactaacattacctctacaggcaatcttctctgtcctcaaagagaaccagtcaccccttctgtgctactacatctattgtgagagttataatagatgagtctttttctgtaagtcttaccctcaccttccaggactgatcaacgtgaagatcaagactaaacctcactccttctttacatccctctctcctacaggttatgtagcacaatccttagtatacagtacttagtcaataaatgtttgctgtatgaagaaatcagtggcagatatgtcatctctacaaaaacagttaagtataggttccattcataggtcaatagcttcattttttcacacagatgaaagaacagaatgttgttctaacaaagacaagtaaaatgtagaagcaacagaaactcaaaacctcctagttttaagattaaaaaatacaaatctcaaaccttgtagataaagaatgtcattcaataaagaatgtcattcaataaagaatgtcattcaattaataaataatgtataatattaagcatctacaccacgtgaaagcacaaaccaagccaggcactgtggtgatataacaaatgaatcacaacttctgccctccaggcactcatgtatgatggcaaaaggcaccacttagggtggccaggcagttgtttgggcaagaggaggcaagaatttaaattagaaggcaacggtgggagtgtaaagcaggaatatttagcctcagctggactgagagtatgtgatatcacagaagtggattcttgacctttcaagcccgcactactgagagaagagcaaggtggattggcagaggatgcacttaaagtggattgacaaaacgtcgtatcttccttatcctgcttccaaataagcctctaagaaaggtggcagcatgatgtggtggaaaaagcatcaggctaggatctgagccatctgagtttccatcaaggcactaccatttgtgatatcctccaccctgccccgaaccaatcatacaacaaagccttggccttcactcatttatcccacaggtaatctctgaacacctttcttatgcaggcaccacactaagcactgggggtacagatgtgtcgtgaagaaataatatccctgctctaatggagcttgtagcctaatagggaagtcagactttactcataaactgtccattccaatcatgacatacagtatagtagtaagagaatggactcagacccagaatacgtgggttcaaaccctggctctgctactaccagctgtgtcaccaaaggcaagttttacttaacctgtgtcttttctcatctgtcaacttggtgtaacaacagttaatattcaacagtgattgatatgatatatgtaaagtagcagaagagtggtaagcgctatctgggtgtttgcaatgcatacctaccgctattactgatcattcccagtaacgcattcagccacctgagtccatactcaccgcttgctcattcctcatcccgatgtacttgatgcctagctgctgggcagcaatggcgatttcggtcactgggatgcctacgatgccaaatatgtactccacatcctgaggaacgaagaacaggggagtaaactcccaaggccccaccatatcgccacatccttccctccctcccgggcgctaaaaggaaaaccccccgacccccatcgcccatttctactcgtctccaagacaacatcgcggtccccgccagcttccgtaggagcctttcattccaggaaggtccatcgtacttgcgttttcagggcctgagcgatgactttagcaccagacacctgctcctcgctgcgctctgcgaagttactgtccggcatcttccaccgaaaagctctaagcactcacgcagccggcaaacaagcggaatcatccagcaaggcaaacgcgaaatcggcagcacgccacctctggtactgcacctctgacggacaggagggcaaccaactgccttaaacaacgggaaggaagaggcggtct

SEQ ID NO: 1604 - DNA, 1859 bp, Homo sapiens
tctggaggaaaatgtctgtattaaaagccaaaaaaccacataagtacaagaagaaacgcccaccaggccacgtcactggatagatcaacttggaaaaggttcataaagttcattttcagcggtaacaatatatcggtgttaaatccttcccatgccctccccccaattttaaataaattaaaaaaccacaaatttcaaatacaactatgttcagatacaaagagcttctcttactacagcaatagcaatttaatctttttgttttgtattttttttactaaaactttcatttaaaacagttattaaatatataaaacaaatacacaggatttggtcattttctgccatgaatctagggcacgtgggtgcggggaaggagtcgggcagggggatgcaatagaggggaaagggccccatttccctcctctccgtcttcggagctgcgatcccaccctcagtccaagggcttaaacatctgcttttcggaactggaagcgcagcacaaaccttgcttttcaaaggcgctggggtctctcggcggccccatctcgggaagaggaactaacgataactacagcacgaagcacaccggccgagtctccggcgggaaaggcacccgcgcgcgcggacacaggacggacacagggaggagcggagcgggtcacttggtcgccacccccgaagtgacggccgcggcggcggcggcagcggcggcggcggcggcggctgcggtggtccctgcgggcactgcggcgggggtggctgcggtggtgctggcggtggtccggcgctgttccatgccgttgggcaggaagccggcgatgatgggcaccggccagatgagggcggccacgctccacaccacgatgaccagggtcatgaagcaggccaccagcgtggactcaatgggcttacggttcagccgccagcccggctcgccctgcagctcctccaggctgaagtctaggcagcagaaatgcagcggctcgccctgcagccacagcggcccgggcggctcggccgcggggtaggctggcagcgcggtgggcgccccggcggtggcggcggcggcgctgggggcggcggcgggccggaggcggccggtgcggcgaccgcgcacccagccgcagcccacgcagaggcgcaggtcctgctgcgcgccgcccgccgccagccccaggtgctcgatgagcagcggcggcccgacgcggtggaaggcggcggcgaagaaagcgcggccgtgcgcgttggtggagaagagcagtaggtcgcactggaagccccgcgggcggccccagcgcacgagcagcgagctcagcatctgccgctgcacgctgatgttgcacaggcgccgccgccgccgccgcctcctccgggcccgggcgctcggggggcccgggggccgccgaggccagcagccgcggggcgatgggctcgccgcggaggacgcgttgactgaagcattggagggcaccccgaggaggccgggcgcgtccgcggccccgccgcggacgggcggcagcgggcaggcggcggccaggagcgcggcgagcaggggcagcatggcctgcggcgggcgcctacgcgcgcgaggccggcggcggttgcatggcgagcgggcgacgggccggcgagctcacggtgggaccgcgggagccggcggccgggcgcagtgcgggcgcgccgggcgcctgccaagcccgcaggggcggcgcggaggcggtgacggcggctggctcggcgcggggatccctccagacccggttgcgtttggggttccccgccgcccccggcgccggggcccttgggctgccgcgctgctctgcggggccgggtgctatcccagagcaggattcccc

SEQ ID NO: 1605 - DNA, 49332 bp, Homo sapiens
ttaatgaaaatgacaatttccctgttgagatcacgtgaacataaacagtgaaacaaagcccttgggggggggtaaatggatgcagagcaggcttctaaggtgcagtccccctccttcgtgtgggtgagtgatgtcacttgcaggacaggctgtttgggttcccccagtcctaggtcttctttccccagttgtctttcctttgtagctgtccttaggtttagtgttggggtcacaatttggaattcaacagagagcttctgaaggtaatgggacagaaagggaggacaggaaaggagggaggaaacattagtcttcttcatcctcactgatatcataggctgcagccttgtgcctggagagatttgctggggagcaaggtggggaagtcttgccggagaagggccatcggaaagagggggagggggagcgctcgcgagtagggctgctgctggggctctgcttcgggctgatggcctgcagcatccggcccttcccctctttcagcatatgtttctgcagaaaccgaaaggaagagtcagaaaaacaccgtggatcctacttaatcatcactgaagcatctaggactgggatagtctatgctgtactatttatttaagggttctcccctgctgtcatcacccgggaaattccccattcttcctcaataatctagtctaggattattctaatttatccaaacaccttcacagacagatccttcctgatatctaacctaggactcacttgctcaatcttttatttggttgaaaagactgctactcctcaaagacagaattcccaccttacctggggttcctgctgcagctacttgtagtggaggctgctttctttttattgttctttattctttcctttccttctatctaaaatcataccacagataaaagctgggcaaggcgacttgcttatcttgtcaccagactttaaggttgagagagagctggcaaaattatctaggagaatgtgtaacgtctttctgtaaaggtttcaaaaaccttgctggggacagttgaaagatagttctgcccagataaggggatagactagataacttctcagtgtcgatgccccttcctgctcaatgattctgtcattctttccacaacatggaactccctacattgtccagtgggaaagaacataccagtgctccttccggaccaaacatttccagaaaacttccaatgaattctcgggacttctcctcccacttctgaatgaggtcaatgcttttttcctccaccttctgaacaaattcttttgacttttcctccacatctttcactttcttctttactttgtcaaccctctcctgcaagtggtatttcttctcctagataaagaaataactcttctgagaaataatgctcatcctaaacttctctaccataagagaacgaaaaaacatggctcaagcactcaattgacactgttttcagtctagaattttgctttgctttaatctaccccactctcagcataataacagataagatatgctgtggatgcacacacaagaagtggtaattctaatattgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatactgccaagaataaactaattacaatagattgaaagagaaaatactagatcttttacttaattaatctgcttattgtactggatttttcccctctatcactggcttattctattattttaaatgaattgtgttttttgctttttgttcctttagtattttaaggtccatttactcatttgcaaaatgatgatactcgttggtcttaccaactttgctaaagataaggaaaatggtataaaccctccggtggaagggaagggagtatttagtcaaatgagaagtatccttggccaggcacagtggctcatgcctgtaataccagcactttgggaagccgaagtgggaggactgcttgaggccaggaactcgagagcagcctggacaacatagcaagacctcatctctactaaaaataaaaatataaaaaataagctgggtatggtggcctgtgcctgtagtcccagctactcaggaggctgagatgggaggagcacttgagcccggaggtcaaggctgcagtaagccaagattgcgccactgtactctggcctggatgactgagtgtgactctatctcaaaaaaagaaaaagaaaagtactctcaaaatttccagatcataaagagaaaagggattatgtttagaatttttaaacacctgatttttatgggaaaaataaagctatagtaagtaaattaacaagagctagggtttatctgcctagataaatcatatttagatgtaatcattttatccattcttatagcacaatttacagagatgggagtaggtcagggagcatggtaaactggttatgtagaagacattaaagttagcagctttcttctttttaaatcgattttattgaggtctaatttacatacaaaatgtatagtgttggctggatacggtggctcatgcctgtaatcccagcactttgcgaggccaagggggtccgatcgcttgaggccaggagtttgagaccagcctggcaaacatggcaaaaccccatctctgctaaaaaaaaaaaaaaaaaaaaaaaaaaaaaaaattagccaggcctggtggcacatgcctgtaatcacagctattcaggaggctaaggcaccaggagacagaggctgcagtgagccgagatcacgccactgcactccagcctcggtgacagagcgagaccctgtctcaaaaagaaagaaacactacatatatatatatttgcatgaatttttttagtttttttgtttgtctgtttgtttagagatggggtctcgctatgttgcccccagactggtctcaaactcctggcctcaagcagtcctcccgcctcagcctcccaaagtacaggcatgaactaccatgcccagaaaaatatatagagtttctaaaaggcaatattaagctaagataaacttaactttcgtcaatccaaatttaaaactcaggtctgtgtgggaagtggtgtgtcgggtgtcactatccacacgaggagggctcatagcctttcgcaggttcccaagacatcatccaaccgaagaagagagaggaagtttaagagacaccgttttccatttattgacagaaatactgcactatataaattactcatttatttagttggctgtatggctttatacgaatgtgttggtaccagaccgtaacggcagaaactgtctgtttcattctttttgtgaacagttaacatagtggtaattcattcactgaacttttgggagtgatcatcaaagccaactgcaaagccagttcagctgagatggagtgggaggtgatatgtctcctacagagtcagggaactctggggtaaggctggaactcacgttgataaagctgacattgagctcctttgctgtgtagcccctctgcaggttccgcctcgcatacacatcataatcccgcacaattcgggtgatgatgtctgatgtggagataccttctgtcctctgtgttggagcaaacatgcctaactcagaaacacatacagacaaacactgtgaggttctggttagctcaggtattaagactaaatggaaattgggggcaacattcctttcctttcctcaaaaagcagaatctgttattactaaatgaaactgaaagatactgatatacagaaggtagaccgaatcaaaggccagaggtaaggcaaagaagagttacatagccctaatattaagaaaaatatgagaaagggtttcctgaaattaagagagatatccaaagtagatgtttagaccaagaattgatggatgtcatgaactgacgacaaagaattgatgggtgctatgctcatctttaccttttatccaaaatgtggcctgaaagaggatgttgaatttctaatgtacacattttcctctgtaaagcagcaacatggctgaacatctgcagctgccctgagatcccctacagtgaggaagcacagctcactcacctgcctccttgatgtgcttataaacatcatcactgccagcagatgaataaggaatatcatcatgggctacaaaatcaatctgaaaataaggaaacatcattaaaacccatgataactgccattcagaaagacccagtcaatgttctcaggcccagaaaaaggacaataggcagaggccaggcctcagtggacttcatatctctctttgctttgctcataaattctacaatctattcacaaaccacccaacctaatgatttatggagtatacatatgaagttagccagctgcttttgtagctatttctcctagtctgctagaactgttaccctcactctgtataccagtcatcttgctgtggtcaatagggccagagggtttgctggtgaaccggttagtgggtggagcctaggaaagaaggaaatctccctgtcctgggtctggaaggatttggtcaaataagggtttctaaaagtatgagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaattagccaggcatggtggcgggcgcttgtagtcccagctacttgggaggctgaggcaggagaattgcttgaacccaggaggcagaggctacagtgagccaaaatcgcaccactgcactccagcctgggtgacaaagcaagactctgtctcaaaaaaaaaaaaagtatgagaaagaggttacttctttcttaactagtttctctcagtccgtgagaaaagagggaatataaaaatagcaaccacgagccctctgactggaatagatacatctattggcctgagaaatacaaaccgaaggccataagagaagttttctccctctcccctctcccttctcccctctcccctctccctctccccacggtctccctctccctctctttctatggtctccctctgatgccgagcggaagctggactgtactgccgccatctctgctcactgcaacctccctgcctgattctcctgcctcagcctgcccagtgcctgccattgcaggcgcacgccgccacgcctgactggttttcgtatttttttggtggagacagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaagttttatcctcaggatctatcatttcactacttttttttttttttttgagaccgagtctcgctctgtcgcccaggctggagtgtagtggcacagtctcggctcactgaaacctctgcctcctggattcaagcgattctcctgcctcagcctcccgagtagctgggactacaggcgcatgtcaccccgcctggttaatctttgcatttttagtagacagggtttcaccgtgttggccaggctggtcacgaactcctgacctcaagtgatccacctgacttggcctcccaaagtgctgggattacaggcgtgagccacagcgcctggccattttactgctatgaatatcctttgcaagggcaagaagagatgaatgatactggggatcaataatgttgttcggaggcgtgctaaacttcacttactccttcctgtatgggccaccagccttttgctgataattactaagatcactataccatccccgagagaccactgtagtgtgaagcatgttcattgggactatgtcagagactctcagccagcatctcaattactcatgaacaacttgtcagggatccataggcagcaaagtaaagaataggaggccgggtggatcacctgaggtcaggagttcaagaccagcctggccaaaacggcgaaacactgcctctactaaaaatacaagaaattagccgggcatggtggcgcgcacctgtaatcccagctactcgggaggctgaggcaggcgaatcacttgaacccgggaggcggaggttgcggtgatccgagatcacgccattgcactccagcctgggcaacagagcaaaactctgtctcaaaaaaaaaaaaaaaaagaatgggacaagcaaaactcaaggttgagtatatattgttaacaaagagaaaaggggagttagaaattcctctaacttcatacttctgtctgggcctgtgggctgtggtgctgagaataaacttgcttaccacctttggtgccactggctgctaggtgttgatgtagaaaagccagagaattataaaaggtctgtcctaatcctcaatagttttaataaatatcccctcttcaggcctacccacgtattgctttagaagcactttggctgccttcattctttctgcctcactgaacaatttacctacaacattccacgcgcccctgtagagaactgacaacatgcttgctatttcctcaggcttgggggcctctaacctggcctaatcaatccttctcatcttttgtacccaccttttgcaggaaacctgtggcttttttttttttaaagtagagacagggtctcggtatgttgcccaggctggtcttgagctcctgggctcaagcgatcctcccaccttggcctcccaaagtgcttggattacaggcgtgagccactgcacctggctgaaatctgttactttaatgtgggagaattaaaaggaggtaaggggttgataataacttactgagaaacagtgagaaatatccttgatttctgattccacccaatttctagcataagatcaaagccctgaaatgaaacttaagccaagaaaagtctatgttaatccgtcttatttcctggtaatgtgaccgtcttcagagttcacctggggctatggatattctcaggagactggcatgttctaagggtagatgtgcctatggtgtggggggaaggtctcgtaactggtgagttcagttcccagccctgccagtggtgtaacttgtggcgagttcagttcccagccctgccagtggtgtaatttgtggcgagttcagttcccagccctgccagtggtgtaacttgtggcgagttcagttcccagccctgccagtggtgtaacttgtggcgagttcagttcccagccctgccagtggtgtaacttgtggcgagttcagttcccagccctgccaatggtgtaacttggagcaggttatttggtttctctagcccttgttactcatatgtaaagcggaaatgacaaacacaccacaggattgctgtgggcagaaaatggaatagaatggatgtaaaagtgcttgcaaaccatccagccccatataaacgtcaggggtgactgttatcactagtaatatcactgtcatctcctacgaaacttacataagaggtagaagtaaaacacggctagtggaaaaccagcctacgtgccagcagctttgagagttgaggggattctgaaacaaggaatgggaatatgtgtccagtttcttacccggtgttcggccaggaactcgggtgtcagcgtccagggcgcattcctcaccacctcatccacgtagcggcagtgctggactgcgtcatagcgctcattctcgttcatcaccgtgaagcctttgaagttgtgtgtgagctcatcactgcaaactggttcaccacatcataaattgtgtgttggagtcctctttgcttagcacctcctcagccaccgacctctcccatcttctcccactgcttaggactgcaaccatcttccccaactggaaaaaagtcttctaaaggtggttgaacctgggtgataacgcttttcctaatgcagcgtataccttcaggagcaacactcactaaacagtatgttcatactttggagaagggacagtacaacaggtgaccaagatctttgactctgaaataaacctgctgtgcgtgtctgcatcaattaagtccttaaacatgttttcctgttttattcacactggactggaccacctaacatttccttggcagacttttgtactccagttaattcaaaatgataaactgaaatctaaagcaaatgttttaaagtggacaacggaagtcacggctgctcctgtgaccacagaaactcagctacaagcagtgaataaatgccagatggcacagtcgaggagcttgaagctcctctctccaggtttagtttgctggtacccatatacttcatgtgtgttagagaggctgtactacatccttcatttaaaaatggaaacaagagccagtgtactcagctgagaaagacagactgtactatcatctttttctgcacagcacctgaagtcaccaaatgttttcttacctcccacaatgaggtacgtattagggaaaaggttcttcgcttgcatcagagctcgggcgtgaccagagtgaaataagtcaaatattccatcggcataaactctcacaggtcgctcacctaaatccaaatgaaagaattgatcacaaaaatacctttttttttgtcatttttatttttatttttgaggccgagtctcactctgtcacccaggctggagtgcagtggcgtgatctcggctcactgcaacttccgcctcctgggttcaagtgattctcctgcctcagcctcccaagcagctgggattacaggtgcatgtcatcacgcctgcctaatttttgtgtttttagtagagatggggtttttccttgttggccaggctggtctcgaattcctggtctcaaatgacccgccagcctcagcctcccaaagtgctgggattacaggtgtgaaccaccatgccaagccacaaaaatacattgattcgatatcttgtacttggcaaatggaactggctctgtgtgacagttccatgactgtatactcctttctttttttttatttttttcttgagacggaatctcgctccatcacccagactggagtgcagtggcacgatctcggctcactacaacctgcaactcccggattcaagcgactctcctgcctccgcctcctgagtagctggaactacaggcgcccaccaccaagcccagctaattttttgtattattttttagtagagatggggtttcacagtgttagacaggatggtctcgatctcctgacctcgtgatccacccgcctaagcctcccaaagtgctgggattacaggtgtgagcaaccgcgcccggcccaactgcatactcctttctttaggtgttctctgggtattcaccctgattttaggggtaggttgggttatgaaaaatgactataaagaccttttcattttttttttgagacagggtctcactctgtcatccagcctggagtgcactgatgtggtcacagctcacggcagccttgacctcctgggctcaagtgatcctcccatctcagcctcccaagtagatgggaccacagatggacaccaccatgcccagctaattttttttttttttttttgtagagaccatgttgcccaggctggtctcgaactcctggactcaagcaatcccaccttggcctcccaaaatgctgggattccaggtgtgagccaccatgctcagcctataaagagatttttgacatcatcatctgcactaactgcctctgttagcctggttgtaccaaacttttcaggcacaacaaataacagagaactgtcaacttagaagccaggaaatgatttcccggggaacaagactaattccaaagtgaaataaacattaaaaacagaatcagcataatggtccatcatgctttaaataataaatctaaggagtccatgtaacttattccctttctgtgaataaaggaagagctattttactgcagcagaaactgacaggagcatttacatcatttgggaaagataggtcaaagtgtcatcagatacactatgctgaggttgaggatcagatacaccatgccgaggctgaggaccagatacactatgctgaggctgaggaccagatacactatgctgaggctgaggaccagatacactatgctgaggctgaggaccagatacactatgctgaggctgaggaccagatacactatactgaggctgaggaccagatacaccatgctgaggttgagtaccacatacactatgctgaggatcaggtacaccatgccgaggctgaggaccagatacaccatgccgaggctgaggaccagatacaccatgccgaggctgaggaccagatacaccatgccgaggctgaggaccaggtacaccatgccgaggctgaggaccaggtacaccatgccgaggctgaggaccaggtacaccatgccgaggctgaggaccaggtacaccatgccgaggcagaggaccaggtacaccatgccgaggctgaggaccaggtacaccatgccgaggctgaggaccagatacaccatgccgaggcgaggaccagatacactatgctgaggctgaggatcagatacactatgctgaggatcagatacactatgctgaggctgaggatcagatacactatgctgaggctgaggaccagatacactatgctgaggctgaggatcagatacactatgctgaggatcagatacactatgctgaggctgaggatcagatacactatgctgaggctgaggaccagatacactatgctgaggaccagatacactatgctgaggctgaggatcagatacactatgctgaggttgaggaccagatacactatgctgaggctgaggatcagatacactatgctgaggaccagatacactatgctgaggctgaggatcagatacactatgttgaggttgaggatcagatacaccatgctgaggttgaggatcagatacactatgctgaggctgaggatcagatacactatgctgaggctgaggatcagatatattatgccgaggttgaggaccagatacactatgctgaggatcagatacactatgctgaggttgaggaccagatacactatgctgaggatcagatacaccatgctgaggttgaggatcagatacactatgctgaggctgaggaccagatacaccatgctgaggctgaggaccagatacactatgctgaggatcagatacactatgctgaggttgaggaccagataccctatgctgaggctgaggaccagatacaccatgctgaggctgaggaccagatacaccatgctgaggctgaggaccagatacaccatgctgaggctgaggaccagatacaccatgctgaggctgaggatcagatacaccatgctgaggctgaggaccagatacaccatgctgaggctgaggatcacatacaccatgctgaggctgaggaccagatacaccatgctgaggctgaggaccagatacaccatgctgaggctgaggaccagatacaccatgctgaggttgaggaccagatacaccatgctgaggttgaggatcagatacactatgctgaggctgaggaccagatacactatgctgaggctgaggatcagatacaccatgctgaggttgaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgcagtactgtttataatagcaacagtcaggaaacgacctacatttcaacggaagattgaatatagcataatacacccactaaaaggtgggaggatatataaacaatttacttagatattcacagaaatgggtaatattggtggcctgttatagggataccaggtggctgtgagacaggtcttgagagggagacattttactttatgccctttttgtattttatggatattaaactgtgggaatgtattgatttcacttgatttgattttttgagacagggtctggctctgtcaccctggctggagtgcagtggcatggtctcagatcactgaaacctccacctcccaggctcaaatgatcctcccgcctcagcctcccgagaagctgggactacagcgcacaccaccacgccccgctgactacagcgcaccccgccacgccccgcagactacagcgcaccccgccacgccccactggctacagtgcacaccgccacgccccactggctacagcgcacaccactacgctcagctgatttttgtattttttgtacagatggggtttcacatgttgcccaagctagttgtatttttatttatttatttatttgagatggagtcttgctctgttgcccaggctggagtgtggtgacatgatctaggctcactgcaacctctgcctcctgggttcaagtgactatcctgcctcagcctcccaagtcactgggattacaggcgaaagccaccaagccgggataatttttgtatttttatattcgtatcccatgttggccaggctggtctcaatttcctgacctcaagtgatctgcccgccttggcctcccgaagttctgggattacgggcgtgagccaccatgcccagcccaggctggttgtattgattttataatacaggaaataaaaattttaaattaaatataccaatccaatgaaaaactaagaattaattaatggatttaagagtcagaaaggtcatagctcaagctttgaccaagctttccaaccagctttcttcctctgtaaccttaacttccttatgcctcagttttctcatctatgagagaaagcaggctgggtacagtagctcacacctgtaattccagcaccttgggagaccaaggtaggaggactgcttgagcccaggagtctgagaccagcctgggcaacacagtgaaaccctatctctattaaaattattttttactgccagcatgtgtcaactaaaaaaaaagaagaaaaaaatatttttaaaaagataatttttaataagacaaagcaaaataaaacaaaatttgagcatataatcccccttctatgtcccagaaatcactgcattggctctatgcctattaaaaaataatacattaaaaagatttttgggccgggcacagtggctcacgcctgtaatcccagcactttgggaggccaaggcaggtggatcacctgaggtcagcagttgaggccagcctggccaacatggtgaaaccctgtgtctactaaaaatacaaaaattagctgggtatggtggtgggcgcctgtaatcccagctactcgggaggctgaggcaggagaatctcttgaacccaggaggcagaggttgcagtgagctgagatcgcgccactgcactccagcctgcgagacagagcaagactctgtctcaaaaaaaaaaaaaattgaagtatcccagaagtcacgtccatgaagtaactaacatagttccattttccctaaacaagtccagaggggctatgatctcacactattcgatcctgaaacacaagggatagaatatacaaatgaagactactttgttgtttctttgctactagacagcatacagcagggaaattttgctcaagaaacacattgcctggatggtggcaatagcacagaatgctgttgatcaagtggctgcttgcagcacagctaatcatcctatgttaggccaagtagatcactgaaccttttctcagaccaatcccagatgcgcctcttgctctctccagtgcttccccagcctaccaacatctcaactggccaccattccatcccaagtctttggcaaacccaggctgatatattaaccaaacggccagaaggggtcactgttgaactagtctgggaagaaagctagcgttagccattcttttaccaagtggctattggccaggataaacacacccctgatttaatgtatgttatagtatatataatcatatttatataaattatatacttttaatataatttttcctgtttctattatataatgtactatataatacatatttaatatcatttatatattatgcatatattacatatgtatatatgttatatagatagatagatagattttttttttttgagacggagtctcactctgtcgcccaggctagagtgcagtgacgtgacctaggctcactgcaacctctgcctcccaggctcaagtgattctcctgtctcagcctcctgaatagctgggattacaggtgtgtgccaccacgcctggctaattttttatatttttagtagagacggggtttcaccatgttagccaggatggtctcgatctcctgaccttatgatccacccacctcagctttccaaagtgctgggattacaggtgtgagtcactgtacctggcctatatatatatttttttaatttttatttatgtatttatttattttttaagatagggtctctgtcacccaggctgaagtgcagtggtgcaatcatgacttgccgtggtctagacctcctgggctcaaacaatcctctcacctcagcctcctgagtggctgggactatagatgcacaccaccacacctggctaattattaaaatttttgtagagatgggatctcactgtattgcccaggctggccttgaattcctagcctcaagcaatccttctgccttggcctcccaaagtgctgggattataggcatgagccaccacactcaacctctgtatattattaacagcaactccctttcatgctcaaaaccgtcctgatttggatgataaattatatggtttatgtgggttatgaattatacgctgcaccactggtgactaagtaaccatatgtcctcctttaggcagaagaaacctgggtttcagttaatgatctcttttgatagatttactctcccaaatacctaccaccgaaacattctgttcctaacatttccattgcccttcacactctcccttttccttcctttctctgagttaaacatattgctgatttttttcatctcccaaaagattcctagagctgaccttcttgtctctcaaatcatatttgtttttctctaagtagagaatcttctcctagattatacaacctccctcgtaaaaacctggggagcaggagggaggtgttgaaacttcactagagcaggtgcattctttattgctttattccttgtcctgcactggcatgaatgcagttacctacttggtgatttaacataaaacagtcagacaaaatgagatctaagagaaaaaccagagttcaaattaagctggcaaatttataggctaatttgtggctgtttgttccaccaaaaatacaattattttgctgaaggccttctattctaatgcttacaatgagtagcaccattcccgggtgaggtttgagctgcaattctattccactaatcatccgttttactgtaggggaagccttcgcttcttggttactatggaccttaattgctttatgtacttaatgaagaaactataaagtagataatcttgaaaatgacttatttgtaaaatcctataattctaaaattaaaaacaattataccagtcaggacttgttaattataagctttaaaacttggaaacaggcccggcacggtggctcactcctgtaatcccagctacttgggaggctgagatttgagaactgcttgaacccagaagggaaatgttgcagtgagctgagatcacaccaccgcactccagcctggttgacaagcgagactctgtctcaaaaacaaaacaaaacaaaagatcaacttggaaacagtacacatattttcaaattttatgtaccacaaatgatatatagacaaattagcaacaaactggataatgcaacccatcagatcaaatctaaatgaatagctgattgtaaatgtgtgtcattagagagtatgtaaaaagttcttgctttcaatagcctctactatcacatctgaatgtgaaccctgaactatcttctggcgttttgaagttagacctggctaccattacacaatccatagtctctggttttctttgtcattttaccctgcctccaggagcctacctattacccaaataagggaagccaaactcaaaaatcttatcatgaatcagaaggttgtgatcaatatgaactatatctacacattttttcaaaaggaaaggattctctggaattagcctcttttttgttgaggaccccaaacccacaatacatatacccaagataaggccaaaggataggtgttaaaattcccggcattggccggcgcggtggctcacgcctgcaatcccagcactttgggaggctgaggtgggtggatcacgaggtcaggagttcgaggccagcctggccaacatggtgaaaccccgtctctactaaaaatacaaaaattagccaggcgtggtggtgcacacctgtaatcccagctactcgggaggctggggcagaagaattgcttgaacccgggaggaggaggttgcactgagccaagattgtgccactgcatgccagcctgggcaacagagtgagactctgcctcaaaagaaaaaaaaatttcccagtatgacactgtacatcacttctatttgttttttgtttgtttgttttgagacagggtctcgctctgtcacccaggctggagtacagtggcatgatctcagctcactgcaatctctgcctcccaggttcacataattctcgtgccttagcctcccgagtagctgggactacaggtgcccaccaccacgcccagctaacttttgtatttttagtagagaaggggtttcaccatgttaaccaggctggtctcgaactcctgacatcaagtgatgatctgcccgccttggtgtccaaagtgctgggattacaggtgtgagccaccactcctggcccacttctatttgtatttcactgttcttcagttactacagagagcaaacataccaacacaattaagaagtaaccacaaatatactgtatatgctgcaaatgcacagatttgtggctataaatccctcttattccctggtgtctgtctgagtcttagttcagtcctatatttacagggtagagagaacacttagtaatcagaagaagtgaaaaaggattggaaaaaaagggagaattggggaatttacagagaagaaagaatatttgcctataggactttgtattcataacaaatgctcttggaagtttctttttataatgatctctaaaaccaattgccccacataagaaaagcatctcgaatatatattagtaatttatgtgtcaaaaactgctaattaattatgtaaattaagcatgcaaataaagagcaagggctttgaaaataaagtattttttaaaacctggaaaattataatatcagtaaaaataaaattaagtgacgagcatctcccaacttgggatatttttgtcctctatcaatcggcagcatcatagccagctgacagaacgtagagaggtggtggggaattctgaaggctatgaagaatgtgacaccctgacacatgatttggactttatagaaatagataagatcataactcagctcaagctaatataatatcatattgtttctgttttactgtatctcacagctacaacagcagcccaggaaacaggtgcataataataagaaaaaaaatgaaagtttatggagtggagttacccttctaaatagaacatcaagacaggtgagaagaaccccttcgctgctggcctttgcaagtaaacagagggcagtatatagagagcaggtgtgtatttgataaagacaatggaatgctaaaaacaatagtcaaacaacaaattaagaaggtatttacttacaaggagttcctctgctggcttcttccatagttaccctgacatagggcttactaaagtcaacttcaatttcatcagaaaaaggagctggttgccgtaagcccttaagaaatggaaagtgaaggaaaagaaagttcaactcaatggcatacactgtaatactaaaaaaaaaaaagatgagagaaaggagattgatctctctattatagatggcttcgtttaagagatttcgttattcccgcctgtaatcccagcactttgggaggccgaggtgggtggatcatgaggtcaggagattgagacaatcctggctaacatggtgaaaccaggtctctactaaagatacagaaaattagcctggtgtggtggcaggcacctgtaatcccagctactcaggaggctgaggcaggagaatcgcttgaacccgggaggcagaggttgcagtgagccaagatcagaccattgcactccagcctagcccacagggcaagactccacctcaaaaaaaaaaaaaaaagagtttttgttattcctatgtattttattctacttgatgctgttgtgaatggaattgttttctgaattttatttttggattgttccttgatattatgtaacagtgcaattgatttgtatttgtgtttgtgtaactgaaattttctgtatattgatcttatgtcctataactttgctaaagttaattatcagttctagtatccgttgttgtttcatggattccttagcattttctacatataatatcatgtcatctgtgaatatagttttgcttattcttttccaatctggatttttttttttttttgagagggtccagctctgttgcccaggctggagtgcactggcgccatttcagctcactgcaacctccaactccccgactcaagtgatcctcccacctcagcctcccgagtagctgggactacaggcatacactacccgacacccagctgattttttattcttgtagagacaaggtctcactacgtgcctaggctggtctcaaactcctggcctcaagcaatcattccaccttggcctcccaaagtgctgggattacaggcgtgagccaccgtgcccagcctctggcctgggatttttaactatagtttgtttcttgtgatgtttatgtctggctttgatatctggcctcacaaaataagttgtgaagtgttctctttaccttatttttgtgtaagattcgtattatttattccttaaatgtttttgtggtttttgtaaagacactctgtcaccgaggctagagtgcagcggcacgatcatagctctctgcagcctccaactctggggctcaagcaattctctcacctcagcttccctaatagctgggactacaggcatgcaccaccacacccagctaattttttaactttgggcctggacctgtctttgtgagaagatttttaatgactaattccttttttttcttttttaacttgatataagtctattaagattttctcctttgtcttggttagtttttgcaacttgtctctttctaggaaattgtctattacatttaaattgtcaaatttttggcatgaaattgctcccttataatccttctaatttctgtatggctgcagtgatgttccgttctaaaaagatcgtatcatgattgggctgaatccagagactgggaagatactgttttgttttcaggtaagtgtagattttcaaaattgttttaacattaaaacacgttttttttgtttgtttgtttgttttgttttgttttggccaggtgcagtagctcatgcctgtaatcccagcactttgggaggcccaggctggtggattgcttgagcccaggagttcaagaccagcctgggcaacatgacgaaaccctgtctctacaaaaaaatacaaacattagctgggcgtggtgacacatgcctgtagtcccagttacttgggaagctgaggtgggaggactgcttgagccagggaggcaggggttacagtgagctgagattgccccactgcactccagcctgggcaacagagcaagaccctgtctcaaaaaaaaaaaaatcacttatataagtttagtttaagatatacttaatgatataaatggaaacattctttttttttttttttttttttttttttttgaggcaaagtcttgctctgtcgcccaggctggagtgcagtggtgtgaactcagctcactgcaacctccacctctcaggttcaagcgattctcatgcctcagcctcccaactagctgggattgcaggcatgcaccaccacacctggctgatttttggatttttagtagagacagggtttcaccatgtcggccaggctggtcttgaactcctggcctcaagtgatccacccgcttcggcctcctaaagtgctggaattacaggcttgagccaccatgcccagccaagacattcatttttagatgtgtatgtgttattcttctttgaaatacttttaaaaatagaaccaaggacctagatattaatcaaaaacacaaggaaatactacttcatatcaaccaggatggctatgagcaaaaagacaggcaataacaaacagtcttggtaaggatgtgaagaagttagaaccatcatacattgctactgtgaatataaaataatgtgcagctttggaaaacagttcttcaaaatgttaaacatagaattaccatatgacccagaaattatactgctaggtatatacccaagataactgaaaacatatattaagaaaaaaacaactatgtcaggcacggtaactcacgcctgtaatcccagcactttgggaggccgaggcgggtagaccacctaggtcgggagttcgagaccagcctggccagcatggtaaaatcccatctctactaaaaatacaaaacttagccaggtggcgtggtgcatgcctgcaatcccagctacttgggaggctgaggcagaagaatcacttgaacccaggaggtggaggttgcagtgagctgagattgtgctaccgtactcgtctgggagatagagaaagactctgcctcaaaaaaacaaaacaaaacaaaaacaaaaacaaaaaacttatacatgaaaaatgttcacacttgcattactcgtaatagccaaaaagtagaaacaacccaaatgtccatcaatgaatggataaacaaatggtatgtccacacaatggaatattatttacccataaaaaggaataaagtactgatacatgctaccacttggatggatcttgaaaacattatgccaaaaaaggaagtcggacacaaaagtccacaagttgtatgatttcatttacattagatgttcagactaggcaaagctgtagagacagaaagcagattagtggttgccaggaggtagctggaggggtaatagggagtgactgctaatgaatacagggggtttctttttgtggtgatgaaatgttctggaattagatggttgtgatggttgtacaacagtatgactagactataaactactgacttatatactttaaaatggttaaaatagtgaattttatgttatgtgaattttacccaaattttaaaagatacattggccaggtgtggtggctcacacctgtaatcccagcactgggaggccgaggcaggcagatcatgaggtcaggagttcgagaccatcctgactaacacggtgaaaccccgtcactactaaaaatacaaaaattagccaggcgcagtggtgggcgcctgtaataccagcactttgggaggccgaggcgggtagaccaccttaggtcgggagttcgagaccagcctggccagcatggtaaaatcccatctctactaaaaatacaaaacttagccaggtggggtggtgcatgcctgcaatcccagctactcgggaggctgaggcaggagaattgcttgaactcgggatgcggaggttgcagtgagccgagatcacgccactgcactccagcctgggcagtggagcaaaactccatctcaaaaaaaaaaaaaaagagatattttaagtatcttatctttcacaactgtttcttcagtctttctcacatactgtgtatatttccaggtagaagacaaatacagctgtccttcctggctggggtttaggctgaatccgtttctcctaagtatagggagtgaaacctaacgttgtgcagctataacaaagcagcaaaatctttttttctagagttgtttccagctagaaaaggtagtatttttttaaaacactgtgttattctcaaagaacagtgtctctagaagctgaggtttataaaagtaggactaaatatttctgtgttctcctaaaacacatctccttcattttaacctcaagggaatgccacagtatcgctttcaagtcttaagactatctggtagtgaggtataaatgaaagaacatggggttaggacttggaaaatttagatctaaatcccaactctatcatttaatacctgtgaaatcacagcaagtttctaaagctttcatttcatcttctacaaaatagaaaacaacaatacctgccctacaagtttactatgaggattaaacaaagtagcatccgcaaagtaattagcataatgtttcacaaaagtaggcactcgacgaatttgtcgttagctcatttcctcttgtattctatagaacacagatttcagcatgctaacaaaattaactcctattaatctaagaggttagcttctaaaatgctatataaactttccaaatgcatgcatctaaaagttataatggaaatcaacagtccccaaattatgaattgtctctgaatgcaatattgcttccataacaactttttccagactatattcacacacattatttcactattccttaaaatttcagtgaaaacaagagattctggcatccacactaacaggaaaatggacataattcaaataatatagactagaacttgatattgtcttcccagtacactttttactttctaaggattctttttttttttttttggcttttttttgtgagacagtctcaccctgtcgcccaggctagagtgcagtggcgcgatctcagctcactgcaacctctgccgcccaggatcaagcgattctcctgcctcagcctcccgagtagctgggattacaggcacccaccactgcgcctgcttaatttttttagttttagtagagacagggtttcgcgatgttggccaggctggttttgaactcccgacctcatgatccacccgcctcggcctcccaaagtgctgggattacaggcgtgagccaccgcatccaactctaaggattcttaaatatttttcagcaaaaagtttctgaatgccacagaaaaacatttatttccctttcacccaaacattctgtattaatgataaagggtcctcccgagatcccaattgtttctattttttttattttttaagagacagggtctcactgttgcccaggttggaatgcagcagtgcgatccatacctcactataaccttgacttcctaagctcaagagatcctcctgcctcatcttcctgagcagctaggaccacaggggcacatcaccatatccagttaatttttccattttttttgtagggacagtgtctctctataatgcattgcccaggctggtctcaaattcctggcctcaagggatccttccacctcccaaggcgcttggattttaggcatgagccactgtgcttggcccaattctttcaataatgccacgggaaacgctacagagtcaagaggaataccatgtggtatgagaaagaagggacaaagaacagagctgaaagattccaccccccggggatctgtttttttgttttgttttgttttgagacagagtcttgctctgtcgccaggctggagtacagtggcgcgatctcggctcactgcaagctccacctccagggttcaagcaattctcctgcctcagcctccggagtagctgggactacaggcacccaccaccacgcccggctaatttttgtgacttttagtagagacggggtttcaccatgttggccaggatggtctcgatcacttgacctcgtgatccaccctcctcggcctcccaaagtgttgggattacgggcatgagccactgcgcccagccaggatctggttttaaaaatgaaagaaaagcaatcattctccctgactcctattgccatttcagtgaatgtaaacaatgagctcatctgtccaattactatttggatgtcttataggccctctaaattgaacctgtactaagttaaactctttgtcttcctcctaaacctgcttttcctcctggtatttcttatctcaatgggaagtaccccatctacacaacgtacctaagactgaaacctaggagtcactcttaacaccttttgtccttcatatctcagtaatctccaagaactgtccattttacatcttttttaaaaattacaattttaatttaaaatagagacagggtctccctatattgcccaggctgctctcaaactcctgggctcaagggatcctcccaccttggcctcctgaagggctgcgattacaggcgtgaagccaccatgcccagccgattttaccttctagaaatgtgcaaagtttatctcgcactctctgtacctaatgtcatagtttaagccctacttcatgattctgaacttgtaccccatctcttgttcatttcttgaattccttgtatccttcaaagttcagctcagaaataacccttttgatgacgcttttcccaaaccactgcccctacctcttggtcaaagtcagtctcttgcttctcaagattattttggttgaaatgagattgggaggcctatacttagccataagcagaactatggccatcctgacccaccaacccaggcatctaatacctggtatccttcctactccttttttctcaagagattgactttgtaacttccgtctatttggcacttttcatacgtatcataatttcatactgtatcataattatttgctgctgtttctttctcttttttgtctgtgagttttccaagggcaaggtcatcttttcatccttgcatctccaatgcaactggcaagtagaggttctcgaaacattttggttgaaatgagattgtgaggcctactttgccataagcagaactatggccaatttcccccacagtttagatacttcatgactcattcatacatatgatattctttgtaagttattttattttatttattattatttttattttatttatttatttattttttttgagacagagtctcgctttgttgcccaggctggagtgcagtggtgtgatctcagctcactgcaacctctgcctcctgggttcaagccattctcctgcctcagtctcctgagtagctgggattacaggcgcacatcaccatgcccagctaatttttttttgtatttttagtagaaacggggtttcgccatgttggccaggctggtctcaaactcctgacctcgtgatctgcccttctcggcctcccaaagtgctaagattacaggcgtgagccacttgcgcccagcctgatatatattaagataagctaaacgtcttatgttttgtaaatacttttgtgatccttttgattgaacctttagaaacatctgtatcaataaatgatttatacttatcgacaaaatagccataaagtttttcctagtttttccttcttaactcctttgtctcttttctatccatttcatcctgacccaccaacccaggtatctactacttggtgatccttcctattcctttctttacatgcaaggaaagtactttttctaaagctaatgagctccaccgggtgtggtggctcacgcctgtcatctcagcacttagggaggcagaggtgggcggatagcttgagcccagggcaacagagcaagtccccctaccctttttttttcttttttgagacggagtctcgctctgtcgcccaagctggagtgcagtggcgcgatctcagctcacttgcaaactccgcctcctgggttcacgccattctcctgcttcagcctcctgagtagctgggactacaggcgcccaccactgcgcccagctaatttttgtatttttagtagagacgaggtttcgtcatgttggccagactggtctcgaactcctgacctcaggtgatccgcccacctcagcctcccgaagtgctgggatgacaggcgtgagccactgtgcctggcctgcaagtgcccattaaaaaaaaataaataaactaatgagctctaggctatagaattctactctatgctcacatctcataaaaggaaggtcttgtttatctttacacgtctaccacctactgccatactagcgcattgtaaatatgcaataaaggccaggtgcagtagctcacgcctgtaatcccagcactttgggaggtcgaggcgggcggatcacgaggtcaagagatcgagaccatcctggctaacacggtgaaaccccgtctctactaaaaaatacaaaaaattagccaggcttggtggcgggcgcctgtagtcccagccactcgggaggctgaggcaggaaaatggcgtgaacccaggaggcggagcttgcagtgagccgagatcaggccactgcactccagcctgggcgacagagcaagactccatctcaaaaaaataaataaataaaaatgcaagaaaatcttgcttactcaacccaaatgtcaactggagaatgaataactaaaaagtagtatgtgatatatgatggaatgttatttgtcaataaaaaaaaaatgaagtactggccggacgtggtggcccacacctgtaatcccagcacttcgggaggttgaggtgggcggatcacttgaggtcagaagtttgaaaccagcctgagcaacatggtaaaaccccatctctactaaaaatacaaaaattagccaggcgtggtggcggcgcatgcctgtagtcccagttactcaggaggctaaggcaggagaatcacttgaacctgggaggccgagatcacaccgctgcattccagcctgggcaacagagtgagactctgtctcaaaaaaaaaaattgccgggcacggtggctcacgcctataatcccagtactttgggaggccgaggcgggcggattacctgaggtcaggagatcgagaccatcctggctaacatggtgaaaccccgtctctaccaaaaataaaaattaaaaaaaatcagccggatgtggtggctggcgcctgtaatcccagctacccgggagggtgagacaggagaatcacttgaacccaggaggcggaggttgcagtgagccgagattgcgccactgcactccagcttgggcgacagagcgagactcagtctcaaaaaaaaaaaaaaaaaaaattaagtacttgtacatgttgcagtacgaatgaatcttcaaaacaagctcagtgaaagaagccagccccaaagaccacataccgtatgatgtcatttgtatgaatgtccagaacaggcaaatccacagaatcagaaagcagattagtggcttccagaggctggagagactggggggaaatggggagtgactgctaatgagtacaggccttctttctggggtgataaaaatatcccaggccaggcatggtggctcacacctgtaatcccacactgtggcaggctgaggcaggagaatcgcttgatccaggagactgagaccagtctgggtaacatagtgagaccccatccctacaaaaacaaatttaaaaattagccaagcatggtgatgtgcacctatattcccagctacttgggaggctgaggtgagaggactgtttgagcccagaaagttgaggctgcagtgaactatgatcacaccactgcactgcagcctgggtaacagaccaagaccctgtctcaaaaaaaaaaagaaaaaaattctaaaattggtcatggtgatggttgcacaactctgtgaataaactgaaaaccactgaattgtatactgtaaatgatatgtcaattataactcaataaagctgttaaaaaaagaaaaaagtcttgcttgcttttgttatagagttcaaaggagattcagagctagaaagtacaggtgtacagtgagatggcagaaagtttactagcagacattcctcctcactaaggtgggccaggctgttgggtggatctctgaccattcacctatgccaaatagtctgtgtgtttcagggaggaatgtggaataggtagcagcaagtcactgaactgatttcacatgaatatatgaagcaaagtaatttaaagcattaagactccccagaagaatttaaaaaaaaaaaagattcccagagtctaaagaccaagaaatttaagttttctcagagctcattccactgaaaagactggcttcctttgctttattcctagctacagtgattggctgattagctgacagtatcacctatttggttataacttgttcctactccaagtgatgttgctgaattggtacacaccaccatttctttaatctgaattatctaagaaatattcagaaactaacaatgccctgttttgttgattgctgagtcactttctgagcttatttgctgtagtatgcagaataatgcccccctgcagatggccacacccattccctggagcctgtgactgttttaccatacatggcaaaagagactctgcaggccaggcacagtggctcacgcctggtaatcctagcactctgggaggccgagataggaagactacttgagctcaggagttcaagaccagcctgggcaacatagcaagacccttactctaaaaataaaaataaaaataaaaatagtaagccaggcatggtggtgggcacctgcaatcccagccacttgggaggctgaggcagggaaatcacttgaacccaagaggcagacgttgcagtgaaccgggaccgcaccactgcactccagcctgggtgacaaagcgagactctgtctcaaaaatacaaataaaaataaataaaaataaaaatagtaaagaggctttgcagatatgattaaataaaggaagattattctggtttatctgggtataccgaacgtaatcacaagagtccttgtaagtgaaaaggggaagtaggaggttcagaatcagagcaggagacatggcagaagcaatcgtcagagtgatgtgagcactggctggtgccaagcactaagcaatgtgggaaccctctagaagctggaaaaggcaagaagatggactttcccctggaccctccagctctgccaacaccctgattttagccctctgagacccatttcagatttctgatatccagaactgtaagataattcatttgtatatttgtattatggtaatttgttacaaatgcaacaggaaacaaatatatatacttgcccttatgatcaatatcagccctgcaggcacttgtctatttgtagggtattatttgcttttattgctcaagacagagcattcatttggaataagtattaactgtttcagaatagatttttccctttgggctgggaagctctagaactaagcagtggaaactgagtttgatcaatggctaatagtcaatataggtaaagaaacatacaattctgtcactgggattttgaaacacagatttcataataatattaacaacagtagcttcaattgtgtgtaagtgttctctgacatgtttttattatggaaagttttaggaagggtagcaagctgagacaggataggcagtgtggaggaaagctttaggaagggtagcaagctgagatgggataggcagtgtggaatggggtctttcatctaaggtttggcaataattaggaaatacaaagataattttccagagataaaggagcataaggtaggcataaacggaaaaaggttctcatctaagatacaactagtaacaggatggaggaatgatagagggagaaaaaacagcagaaaagacgcactagacaccatgagatgatacgaagatcaaatcactgcctagagccccaatttttctatttcattagttttatttatttgtttatttactttttatttttatttttgagatagggtctgtctctgttgcccaggctggaatgcaatggtgcaatctcggctcaccgcatcctccgcctcccgagttcaagcaattctcatgcctcagcctcccaagcagctgagattacaggcatgcgccaccacgcccggctaattttgtatttttagtaaagacagggtttcaccaggctggtctcaaactcctgacctcaggtgatcctcccacctcagcctcccaaagtgtgggattacaggtatgagtcaccgcacctggccatatttcaatagtttcagcctaatacacatgcaacttccatattttcctaacacttctttttctaaacccaatgtaaagcttctacaactgagctgtgagtcataatccagtaaaaaggcagcagatttccagtgactgtgaaaatacacttactattccttcttttcattatttcagaagacatgtaacactgatatcatcaatgtcatatcggtttctaccctccccctgccaggttaatctccacttaccactgcacagcgctgcactttggaaggaaccccatcttcttctgttgccccgttgggtccgggcgcctcttttctcctcttccttgcattgaccttggctgaacactgtgcatccatcttcttttaactggtcatagaaagtgaaaacaaaaattttctcattggggtgggaaaaagtttgtcaccagtatttcagagacgttgacgtggatacactcagcaaaataccaattctacagctgcacttcaccaagatgagccaatggcatctggcaaaaccagcgaagcttcacaaaacacaggctctagtagaaatactgaaacgcctctctgtgcaacaatggccacagtgaattgcctgaagtcggaagtcattccccctcacagtgcagcctacatactaactgctcattttaaatcctgattgcatgcaaaagattggaataatttggctgagaaagatagttacacagactctcccactatcctccgcatcatcgatatgacaggtataaggcaatgtgaaggtatgactggtgcaggtagagaaaagagccttttgtaaacggatggctctcaccaagtcctggattaacaaaacacggatttcttaactctaattttttttaagacggggtctcactctgttgcccaggctggggtgcagtggtatgatcttgcctcactgcagcttcaacctcgttagctcaagcgatcctcttgccccagcctcccaagtagttgggactacaggcacatgccaccacacctagttatttttttttttaagagacaggcctcgctatgttgcccaggctggtcttgaattcctggcctcaagtgatcctcccaactcaaactcccaaagacttgggatgacaggcatgaaccacatcactgagtgaatttcttaactctaaaagttctatagatttcagtgaccacttcaccagagttacttgcatgaaaattgtggagtagcataatggtttttatttacttttttattgtttttatttttttaggggtcttgctaggttgtccaggctggagcgcagtggctactcacagccataatcatagcacactgtagcctcaaactcctgagcttaagcaatcctcccatctgagcctccagaatagctaggaccagcataatgtattttttaaatgtccttctccttctttcctttttttttttttgagaaagagtctcactgtgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactccgtcaccctggctagagtgcagtggcaccatctcggctcactacaacctccgcctcccaggttcaagcgattctcctgcctcagcctcctgagtaggtgggattacaggcacccaccaccacgcctggctaattttttgtatttttagtagagacagggtttccctatgttggccaggctggtctcgaacacctgacctcgtgatccacctgcctcgtcctccaaaagtgctgaaattacaggcgtgagccatggcgcctagccaatttttgtatttttagtagagacagggttttgtcatgttggccaggctggtcttgaactcctgacctcaggtgatccacccacctcgacctcccaaagtgctggaattacaggtgtgaaccactgcacctggcccttccccttcttttctcagtactcatttccctttcctctttcagggtcttaacacctcaagcttgttcacagtttccagctattaaaaccccctcagggattctccttcccccaaaggaacttatttattattgtctcatttagcagagagtttctagcaactagctattacagcaaagttctgaatattctgtatttcatgtttaagtcacagaatacttggggtgtcacttcgctagccagaaacctctgtggccagtggcacctttgcctgagttttgctcaggcccgccgggctcgttccgtccactcagcctggtaggctatgctcagcttgtgttaccagcacagattccatgcatgccaaggacaagccaggcacggagcggcaagaggtgcacaggcgagccagcacagggtccggccactgcgcacagccaggcacgccagctgccagggggtgagcagctcgaggcgccagctccctgagaggctgcagctgaaccaggcgtactacaagcagcttccactgcaggcactggggaacatggtgctgcccagaagcttggagaggccaggaaccacagagctccaaagagggtgtcacagccctggctcaaggagctcctaggtctgggcttcccaaagggctacagctcttctctttctctctcctctcttctctctttctgttgcccacagcgtggcaagcagtgggggaggggaggacgtgtttcggctctgtttgtgtttcagctctttcagtcccaccatttggcagatcccgagttcttgtcccacgtccaggaagaatgaggtatatggacaactggaggacgagcaaggtgaagaggtgctttattgagcaacacaacagccctcaggagaccccaagcgggtagctcctttccgcagcaggtcgtcccagcatctgtgcagccctcagcggagaggagacccagagtggatagctcctatctgcaggcaggtcatcctgacgtctctgcagccctcagtggagaggagacctggagtgggaagctcctatccgcaggcaggtcatcccatcaagtatggctgagtccagggtttctacgggcttcagcgggcaggaagtgcatgctgattggtccatgggcagccacaggcagcccggaaaaagcatcgtaagttctcattccagtccacagaactggcagcctgggccccaggcttcaggccatccctggcttgaaggtggggcttcaccagggacccgcccatttccgcctaggagcctgtctgcctcctgctgtcatcaacctgctgtccacagcgcccaggctattcacgaaggggcgcctgcaggcctgaatggagctgctctcagctccgccttggcgtcccctcctgtgctgctggacacccaaaatccagagggggccaaggcagaagggggctggcatgtcagcactgcccctagcacacgcaaacccagccaggtcatgacagtgcccaggcttggcctcaactttgctccaaaatcagagcaggcaccaggagcaaggagaggccaggcagtgggagcaggcacttcaagcctgcaggggcaggggaggttcctgggcccccaaaagcacagggaagcccgggtatgtagccacggctgctcccgccctgccaacttggaaacgggcagggcttccacctactcccagctcccagtggctccatggagcgtgcagcacagaccatgcctccccgactgcagccggcatcatggcagcagcccatccagacaggccaccgctgccatcatttagatgttggcttttcagccccctgcagggatagttgcgtttttcttaagtaacacaatttgtacaaataaattactttcttgatactgatgaaattttaggaatcagccagaaattgggggtaggggaaactctatgataaactgtcatctctgcacaagatacggttcagagaaaaatcttcagaacaggtggaaaaccaatgccagacagaatgaggacagtctgctctgccctactgcctctcataagcctgactgagatgttcgtctaaacaactgcaactgtgccttactttctttcctccggctcaactccgagtggcaatatgacaagatctacaagaaactggcctaattcttagaagctgaaggtgacaccccatgagtcatggccaacatgaaaaaatgtcagagtcgaaagtgaaagatgagcaccacctagaaacttcctttcatcacaaatgcaaattaaaatggaagaagggttctatacatttcactccgagttctttcagtgatgatgatcagagcttgtcttcactattgttcttaatgattccttcataatattcagaggtcaatactctcatctcagtggtctgagtgaactactcaaaatgcctaatccatccaattaatgattgttttctaatttgcacagtactcttctgtaagtatctgctcaattcttctaagtgtagagagacaaaatccactatgagaaatataatcagcaatttggcatctggcaagtcaataatatcaggcagtcaaaaatatgagtacttactgcttacaaagtactgtatcataatttttaagtacaaactgaacctggaggacattatgctaagtgaaataagccagacgagaaagacaaataccacaaatgacctcacttatttgtggaatctaaaagagtggaactcacagaagtacagaatggaatggtggttacaagagatggacagaagagggtggagagcaaaaagggagatgtcgagtacaaaaattcagttttgaaaggagaaacaggctgggcacagtggctcacgcctgtaatctcagcctttgggaggctgaggcgggtggatcacgaggtcaagagatcgagaccatcctggccaacatggtgaaaccccatctctactaaaagtacaaaaaatagctgggtgtggtggcgcatatctgtaatcccagctactcgggaggctgaggcagaagaatcccttgaacccaggagacagaggttgcagtgagctgagatcgcaccactgcactccagcctggcaacagagtaagactctgtctcaacaaaaaagaaaaaaaaaaagaatggagaaataagctttagtgatctattgcacagaatggtgactataataaataataatgcagccaggcacggtggctcacacctgtaatcccagcactttgggacgccaaggcaggcggatcacaaggtcaggagattgagaacatcctggctaacacagtgaaaccctgtctctactaaaaatacaaaaaattagccaggcgtggtggcgggcacctgtagtcccagctgctggggaggctgaggcaggagaatggtgtgaacccgggaggcagagcttgcagtgagccgagatcgtgccactgcactccagtctgggcgccagagtgagactccgtctccaaaaaaaaaaaaaaccaaaacaaaataaataataatgcattttatatttcaaaattgctaaaagagtagattttaaatgttttcaccacaaaaaaataagtatataaggcaaggaatttgttaattagcttgatttaatcattccacatgtaaacatatatcgaagtatcacattgtatcccataaatataaacaactattatttatcaatttaaaaaattaaaggccaggcacaatggctcacgcctgcaatcccagcactttgggaggctgaggtgggcagctcacctcaggtcaggagtttgagaccagcctgtgcaacatggtgaaactccatctctacaaaaatacaaaaattagccagacttggtggtgcattcctgtaatcccagctactcaggagactgaggcgggaggatcacttgaatctgggaggcaaaggttgcagtcagccgagatcgcaccactgcactccagcctgggcaacagagtgagactccgtctcaaaaaatgaaaaaaaaaaaaaaattaagtacaaactattttctcaaggaagcttcaattaaggcatggaaaacacacacagagctccacctcaaaaatgcttatgatataaaaatgctctacaggattctaaaaccatggggtgaaagtttgctgaggaataggatatttgcagttacgaaaaattgaccaggtgtagtggcacatgcctgtagtcccagctactcgggaggccgaggtgggaggactacttgagaacagcaagtcaaggctgcactgagccatgatcatgccactacactccagcctggacagcaaagtgagaccctttctcaaaaaaaaaaaaggccacatgcagtggttcatgcctgtaatcctggcactttgagaggccaaggcaggcgaatcacctgaggtctggagttcaagaccagcctggccaacatggtgaaaccccgtttctactaaaaatataaaaattagccaggtgtggtggcgggcacctgtaatcccagctacttgggaggctgaggcaggagaattgcttaaacccaggaggcagaggttgcagtgagccaagatcatgccattgcactccagcctgggtgacaagagtgagactccatttcaaaaaaatatatatatttttttctttacctgcttacactattatgtgtttatactattccttatctgcttacatacagttcttctattttctaaagatgacttttgggttttacattatattctacactgttctttaaactgaagtctttagatccttcggatttaaaataaaacacacccactgctttttgggttttagtgtaagacacttctttatctcatccacttctcaggagatggaaaacatctgggtcacagatattccataatgataaccctaaaagaatttagaaattatgcaaagattactcctcatgactttcctctagaactactgctgtttaaacttttactctgggctgggcgcggtggctcatgcctgtaatcccagcactttgggagaccaaggtgggtggatcacatgaggtcaggagttcgcaaccagcctggccaacatggtgaaaccccatctctactaaaaatacaaaaattagctgagcgtggtggcatgcacctgtaatcccagctacttgggaggctaaggcaggaggatcacttgatccctggaggtggaggttgcagtgagcctaaatcgcacgccactgcgctccagcctgggcgacagagcgagactttgtctcaaaataataataacaataataaacttttactctgtaggtctcacaagtttttttcattttttcccggccttcttatgccatcccaatgttctctcacatctactaacttataaccgcagcaccaaagcatacagaataataactgatgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctccctcaagagccctactaggatgggccaacacttcctgtttgtttagtggttcatcctccagaacactttctttgtcaaaaaggctataacagcccagtacagtggctcatgcctataatcccagcactttgggagaccaaggcggatggattgcttgagcccaggagttcaagaccagcctggccaacatggcgaaaccccatctctactaaaaagacaaataattagccaggagtggtggcacatgcttgtagtcccagctacttgggagtctgtggtggcagaatcgcttgaacccaggatgcagaggttgcagtgagccaagatcgttccactgtactcccgcctgggtgacagagcaagacctcatctcaaaaaaaaaaaaaaaaaaaaagctaggccaggtgtggtggctcacacttgtaatcccaacactttgagaggccaaggcgggaggatcacctgaggtcaggagttcgagaccagcctggccaacatggtgaagcccggtctctactaaaactacaaaaataagctgggcgtggtggcaggtgcctgtaatcccagctacccaggagactgaggcaggagaatcatttgaacccaagagacggaggctgcagtgagccatgatcataccactgcactccaacctgggtgacaagagtgaaactctatcaaaaaaaaaaaaaaaaagggctgacagccagaatacagcaattgttaagacctgatctttccaactgctgcctattcactccctagataagtcaccttatcttaatcactgaaatttgagcacagactctaaatatggacataaaaacccatcccccaacaccctgcctgctaagtacattagtgtctccaaagtgccctcgaaatacagaatgcagtatctgtgcctgtgatttttactccgactcacaaagacctggtttggtttctgctgactcacctaccagtacacactgcttgccttgttcctccacgttccaacacatgcctgctgaggcacatcagctttgctagacaagtggaagatgtgtttgtggagggaggggtggcactgaggagacactaaggatacagctagtcatatttttccaatgtgaatgtcctgaaggagacagaatctaggtgctggcatgtctatgcttgagtctgaaagatgataggctcctacaagtagttttagggactcctatccagtcctttctttttttttttttttttttttttttgagacagagtttcactcctgttgcccaggctggagtacaatggcacgatctcagctcaccacaacctccacctcccgggttcaagcaattctcctgcctcagcctcccgagtagctgggattacaggcatgcaccaccacgcctggctaattttgtatttttagtagagatggggtttctccatgttgaggctggtcttgaactcctgacctcaggtgatctgcccgcctcagtctcccaaagtgctgggattacaggcgtgagccaccgcacccggcctatccaatcctttctattcaacttccttattgcaaacagacctaccaagggaaagaggagttggactttgcttcctgaactatgtaacaatctaaatatagcagagtcctctcttatccacaggggaaatgtttcaagacgccagcagatgcctgaacccctagagagtatggaccctatatggacagttgtccctcagaatctgcagggcactggttccaggatctcctgcagatgccaaaatccacagatgctcaaaagtcccttatatatataaaacggtgtcgaatttgcatataatctataccccctatatactttcaatcttctctacattacttacaacacctaatacaatgtaaatactatgtaaccagttattatacaatattggttttttatttgtactgttttttattgttgtattggtatttttattgtttttttttttttttttttctgaatattttcgatccaagtttggctgaatctgcggatgtggagcccatggccacgaagggctgactctactttgttttctccctatatacacagagctatgataaagttttatttataaattaagcacagtaagagattaacaggaataactaataataaaacaattataacaatatactgtaataaatgttatctgaatgtggctgttctctctcactctcaaaatatcttactacatcatactcacctattttctgaccgtggctgactgtgggtaactgaaaccacggaaagtaaaactgcgactaagggtgagctcttgtagtagcaagttgcaattacatatgctattccacatttcaaaaatctaactcaaacttgaccaattactacaaggaactatttgcaaaaagatgaggcataatttttcctttgcactctattcctgccttccccatctctaggcctacattatcttccccactaaaacccaatgcccagtatttttctatcagcatatcaatgcccagttccaaagccgagtgcgcaagcagactttacatttgggatgtttctctgcttctaccgtggtggtgcttaatgagctggtgctctaagaggcaagctctggaaactcaagggttaaagtgcatctaatattcctggcattcattaatcctatcatcttgctgtacactcaggtctttctggagataacagtgtaaggacattgccccctatgtaaaggcctttgaagcttgaaggagtatatggctaagcgaaagtagggaaaagagctggactcaagaaccagaaaatctagatcaggggtcagcaaactacagctagctggccaaagatggcccactacctgtttttgtaattaaaattcgatcagaacacagccatgttcactcactgatgtgtttattgtccatggctgcttttgtgctacaacagcagagctgagtagtcacagatactgtgtgacctgcaaaccctaaactatttacaatctggcccgttactgaaaaagtttgctacctctcatcctagatgaaatcaggaccagctttattaataatttggtggcaaattctacctaaatttacccaatctaaagtgaaaaacagtgttagaaatagaattatttcgagtacagtggtgcaatcatggctcactgcagcctcgaactgctgggcttaagtgatcctcctgcctcaccctcccaagtagctaggactacaggcacatgccactacacccagctaattttttgtagagatgggggtctcactttgctgcccaggttggtctcaaactcctggcctcaagcaatcctcccacctcagcctcccaaagtgctgggattataggtatgaactatcacaccaggctgagaacttataaatgtaaaagtgaatttcaaaacatgagcttctctgacagattagttctaaactaaagttcaacgttacttgtcatgagccctataaactgtcacatttaagaccttagctttgaactggatctcttccctctaatttcgtcagagaaacccttattcaacaaacactgagcggcacttactctgtgccagaccctgggttagccactggcacacataataaagcttatacttcttcggcctggacatgtagtagaatatttcaggaaagaaaaaaccatgagggacacatgtaatagttcttacagttgaacaattttactctgccactattctaccagaatatttggtgagtaaactcttgtgtttagaatgtgatcttcctagagtgggttatggaactcatatctctgaggcagggtctatgatagaattcaggaagtctgtgaatttggatgaaaaagactgtatctttattttcacttcagtgatgaacataagctacagcagtaatagcagacttattagacaaatggatttgttaccagtagaaatcatggatattttcataccatatcatacttcttaaattttgataactatatatcaatataattcaatataactggttttctttatagttctatgtattttatttttgcatataaaaacatattccaaaaaggaactctaaaagctttcaccacactgccaaaggagtccataacacaaaaaagattaagattcctgttctacggtcaaaaaataaagaaacataatcacatttagggtaattttctgtatataaaaaaactacctgttttttattaagggtcatatgctcattttctatagagcagggaccatatgtcattatttttggcagccttcacttcaaaactggtttgcaagtagttgtgaatgtgatataacagcctagcagattcatgggttcccctggctcactggcagtcatcctagtccaaacatagaaagcctcaaactaatataactttcaacttgtggtacaagagaattcccaaaagaaagcaaggggcaaggcacagtggctcacgcctgtaatcccaacactttgggaggccgaggcggatggatcacttgaggtctggagtttaagaccagcctggcccacatgatgaaaccccgtctctactaaaatacaaaaattagctgggcgtggtggcgggcacctgtaatcccagctgaggcaggagatcgcttgaacccaggaggcagagtttgcagtgagctaagattgcaccactgcattctagcctgggcaacaaggcaagacttggtctcaaaaaataaataaataaataaatagaaagaaaggagggaaaagacacacacagaaagcctgctattaatatatatctattaacctggtttacgaatggtaaaatacaggtaattcaattatttacattaatgaataaggtaggtaacaaacctaaaagaatgccaaatatgagactcatttctttttatcttctgaggtggcgcttcggcacatgctgcaaacgtaaaaaggtacattccttgaatttactggctaaattgtagaaaggaattaggatttaaattctgccacaaataatccacaaagcaattaacaaaacaaatcacagatgaaacatgtgtttaagtactcatttgacaggaatactgtgaaaagagaggtttaggactaaaaacagaaaggtttacgcttaggaaagaggttcaaggacttagggaaaaggagatgccagaagctgccaagcagataagcaggagggttgacaaggcctaaagtgctgatcccctcactctcccaagtcacccctttttctaatatgcttgatgtgtgataatgtcaaagatgtacaagcagccagccacaatcttgagcaaaaaagggactctcacagtcctgtgataattggcaagtgccctgactttagggtttctccaactggaaacaaatccaagaaaaaaatgacttttacaaaaatgtattctttccaatctatttcaaggtaacacaaactttgatgtaagggagacctatttctgcttgattcagaaagggaaatttctattagtagaaaaatcagaaggtctgcttcagatcagttatgtaaatacttagaaaagcatgatgcttaagtaagaactctactattattagcagatattttgctattatccatcattaataacaatggaaaattatgctttttatttgagcatttcaaaaactaattctcatcagcacttataacatctctaggagaggttattcagctccctagggaaatactgtctaacttaaaggccagacagctctgaattataaatggagtcagatggtttacaaactctatgaaattacatacaaaatttggtaagttcacatatatttcagattattaaagggctgtttaatcataagaagagttacctctggccatggttagaaaatctacaacaagagaaagcaataatgctttccatacatagtcacagggcgagtaaatgttaacatcggagaaagtcaccagggactgctaagtccaggctctatctgacgaggtcattcttcttaagggatcacatatccaaaaagcaggtccccagggaaaataaaaccccactgcttatgggaggagagtcatagactgagggggaatgaagctcattctttatcaaccaggccatcatgctagttttcaaagggaatttgcaaagcaaatcttttgtcctacaaaaagattcatttcattcagcaaagaaaaaagaccctagagggagtactgctgaatcccaagcctcttccacagtctgttaccttgaagcatagatgctgttctagaagaaacccctgggtagttccttttagctatgtagaatgtaagtcaagtaaacatctaatgtgctagaaaaaggtgtaactaaccaatttatttagccaagaaaaggctatcccccaccattctcaactcattcccattcaagaacctatctgaactctattcccctattacagagtgtagggggcaggagtggttatcagattaatacactgtacgataaattaaatgacctcatacttctcctattataaaaagcactggtggcacaatcaatagcaccttctaaaaagagctgtaaggccaggcgtggtggtcacacctgtaatcccagcactttgggaggctgaggttagtagatcacctaagctcggaagtttgagaccagcctggccaacgtggtgaaaccctgtctctactaaaaatacaaaaattagccaggcatggtggcacatgcctgtagtcccagctattcaggaggctgaggtaggagaatcgctttgaaccaggaggcggaggttgcagcgagctgggatcgtgccagcacactccagcctgggcaacagagtgagactctgtctcaaaaataaataaataaataaataaaataaaaagggctgtaagagagaaggaagtagtaacattcactttaatttcatctacatcactcacagccctaaagaaagggaatgtgtaggaaataaagtcagcagctaaagcttcatttacattacccatagtgtggtatcattcctagcatgccaggcttggcctcagtgtacaaatcattgaattagagagctaagtacattgaagtctctcccatgtggcatcccaatcaccattattgacactgcgagtgtcatcattttgtccccctttctttctcatcatggtcatagtttactgctattactgcactaaatcccattctcaatgtctttttactagcaattctctgtacttgccaaatcactaaatatcaagataaataggctctggaggtcatatctgccttcctacttccattttattgttggcagattattttctgcccctatcttgagtttccttcccaacccttgttcctacgctcaaagcttcccgttcctcatgagcagtttctcataccacaaacccctaaatcctcactgcctctataaatatcacaaataccactgtccctttttttttttttttttttgagacagagtctccctctgtcacccgggctggagtgcagtctcacaatctcaactcactgcaaccaccgcctcctgggttcaagcaatcctcccacctcagcctccccagtagctgggattccaggcatgcgccaccacacccgcccagtgtccctatttcaatataatttctggttctcccaactgagatgccgagtttcagctctcacagctagtcacctcaattacattcaggaagcctcctccagttaggccaggctaatacagcctgttcccaattgcatctttgtacttccaaagagttccctattcatagaatcattacattttagaaccaaaagaaaactcagaaatcatccggtccaatgtttttcaaacttttaaagtacattttgcttcttacactttgagatgtacaaaatctattttacatcataatctcatacacacataactcaaacaaatcacatgaaacaatacttacccttactatgtaaacacactgaaagtttctattctattccactttttaaaagaaaagtacaggttcaggccaggcgcggtggctcacactgtaatcccagcattttgggaggcctaggcgggtggatcacctgaggtcagcagttcaagaccagcctggccaacatggagaatccccatctctactaaaaatacaaaaattagccgggcgtggtggcgcatgcctgtaatcccagctactagggaggctgagacaagagaatcgcttgaaccagggaggcggaggttgcggtgagctgagatcgcgccactgcgctccagcctgggcaacaagagcgaaactgtctcaaaaaaagaaaaagaaaaaaagtacaggttccatccactaaattggtttcacagctcaatactaggaagaaacccatagtgtgggaggcattaaactagtccaaacttcccattcactgatgaagaaactgtaactcagtggtgaagtttgtccgtaaaaattaaactcaggcctgttaagttccagaccagtgttctttccactaaagaccttctctgcccagtcacggccaatcacaccccgtgcccaaacacaaccctacagcgccatcgcccatcacggatgccatcctcttctccaagtcagcccctcgaagtcactgctctgggtcggagtcccctcgcggccgctgctcgtgttcccttaggtccggatcccccacagtcactaccaatcgatcagagtctccttggagtccttgccccttgatcatagtcccttgcagtcactgcctcatacttcctcggtccaagtgccgtcgcagccccggcctcgcgctctccgaggtcaccgtgtttcgcattcactgctcctgggtcacagtcccctcgctgtcactggccctcggtcacagtagcctcccagcccctggctcccactgccctcgctgtcacttaccactcttcctcagtcacagtcacctcgcggtcccagccccacagtttgtcctctcaaacagagacgcaaagataggcacacacctgcaactcacgctcccccgagcccggtccggtcggatttctggccggcgccgcgtcactgactagggaagttgaggaggttgcggggagacgcccggg

SEQ ID NO: 1606 - DNA, 27076 bp, Homo sapiens
ttcagttgtcaaactactaacatctttattttgtcaagatatttaacaatattaaaaagttcagatttcttcatggtcatgtcttttaccagcttttcaaagattcattcagtagtagaaacagccaaatgctgctacaacgcagaataaactgtcctaaaaaataaatacaacacacacacacatccagaatgttagtactaaagagggaatgagagcagcacaggcaactgaaactaacaccatctcagatctttccaattttttttttcttttttgagacagggtgtcactctatcacccaggctggagtgcagtggtgtgatctcagctcactgcagcctcgacctcctacactcaggcaatccttctacctcagcctccagagtagctaggaccacaggtgcctgccaccataccaggctaattttgtttattttttgtaaagatgaggtctcactatgttgcccaggctgttcttgaactcctgggatcaagcaatccacccatgttggtctccaaaagtgctgggatcataggcgtgagccacctcacccagccaccaattttcaatcaggaagactttttccttcttcaagaagtgaagggtttccagagtatagctacactattgcttgcctgagggtgactacaaaattgcttgctaaaaggttaggatgggtaaagaattagattttctgaatgcaaaaataaaatgtgaactaatgaactttaggtaatacatattcataaaataattattcacatatttcctgatttatcacagaaataatgtatgaaatgctttgagtttcttggagtaaactccattactcatcccaagaaaccatattataagtatcactgataataagaacaacaggaccttgtcataaattctggataagagaaatagtctctgggtgtttgttcttaattgataaaatttacttgtccatcttttagttcagaatcacaaaatgctttccagagcccagtcaaattgcttaaaacatttttaggcatttattacaagatttccacctgcctcagcaactcctgcaccactaacctcacctccagcctggtaatgatgggattaaaacaattccaactcaagtacctgatgattaaccaaaagcaaaattctttggtttagcccagctccctggctccttgggtggataactctgaactgtgttctacgacagtgctgtgataaaggacctgctttgtttttaacttccggtccttcatggaaggatgcttttgtaaaatgcaataaaaataggtaactcagaacatgaaatgaaaaaaaggaacatacaaatacagccccaatttttttcttagattcactgcacagaagattactttgtcaaattgctgtaagagtttctaaaccaacccttatactcagtgtattgtttacctcatcatggacctgtaacaaacaggtcacagagccgtgctggtctgtgcaccccactgtgagtggccctgttctacagcaccacccagagttctccaacaggactgagccctgtcatccagcagttttccgctcaataccacatgattttccctcctttctcatttcctctgcctctactaatgtttcctggaatctcccaaataaagtgctttttttttgagacagagtcttgccctctcgcccaggctggagtgcagtggcacaatcttggctcactgcaacctccgccctctgggttcaagcaattctcctgcctcagcctcccaagtagctgggactacaggcgcccgccaccttgcccggctagtttttgtatttttagtagagatggggtttcaccatgttggccaggctggtcttgaactcctgacctcaggtgatccacccgcctcggcctcccagagtgctgggattacaggcgtgagccaccacacccagcctaaagttttttattacatatttgttcatttgagtattgagtggcccccactggatgttaataggcagaaaccatgcctgtcttattcatcattttgtccctagcccctcaggtgcagaagctgacacataataggagctcagaactatttgttgaatgaatgaattgtatcatctaaagatgcattttttggccaggcccagtggctcatgcctgtaatcccagcactttgggaggccaaagcaggcagatcacctgaggtcaggagttggagaccagcctgaccaaatagtgaaaccttgtctctactaaaaaatacaaaaattagccgagcgtggtggcatgcacctgtagtcccagctactcgggaggctggggcaggagaattacttgaacctgggaggcagaggttgcagtgagccgtgatggcaccaccactctccagcctaggtgacagagtgagactccgtctcaaaacaaacaaacaagatgcatttttttttttttttttgagacagagtctcgctctgtctccaggctggagtacagtggcacaatctcgcctcactgcaacctctgcctcccaggttcaagcaattctcctgcctcagcctcccgagtagctgggattacaggcacccaacaccacacctggctaatttttgtatttttagtagagacggggtttcagcatgttggccaggatggtctcaatctcttgacctcatgatccgcccgcctcggcctcccagagtgctgggattacaggcatgagccaccgtgcctggcaaaaaaaaccatcttcttagcttgactattcccccaaagatagctgataaattaagatttacatagtacttcccactgtccagcccctgatccctagggtagttaagcataaaataaaactttggtggggctgggcgcagtggctcacgcctataatcccagaactctgggaggccgaggcgggccgatcacctgaggtcgggagctccagaccaacctaaccgacatggagaaaccctgtctctactaaaattacaaaattagccaggtgtggtggtgcatgcctgtaatcccagctactcggaaggctgaggcaggacacttcaacccgggaggtggaggttgtggtgagctgagattgtgccattgcactccatcctgggcaacaagagcaaaattctgtctcaaaaaataataaaaataaaaataaaaccttggtgagaccatagaattttagagctaaaagctaccttaaaatcatctacataagcagtgtccatatctggcagtcagcagaatcatggggaactttttaaatattctgattcactgatctaacccctggcctatttgatcagaatctatttgaatagggacccagcgtctatattttaaacaacttcccagatgatccttaggcagtcacagccagtctttgggaaaatgtacttcagcttcctaatgtcactgatacaatgtgagaaaaatccaatgacttacctgaagtcattcaattagaaagtgacagaactggagatggaatccccctcttatttctttttacttttttcttttttctttttttaatttttgagacagagtcttgctctgctgcccaggctggaatgcagtggtgcgatctcagctcactggaacctccgccaccaggttcaagcaattctcctgcctcagcctcccaagtagctgggattacaggcgtgcaccaccacacccggctaattttttgtgtgtgtgtttttagcagagaagaggtttcacaatgttggccaggctgctctcaaactcttgacctcaagtgatccacatgcctcggcctcccaaagtgctgagattacaagcgtgagccaccccacctggcctcactctcttaatttactcaatctagtttctgttctactctaactctgactctatgtattcacaacctgggagtagacgaatagaggatgcaatcctttctggagtaaatataaaataataacttcaatgaaacctcttttatgtgtgtgtgtgtgtcacccaggctggaatacagtggcacaatctcagctcactgcaacctctgcctccggggttcaagcgattctcctgcctcagcctcctgagtagctgggattacaggtgcccgccaccatgctcggctaatttttatatttttagtagagacaggctttcaccatgttggccaggctggtcttgaactcctgacctcaggtgatccgccctccttggcctcccaaagtgctgggattataggcatgagccaccgcgcctggcctgaaacatctttttaaagattcctctttatttttgcttaattttaataaatggctttaagataaagtaataaattttactactaaaaaaaaatgacctttgctcatggaatccctgccatccacatttgtttgcaacttagcaaagtgtgattggttcaaatgaacaaataagtgattttaaaattttagttataaattattactttaataaggattatcaggattgagttttagaacactgatttatggaggaagtggctaaaaataatgtttaaataatatgctaactaaataatatgctattcagaaattcaaacccatgaaaaattatgtcatatgtaaacatgtaagtttccttgcctataagcagcactctaggtttctgctttagtaacacaaaaactaacagtaaaatcatttcattcacaagtcaaagatgaatgactaagacagcagtgtctttccatcccaatcaacagtaaatagtttgatttgcggtgcccacgttcttagaaagggaaaagaggtttccaaatacacttacattcatgaaaacatcatgagtatagttgtcagtgtcagcatcccagaaacagcgagaagccatgctaaaaaatccaagaatgaagaattatcaacaatctaacaaggacctaaacgacacatatctgccacgagaaacagtgttccttaatacattctcatagatctgtacttccaaacctttcacaggtaggtacccacagagtattgtatttgtaccagagagtatactgggtaaaccggagaaactagagtcagatgaagctgcttgcaactagaggtgaccagccaggtactctgacagcctcagaccctacctgatggctacagggatcaatactagagatttgtgtgtgacttttaatgagctcagctcctgcacaataacaggacgaggaaggcacagaaagagcccaacagatttagtccaacctgatcattttatagagtcccagaaaaaggagcaaactctgaactagaattcagtcttctaacgaattataactccaaaaatatctctacagaatgctaaactaccttgaaattggctattctcctctctgcaattcttggataagaaaaaaatattagtcaaaataaaagccaattaaaaatggaaacaacttaaatgcccaataggactggattggtaaatgaaattatggtatttctcaggatctgggagaattttttaaaaaaagaaaaaagaaataatgatgttttctggcaatgaaattctatgtagaccttaaagaaaagttttgcaagacacagtgacgtgtccctgtagtcccagcaactcaggaggctgagacagggagtatcatttgagcccaggagttcagggatgtagtatgtgaagatcacacctgtgaacagccactgcacttcagcctgggagacacagcaggaccctggctcttaaaaaaaaaacaattctgcactttgggaggccaaggcgggcagatcacgaggtcgggggatcgagaccatcctggctaacacggtgaaaccccatctctactaaaaatacaaaaaattagccaggcgtggcggcaggcaccagtagtcccagctactcaggaggctggtgtgaacctgggaggcggagcttgcagtgacctgagatagcaccactgcactccagcctgggagacacagcaggaccctggctcttaaaaaaaaaattccaagaacatgaaaagctattcacaatataatgttgagtgaaaaaaataggctgggcatggtggctcacacctgtaatcccagcactttgggaggctgaggtgggcgaatcacctgaggtcaggagttcgagaccagcctgcccaacatggtgaaaccccatctctactaaaaatacaaaaattggctgggcatcgtggcacacgcctgtaatcccagctactcgggaggctgaggcaggagaatcacttgaacccaggaggtggaggctgcagtgagccaagattgtgccactgcactccagccttggcgacagagtgagactctgtctcaaaaactaataataaataataataataagtgaaaaaaaaattacaaatgttttacatttctattaaacgtatgtgtatgatttatcatgcaaacacttattgagcacttactttgtgccattcactagtctaagtgttttacgtgtattaactcactgaatcctatgaggtactataattttacccatttagtgaatgtgacaaatgaggattagagaaattaagtgtacaaggtcatacaactaggtaacaaagcttggctttgcacccaggcagttcacaacccatacccacagagaaacatacacatataccttatattatattggttcttttttttcctgaaacaaaaggtctcacatatttattactgaacccagcctactatcgcagggcatataagcaaagagaaaaaatatattcccaataaaacacgtccaactgttcagacagtggtgacgttttcagcttgctatagtaagatggccgtgaccttgatacagcgtgaatatgtgtgccagctcacgtgcagttccttatagacccagcttggctgttctgcaatgtctcctttccagttgtgcctgattttattaccagttttcaaccagatccactggagaatgggacgatttggcttttgtttcttggccaggaatcgcttactcttaaaagacttgtgagaagacatgacaagaagcagaatcaagcacacaccacaagagagagttgtttgttttttgagacaaaaatataaaatagtgagaccccaattgttttatttatttatattttatttttattttttgagagggagtctcactctgtcaaccaggctagagtgcagtggcacaatctcagctcactacaacctccacctcccgggttcaatgattctcctgcctcagccttccgagtagctgggactacacacgtgcattaccacgcctggctaatttttatattttttgtagagacagggtttcaccatgtgggccaggctggtctcaaactcctgagctcaagcaatcggcccacctcagcctcccaaagtgctgggattacaggtgtgacttggaaaaagtgtaatggtacagtttgtagcaggctaataatgctcccaccaagaacagtaagaaaagctggataaaatgaatcagggagctgccaaagcaaacaggcctagaggagccaaaattccagaaagaggtgaactctaggaggtaagctgatattccgcagcagatttttttcctggaggatttgccaattcagggcacagggctagatgctgagaatctgggccttgctcaggtaaagaacaaattactgagggaaaatttaactagtaggagagttggcagtctttactttttaaaatttttttatttattaattttactttgagacagagtcttgctctgtcacccaggctggagtgcagtggcacgatctcagctcactgcaacctctgcctccccaggccaagcacttctcatgtctcagcctcccgagtagctgggataacaggcatgcaccaccatgcctggctaatttttttttttcttttttttttttgagatggagtttcactctgttgcccaggctggagtgcagtggcacaatcttggctcactgcaaccacaacctcccgggttgaagcaattatcctacctcagcctcccaagtagctgggactacaggcacccaccaccacgcccggctaatttttgtatttttagtagagacggggtttcaccatgttgggcaggctggtctcgaattcttgacctcaagtgatccaccggcctcggcctcccaaagtgctgggattacaggcatgagccactgtgcttggccctaattttttgtatttttggtagagacggggtttcaccatattgcccaggttggtctccaactcctgagctcaggcaatctgcccgccttggccttcgaaagtggtaggattacaggagtgagccactgtgcccagcagagtcggcagtcttaacaaagctaaggaggtaaaatcagattctggagggaagatcccataaaaaaggagaaagtagaactgagcgtatcacatggtaggttttcttttcaagacatgctgaattcaggccgggcacagtggctcgcgcctgtaatcccagcactttgggaggctgaggcaggcggatcacgaggtcaggagatcgagaccatcctggctaacgtggtgaaaccccgtctctactaaaaatacaaaaaattagccgggtgtggtggcgggcgcctgtagtcccagctactcgggaggctgaggcaggagaatggcgtgaacccaggaggcggagcttgcagtgagccgagatggcaccactgcactccagcctgggcaacagagtgagactctttctcaaaaatagaataaaataaaataaagtaactagtatgactaaatcacaagggtccttacaaaagaaagagggagtaggtgggtcagagtcagagagttgaagatgctgtgctgctggctttgaaattggaggaaacggcttatgggctaaggagttcaggggcctctaactggaacagacgaggaaatggattcagtcttagagcctccagaaggaatgcagccctgctgacatcttcattttagttcaatgaaacccattttggatttctgatctccagaactgtaaagtaatatatttgtgccattttcagcactgagtttgtgataatttgttacggcagcaacaggaaactagtacactaaggaaaaagcctctgacatgaagagcaaagttttatgctgaggagacaagatctgaaagtcagcacctgttggaggtagaggcctgcagaggcctaatgaacattcgaggttcttggttgaaagacttggagggctacaattaagaaacaagggggccaggcacagtggctcacgcccataatcccagcagtttgggaggccaaagtgggtggatcacctgaggtcaggagtttgagaccagcctggccaacatggtgaaaccccatctctactgaaatacagaaattagccgggcgtggtggcgtgcgtctctaatcccggttactcaggaggctgaggcaggagaatcacttgaacccgggaggctgaggttgtggtgagccaagatcatgccattgcactccagcctgggcaacaagaatgaaactctgtctccaaaaaaaaaaaaaaaaaaaaaatagaaacaagggtgaggctgggtgtggtggctcacacctataatcctagcacttgggcacttggggaggccaaggcaggagaatcacttgagccaaggacttcaagaccagcctgggcaacatggtgaaaccccatctcaacaaaaacatacaaaaattagttgggcgtggtggctcatgcctacggtcccagctacttgggaggctgaagcaggaggatcacttgagcccaggagccagaggttgcagtgagctgagatcgcaccactgcactccagcctgggcaacagagttgagactctgtctcaaaaaagaaaaaaaaaagggatgaatttaagatagggcctttttaaaaccacaactctcagatgagttggcacaagaaaagaaaattttttaaaaagataaaactgtaacccaacctcaattcagctcagtacctgaagctaagcggccaatactcttcctgcacagcagaagagagagttaagtcctttctggaagaaaataatatcatctggaggtctataattcttttaagcaatatctaagattcaaactaggcatgccaagagacaaagccatatacatgattatcaagaaaaatacaatggaaacaaactcacacatgacccagataccagagtaagcatataacaacataaaaataactactgtggctgggcgcagtggctcatgcctgtaatcccaacactctgggaggctgagcggggcagatcacttgagatcaggagttccagataagcctggtcaacatggtgaaatcctgtcactactaaaaatacaaaaactaggcgggtgtggtggtgggcaccagtaatcccaattactcgggaggctgaggcaggagaattgcttgaacctggaaggtggaggctgcagtgagcagagatggcgccactgcactccagcctgggtgacagagtgagactctgtctcaaaaataaaataaaataaaataattagtatgactaaaatgtaaaaatagagtggggagggttaaaaaagattgaaggataaagccttttactagataactgaaatctataaaaactaaatgtaaattcccaaactgaaagatacaataactgaaattaagaactcaggttatgggtttaactgcagatcagatgcaacagaaaagaggatgattgacctaaaaggccaatagaaaaatatacaaattggccaggcacggtggctcacgcctgtagtctctgctacttgggaggctgaagcacgagaatcgcttaaacccaggaggtgaaggttgcgatgagtcgagatcacaccactgcactccagcctgggtgacagagcgagactccgtctgaaaaaagaaaaaatatataaactgaagcacagagaggaaatagaaaaatcagaaaaaagcataagagacatgtggaatactgagaaaagaccaaacatacatgtaacctaaatcctaaaaagagagcggagtggaaggggcagcagcagtgttttaaaagagaacggctacctctagggccccaagcttagtttctaatgccattctccaacacattgaacaggggctccttggagaaatggctgaattgtagggctggggtagggaatgaacacagtggagcttctgatagtgctggaaagtaaggaagtgctcaaagaaacccacaatagtagagtcagtgggacacaggaatccactgaaagctctcaatggccaagctggaacaattagaactacaaaataaataaagtagtattgaataatcatccaaagtataaaatatccatgagtccatgttgaaataaatgacagaatacataaataaatgggagaggagagacaaatttcctgtgctgaaaattccaaagaatttacgcagatacgatgcccttgaggaggtgggtcataactccctgctctttcagtgtgggctgcacacgatgatttcctcctaatgagtacaggatgaacacggaggaaatgaaaccgcctttgcaaaatgatgactgagacagtgaaagagatccaacctaaccgactccatcttgcgtctaacctccaagctgcccttgttcattcctgggcgtaggctgaactaacttggggggaaacttaatttatagtttaaaacaaagacggtaacagccctttcccaaagcagacctccttcttgccgggggactagactaacattagtcacaagattagaaatgatggtttaggagccatgcagctggaggctacaagattctgaccctccctacactgctcctaagatcagcgcttgagatattttgcagaccctgcacttgatggatcagctggcaccacccagatggataaactggctcatctgatcttgtggccccgacccaggaactgactcagcacaagaagacagctgactccctgtgattccatccctgatcaatcagcactcccggctcactggctctccacacccaccaagctgtccttaaaaactctgctccccgaatgctgggagagactgatttgagtaataataaaactccggtctcccgcacagccggctgtgcgtgaattactttttctctatggcaattcccctgtcatgatgaatcggctctgtctaggcagcgggcaagtgaacccactgagcagttatagaaagagtaagtttatagtaaagaaacctgagaagcattagctcaggcagggaggcaaagttcatatgaacagtaacatgtcatgttgacagtatgtaccattgatatgatatgacgagaatggcgtcttacctctgtgatcttccttccaaaaacctgtaacctcagactaatcattagcagaaaaatcccagtgaaggaacattctacaaaacacctaaccagtactcctcaaaaaagtcaaggtgatgaaaaacaagaaagtctgagaaactgttaccgccaagaagagcccaaagagacatttaatgtggtatcctagatagaatcctaaagcagaaaaaggacattaggaacaaactagaaatcagaacaaagctttatttgataacactgtatcaatattgtttcattaattataataaatgttccatactatgtagatgttaaccatagggagtccgggtgcggtagatgatgcctgtaaccccagtgttttgggaagccgaggcaggaggactggttaagcccaagaggtcaaagctgcagtgagccacggttgcaccactgcactccagcgtgggcgacagagcaagaactgtctcaatagcataattactattcttacagtaacagggaaactgggtgtggagtatacgctaactctgcaacttttctataaatctaaaactattttaaaataaaaacttggtttttttatttttttattttttgagatagagtttcactctgttccccaggctggagtgcagtggcgtgatctcagctcactgcaacctccacctcccaggttcaagcaattctcctgcctcagcctccaagtggctggggttacaggtgtgcaccaccatgcccggctaattttttgtaattttagtagagacagggtttcgccaggttggccaggctggtctcgaactcctgacctcaagtgatccacccacctcggtcccccaaagggctgagattacaggtgggagccactgcacctggccaaaaactgttttttttaaacaaaggtaatggctaagaattttcccaaactgataaaaaaaatcaacctggctgggtgcagtggctcacactggtaatcccaggactttagaaggccgagcatggtgttggcacctatactcccagctactcgggaggctgaggcaggagaatctcttgaacctgggaggcagagcttgcagtgagccaagatcgcaccattgcactacagcctgggagacaaaagcgaaactccatctcaaaaaaaaaacaacaaaaaaatcaatccatagattcaagagactctgagtgctctaagcagaataaatacaaagaaagtaatagtggctagagaggacataccatcttaaattgaataataaaacttacagctgacttctcaacagaaacaatggaaactagaagacaaggtaagcacttatctacctacctacctacctacctatctgaggcagggtctcactctgtcacccaggctggagtacagtggcacaatcacggcttactgcagtctcaaccttcctgggctcaagaggtcctcccacctcagtctctcaagtagctgggaccacaggcgtgtgccaccatgcccggctaatttttgtatttttttgtagagacagagttttgctgtgttgcccaggctggtctggaactcctgggctcaagtgatcctcctgcctcagcttcccaaagtgctgggattacaggtgtgagccaccacgcccggccctgatgggaaactttataatagatggatccatctgacaatatctgaactccatgatcaaccttaacaaagcaaaaagagatgaccagctattttgtaccttctgagaagatgcaataggatgtatagaaaacagtatttccccaacctcaaacctatggctaattaagactagatctaactacttattttcaagaagtacaggaaatagaagacatattaaacaataccataggtatataatcagcaactgccagaatataggaaactctacaggacaaacaaaccaatttcttcaacaaataaatggcaggaaaaaataaataaataaataactgacagggcacagtggctcacgcctgcaatcccagcactttgggaggccaaggtgggtggatcacctgaggtcaggagttggagaccaacctggccaacatggtgaaaccccatctctactaaaaatacaaaaattacctgggcgtggtggtgagcgcctgtaatcccagctactcaggaggctgaggcaggagaatcacttgaacccggcaggcagaggttgcagtgagccgagatcatgccactgcactccagcctgggtgaggaagcaagactgtcataaaaataaaatcaaatggcaggattaaaagaagaaagagagaaatgaggcagcaaaaacaacacattgaagtaaatttaaagccagatgctgtggtgtgcacctatagtcccagctacctggcaggctgaggtgggaggatcacttgagcccaggagttctagtctgtagtgtgttatgatcacatctgtgaatagccactgcactccagcctgggcaagatagcaagatcttacgtcttaaaaaaaaatcctaatttacatattaaccaaatgcaatgtgtggaccttgtttgaatcttaatttgaaaaaattgtaaaaagaaaataataggtctggcatggtggttcaagcctataagtccaccactttaggaggccaaggctggtgaattgcctgagcccaggagtttaagaccagactggccaacagagtgtgacccatctctgcaaaaaaaaaaaaaaaaaagaaagaaagaaaattagccaggtgtggtggtgcacacctgcagtcccagctactcaggaggctgaggcaggaggatcacttgagcccaggaggccaaggctgcagtgagttgtgatagtgccattgcacaccaacctgggtgacaaaatgagaccctgtctctttaaacaaaaaaaaaagaaaagaaagaaaacacatacatacatatatgaggcatatctgaataataacagcatattttatgatattaaggactgacaatattttagagataataaagatattttatttatttatttttgagacagagtcttactctgtcacccaggctggagtgcaatgacacgatcttggctcactgcaacctccacctcctgcgttgaagtgattctcctgcctcagcctcctgagtagctgggactacaagcgcacgccatcacacccggctaatttttagtagagacggggtttcgccatgttggccaggctggtcttgaactcctgacctcaggtgatccacccgcctcagcctcccaaagtgctgagattacaggtgtgacccatcacacccggcccttctcactcttgtaaaggcactcttactgaattgtccaaaggacagatacctcataagaaatatagatgactaaaacaagaaggaaaatccagctactcacaatactccttcacctctttgttctccaatcactacttgcaccaccattttgtatcggtcaaatcccatttctagaaagaaaaaataaggttatttataagcaaatatgtagtaaaattacttattgaagacaaatttgcccagaaatggacataaacattcaatccacaagtacttaatgaatatggtggtaagcttgggggtcaggaggacgtgaaggcagatcctaactataactcagcaagtgtataacctcagaaagtaatttaacttttcagtttaagtctcccttattaaacaggaatatcagtacctacctcccaagattgttataaggttaggtaagatatagtagtatcttttttttgttttgtttttgagatggattctcactctgttgcccaggctggagtacagtggcacgatctcagctcaccggcaacctctgcctccagggttcaagtgattctcctacctcagcctcctcagtagctgggactacaggtatgcatcaccacacctggctaatttttgtatttttagtagaaaaggtgtttcaccatgttgcccaggctggtctcgaactcctgacctcaggtgatccactcaccttggcctcccaaagtgctgggattacaggcgtgagccaccgcgcccggtcagatatagtaatatctaaagcatctaaacagtgctgttaaatactagtccttcaataaaccttagcttccttcctttttcccctactataagtcagctagtgagctgaaccttcaagatagagaaataaataagacgtttttcttgccttaaagaactcacagtaataaagaactcaaaggaaaatagaaaaataggccgggcacggtggctcacgcctgtaatcccagcactctcagaaggtgaggccagtggatcacctgaggtcaggagtttgagacaagcctggccaacatggttaagccccgtctctactaaaaaatataaaaattagccaggcatggtggcagatccctgtaaccccagctactcgggaggctgaggcaggagaattgcttgaacctgggaggcggaggttgcagtgagctgagatcgcaccattgcacactagcctgggtaacaagagcaaaactccatctcgaaaaaaaaaaaaaaaaagaaaatagaaaaataaattataaattgagtatgcttataattcaaggagtggcatgtatgatgtacatcaggaacacagagccagtgggggcagttcctctgtttgtctgggcagtggcaagaaatcactggaaaagacttcttggaagatgtggccggccaataaactgagtcttgagggctgagtaagaggggaccaggtcagccccatctccccacacgtccgagaacgaggggcatgtgcacagcaggagagcatgggatctccaagaaactgtaagctgttcagtaagacagacaagaaaaaaaatgaagattccagagcaaaacgaggtgatccagcaccatttagctgtttactccagaaactacgttgctaaagcagcaaaatcctgaaaattctcactaacaccaagtctgaagagaaaaaaatggaatgggcatttttgaatctttctacttttttgaccaaggaatagtggaaagagttttaaaaaaacaaaagaagtgaaataagcgaagctgaaagagccagctctctctgatgaacgtgcaggttccaagattacactgtaaacgggacaatctgaagactacaggcaatctcccatgtggggcatgaacctgattcagagtgtgtaaagacagagtccaagttatttttaaaaaacactgcacacaactcagctgagcttcctcctttctctaaccaatcccaaattatacagaaatgtgtctagaataatactcagcccttaaatcacggttctgaggggaaaataaaatagtctcagatatggtggggaggggaacttaaaaaaaaaacccacaccatatcagagcaattaaaaatcccccacatcatatcagagcaattaaaaatcccccacatcatatcagagcaattaaaaatcccccacattatatcagagcaattatgatgtatgggcacaacaaaatgaaatgcagccaaatggcaataaacaaagatgcaatagcaaaaacaaaagagtaacaaagaagaacaaagcttctgctgggtgccatggctcacgcctgtaatcccagcaattttggaggctgaggcgggaggatctcttaaggccagaagttcaagaccagcctaggcagcatgacaagaccaccatctccacaaaacaatttttctttttttcttttttttgagatggagtttcactcttgttgcccaggctgaagtgcaatggcgtgatctcaggtcaccacaaactctgcctcctgggttcaagcaatcttcctgcctcagactcccgagtagctgggattacaggcatgaaccaccacacttggctacttttgtatttttagtagagatggggtttctccatgttggtcaggttgttctcgaactcctgacctcaggtgatccatctgcctcggcctcccaaagtgctgggattacggacgtgagccaccacacctggtccacaaaacaatttttcaaaaaatattgaagaaaagaaagaaacttccagtggaaggaaggaagaaggaaggaaagaaggaaggaaggagctgtgtaagagaaaaaatttggctgggcacggtggcccacacctgtaatcccactttgggaggctgaggcgggtggatcacttgaggtgaggagtttgagaccagcctgaacaacatggagaaatcccatctctactaaaaatacattagcagggcgtggtggtgcacgcctgtaatcccagctacttgggaggctgagcaggagaatcgcttgaacctgggaggtggaggttaaggtgagccaagattgcgccattgcactccagcttgtgcaacaagaccgaaactcagtccaaaaaaaaaaagaaaagaaaagaaagaaaaaaatcaacctaggaagtaatacaaatcaaggaacgaagagttattcctcacaattaattcacaatactagaacaatgtaagcttataaactcaatgaaataagtactcaatcaggttatcaaattttttaactttttttttggagacagagtttcgctcttctgcccagggtggagtgcaatggcaagatctaggctcactgcaacctccacctcccagattcaagcaattctcatgcttcagcctcccaagtagttgggattataggcatgcgccatcacgctcggctaatttttttttttttttgcatttttagtagagacgggatttcaccatcttggtcaggctggtctcgaactcctgacctcaggtgatccacctacctcggcctcccaaagtgctgggattacaggcgtgagccaccgcacctggccaggttatgattttgtttgatttggtttggttttttgagagggaatctcgctctgtcgctcaggctggagtgcagtgggatgatctcaactcactgcaacctccacctcctgggttcaagcgattctcccacctgagccttctgagtagctgggattacaggcacgcaccaccatacctggctaaattttatattttagtagagacacggtttcaccatgttgcccaggctggtctggaactcctgacctcaagtgatccacctgcttctgcctcccaaagttctgggattacaggcgtgagccacctcacctggcctgttttgttttgtttttgtttttttggagatagggtctccctctgtcacccaggctggaatgcagtggggcgatctcggctcactgcaacctccgccttctgggttcaagtgattctcctgcctcagcctcccaagtagctggaaccataggcgtgcaccaccacgcctggctaattctttgtatttcagtagagacgaggtttcaccatgttgcccagggtggtcatgaactcctgagctcaggcaatccacccgcctcggcctcccaaagtgctgggattacaggtgtgagccacggcacccagcctcaatcaggttattaagcaacataaagagatgaaaagaaagaccacggccctagggaacaaacagaatacccagaaaagatcattccagaactaataaattcaaaatggcaagaaaaaagacacaaatgaaaacaattactggtttaagaaaatcacaagtaaatggcaataaaaaaggaagaagcctgggcaaaatggcaaaaccccgtctctacaaaaaatacaaaaattagccgggtgtggtggcaggcgcctgtagtcccagctacttgggaggcggagatgggaggattgcttgaggctgcagtgagccaagactgcgccactgcattccagcctggccaacagagtgagaccctgtctcaaaaaaaaaaaaagaagaagaaagaaattatgggaaagaaaaactaataaatatagaagacaaagatggctcaacataacaatatttggtgtcctgaagaaaaggaagtaacgaatggaataggaaacatattcagagatataaggaaatttcctttatatggaaagaataaagtctgcagattgaaagctataaaatgctcattagaaagtcagaatctttagaaaagctactgagcataaaggtgaagatgaggattattttatttatttatttatttatttatttatttatttattttgagacagagtctcgctctgttgcccaggctggagtgcactggcacgatcccagctcactgcaacctccttcaccccccaggttcaagcaattctcctgtctcagcctcccaagaaatcccagcactttgggaggccgagacgggtgggtcacctgaggtcaggagtttgggactagcaagcccggctaatttttgttttgtttttttgagacagagtttcgcccttgttggccaggcttgagtgcaatggtgcaatcttggctcactgcaacctctgcctcctgggttcaagctattctcctgtctcagcctgggattacaggcatgcgccaccacgcctggctaattttgtatctttagtagagacagggtttctccatgttggtcagcctggtttcgaactcacaacctcaagtgatccgcccgcctcggcctccctaagtgctgggattacaggcgtgagccaccatgcccagcccctaaattttgtatttttactagagacggggtttcaccatattgttcagggtggtctcaaactcctgacctcaggtaactcacctgtcttggcctcccaaagtgctgggaatacaggcgtgagccaccacgtccagccaaaggtgaggattccttaagcagagaacatcaagctgggctcagatttcttgacaacaagttaccactgaatgtcagagggcaatgaagcacaagggtcaagaaaataaattattacctcaaaactatgtatattctacttttgggggtggaggggcgggggatggagtctcgctctgtcgcccaggctggagtgcagtggcactatctcggctcactgcagactctgcctcctgggttcaagtgattcccctgcctcagcctcccaagtagctgggattacagatgcccactaccacgcccggctaatttttgtatttttcgtagagacggggtttcaccatgttggcaaggctggtctcaaactcctgacctcgggtgatccacccggctccgcctcccacagtgcctggattgcaggcgtgagccaccgcgcctggcccatagtatattctactttaaaggcaaaaggcaggcattctcaaacacaaaagaatccagggaatacggcatttctgagtcctttctgaaaacaacttacaacaaaatctcatcatctaggagttgaaataaggaactcttcccagctaattgagaggctgaggcaggagaatcacttgagcccgggaggttgaggctgcagtgatctgaaatcacaccgctgcactccagcctgggtgacgaagaccctgtctcaaaaaaagaaaataaggaactcaacaatgaaaatgacatggtcaaggaactaaacaggaggcaactgatccagttacagaatgaatatgacatgactatgggaaacaggtctacaatatcccattgtcatttgtccatgtatatggacatgtagaagtctgttgtaatgtttgcctagtattaatgattttttttttttttttgagacagagtctcactctgttgcccaggttgcagcacagtggcataatcttggctcactgcaatctccgtccctgggctcaggtgatcctcctgcctcagccacccgaatagctgggactacagatgcacaccaccagcccggctaatttttgtatttttctaagagacagggttttgccatgttggccaggatggtctcgaactcctgggctcaagagatccgcccgcctcaacctccaaaagtgctggaattacaggcgtgagccactgtgcctggccaatattaatgattgtttattggtggtggcattcaggtgatttttctcattttatttttctagtgtttaaattttgtataatgaatgtgtaccattttttacaaaaaatcttaacgatgaaccttcattaaaaagtctaaaaacaaaaatgctaatatactaacagcagttaattctgggtgatagaaatacacaggattgctattctttgtacttttctgtattttttaatttcttaaactaaaaacaaattcagaaaaaaacaataaacacaaatattaaatagtaactgcctttggttaatattttaaaactttaaggggccaggcacagtggctcacgcctgtaattccaccactttgggaggccgaggcggacggatcacctgaggtcaggagttcgagatcagcctgaccaacatggagaaaccccgtctctactaaaaacacaaaaattagccgggcatggtggcacttgcctgtaatcccagctactcaggaggctgaggcaggagaatcgcttgaacccaggaggcggagattgcagtgagccaagatcatgccattggactccagcctgggcaacaacagcaaaactccatctcaaaaaaaaaccttatggatacttttttgtattgtctaggtttattacaacgagcatgtattacttttatgaagatattctttctcttcaaaaaatgatgtcttctaagaagagcagatggaaataggccgggcacggtggctcacatctgtaatcccagcatgttgggaggccaaggcttgcagatctcttgagggtcaggagttcaagacaaaattagccacgtgtggtggcgcatgcttgaaattccaactgcttgggaggctgaggcgggaggatcacttgagcccaggaggaggaggttgcagtgagctgagatcacaccactgcactccagcctgggaaacagagcgagactctgtctcaaaaagaaaaaaaaaaaaaaaaagaacttttcagatcagacggtataacattattaacaaaagagagagaccaggcgcagtggctcacacctgcaatcccagcagtttgcgaggcctaggtgggagaatcacttgaggccaggagctcaagatcagccagggcaacatggcaagacaccatctctacagaaaaatttaaaaattaaaaaattagccaagcacggtggcacaagcctgtagacccagctacttgggaggctgagatgggaggatcgcttgagccaggaggtcaaggctgcagtgagccatgttcacaccactgcactccaccctggacaaaacagcaagaccctatttcaaaaacaaaacaaaacaaaaaaaaacaaaacaatcagagagacaaagagaacagggtaggaaaagcacaaaatatgctctacagatgtagtttggtaggggtcgagggttgagtaagggaagtagctaaggattagggaggagagatggactgcaggtactaaatgccaggctgaggacttgacagcttgggggaagaaacaaccaagaaatacaggggaaaggagtccctgtactttctggtctttctgaatactaagattttttggacagtgttttatttcacatcttcactcttttcccccatctgcaaaaacttacatgagtaaaagtcaccaaataattagagaagacaagacactgaagaaaaagttgtctttaatagaatccacagctaacattctatttacgtttttttaatagagatgttttatttttttattttgcttttttttttttttgagacagagtctcactctgtcacccaggctggagtgcagtgacgcgatctcagctcactgcaacctccacctcctgggttcaagtgattctcctgcctcagcctcccaagcagctgggactgcaggcgtgtgccaccacacccagctattttttgtatttttagtagagacagggtttcatcgtgttagccaggatggtctcaatctcctgacctcgtgatccacccgcctcagcctcccaaagtgctgcgattacaggcgtgagccactgcgcccggcctttattttgctttttaatacacatgaggtcggctgggcgcggtggctcatgtctgtaatcccagcaccttgagaggccgaggcgggtggattacctgaggtcaggagtttgagaccagcctgaccaacatggagaaaccccgtctctactaaaaatacaaaattagccaggcgtgatggtgcatgcctgtaatcccaactactcaggaggctgaggcagaagaatcacttgaacccgggaggcggagtttgcagtgagccaagatcatgccattgcactccagcctgggcaacaagagtgaaactccatctcaaaaaaaagaaaaatagacatgaggcctcaccatgttgcctaggctggtactgaactccagagctcaagcaatcttcctgccttggcatgctaaagtgttgggattgtaggcgtgagccaccacacctggccccaatgtcctttgtttaaagatggagagggggcaaatgggtaatactgactctgtgaagagaatgagtcatttccagttatcaccatgattaccttttaatttatctttaatgttttctgataaatgttttgtaagctgaggcatttcttctggagaatattcagcatttgccagttcctccttgagcacagcatggatacagtctttaaccacagagggcctgaacctgaatggaacaatttgtgaacatccagtcggtgactccacaaccccagcttaccttcataccgcaacttctcccatctttttgtcattagtaccacttaatccttctttttcatattttttattataaaatataaacaaattaagacaaatcataggccacatgtgtatcttcaacctggacctgcactgaacttcaacacattccaactcatgctccatatgaatgtttattaggcaactcaatacatccaataatgagcttctcatactcccctctcccccaaaacaaaatatatacttgttgttaattttgttctgcacgctttcacaaaataaaataaaataaaataaaataaaaaaatacggctgaatggcattctgggcattcagaaccttttaccaagataactgagggtatctttctctgtgttcattctacccaagggaaaaatcctgtatgaaatttgtatcactttttctgtgagttaccaagagaataaaaataaacaaagaaatttgtatcacattataatcaaaattcctgttttccatatttgccaagcaaatatggggtgtgtgtgtgtgtgtaaagttagtgatcttacaaacctagctgagtaccctctgctctggcccgtgagcctgacatttttttcagtgtgtgtgtgtgtgtgttgtgtggtgtgtgtgtgtgttgtgtggtgtgtgtgtgtgtgtgtaaagttagtgatctcacaaacctagctgagtaccctctgctctggcccgtgagcctgacatttttttcagtgtgtgtgtgtgtgtgtgtgtgttgtgtggtgtgtgtgtggtgtgtgtgtgtgtgtgtgtgtgtgtaaagttagtgatcttacaaacctgagtaccctctgctctggcccgtgagcctgacattttttttcagtgtgtgtgtgtgtgtgtgtgtgtgtgttgtgtgtgtgtgtgtaaagttagtgatcttacaaacctagctgagtaccctctgctctggcccgtgagcctgacattttttttcagtgtgtgtgtgtgttgtgtgtgtgtgtgtgtgtaaagttagtgatcttacaaacctagctgagtaccctctgctctggcccgtgagcctgatatttttttcagtgtgtgtgtgtgtgtgtgtgtgtgtgtgtgtaaagttagtgatctcacaaacctagctgagtaccctctgctctggcccgtgagcctgatatttttttcagtgtgtgtgtgtgtgtgtgtgtgtgtgtgtaaagttagtgatctcacaaacctagctgagtaccctctgctctggcccgtgagccttaatcctagcgagggctcgctgcggtggtctaagggcctccagatcccacccgggtaggacttcgcacagatgcagctcccgcgccgggagtgagcccatcctggcacccgtgtgcacagtcaccctcgaatcacggctgaacggcatccgacgcgagtggcttcctgcctctattctacccatctccttactcaggacgccatcgcgggtttcccagggccaaccattcccgccgcgccaccctaagacgcgcccggcgcccaaacactgaggaagcgggtggggtcccctgcggcccctgcagcgggaggggcgcccggacgtcacagcagggccgcccgcccgcctcgcggcctcccgcctcccgccccgcggaccccgcgcgtcccccgcgctccttccgtggcccaggtcccaggcgagctccgcccctcagaccagcgcgctcgaggtcgccccgccacagcccgtcctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgcc

SEQ ID NO: 1607 - DNA, 13978 bp, Homo sapiens
taagaggcaggcaagagtatttaatgggcattgagggtcttggcagtcccaccaggggagtgggcaaagggcaaggcacagaaaggcttccactcagggctcaggaagtgggaggtaaggaggcaggttcaggaggcgggttcaggaggcgggttcggaggtgagctcaggtgctggtgctgtgggcatctccgggtgcacaggggcgagaggaaggccgaacctcgcctgggggctcctgcagcagcaggggcagcactgggcccgtgtggaactaaacacagaacaggggcatgagtgctctcaacaagaccccgccccgcagctcgtgccaggtctcctgctcctggaggcaaagggagcgggctggccccacagaatgtgctgcagaggccccggggcgcaggggttgcccagccccacggtggcctcctgatgctccacctccatgtctcacggggcttcgagtcaatgtttcctttaaataaaagagtctcccgccacccgcaccccctggccaaattataaaccacgagactcatctcagtcctgcgagtaggtgactggcctgaggcccatcagcacatgtagtgggggagtcatcctccatttgtctttgtgactccagggactcctgggtgtattctagaggcctgggccctgcttccaacgcccctccagtgtagaaccctcctccccccaagctcggagcgctccagcttcagggtcagccaaacctcaggggcctccccccacaccctcacaacctgcagacacccccctcccgacacgcacagacacccacgcacacacacgcttcttacctcctggagagctgcagcctcaccacgccccgggggtcccttccctgctttgtagggacccagaggttggggctggggggttgagagcagagggggacattggagggtgcagattcggcatggatgtccagtcaggccccaccactctctgcagctggacagcttcagccatgtacctggggagcagcaggccagatgcaggggccaccgtcctccctggtccggctcccctgcccgcctcagcttgggaagcacacggcccagggcttagctctgcaggaagctgaggccagcctcatccaggatgcagcagccctgtatgccatagtggggcaggaacacacagagccaaggacgtagggaggccccagagctcccagtgccctggagaaaaccccagaggagcaggaacagtgagtgtaagggcctggggctgtggtaaggagccagggtgaacccacctctgccccacccccagggttcaccagttgggcctctggcttgccaactcacttgggtcccagtggtgcacaaattgttaaataccagttgctggcacagccctggtcgaaggggttgtatccctgaaggtgtctgcactggtcggggatggaaaccggaagaggagctcagaaccagcaggaatggctgggccatcgcccagtggccctccctgagctggtcagctagccagggctcagcccagggcaccagcaagctggaggccaggagactgaaggacctccccaccactgccccatcctcctcctcttggtctccactggccacacacatcctcctgctacctccttccagatactgaatgtcactgtctggaaggtcagttgagcaaggcccagtcgtatttccctaaccatgatcacatggcccaggaaaatctgggctaaaagccttgaacacgcaatgcggtaaaggccaagtcgtcccctgggcactcttgaccttgatcaggttctctccctcctctctccccttcgcccactcactctacccatccacctcaccccctcccaaactccctctccgccacagggcaggctgggcctcacctgacttcaagagcctttgctgtcatgttttgtcactgaaagtggcccagcagcatctctgcccaccaccaactcccctgtgtcccatgtccccgctctccgccgcaaaggctgagattttcaacaccattctccaccaaaggaaccaggactccatgcaaggacagctggcactcactggagggaggaaaagtctggacagctccataacagctcactgtcgccactcactgttgccatagggcaatacgcatccttgcactatttgagattctgcctactttaaggtatttaaagcatgtaaaagaaacgtattggccgggtgagatggctcacgcctgtaatccctgcactttgggaggccgaggcaggtggatcacttgaggtcaggagtttgagaccagcctggccaacatggtgaaaccccatctctactaaaaatacaaaaaattagccaggcgtggtggcgggtgcctgtgatcccagctactcgggaggctgagacagaagaatcgcttgaacccgggaggcggaggttgcagtgagccgagatcatgccactgcactccagcctgggcgacagagcgacactctggctcagaaaaaagaaactggtattgtattagtcatttagaagattttgattaaatttatggaatttgggccaggcatggtgattggcacctgtaatccgagtgttttgggaggtggagaagggaggatctcttgaccccagaagttcaagaccagcctgagactttcatctctaaaaaaataaaaataggtggctgtggcattgtgcacctgtagtctcagcttcttgggaggctgggatgagaggatcccttgagcctaggagttcgaggctgcagtgagctatgattacgccactgcactccagcctgaatgacagagtgggaccctgtctctagaaaaactaaaatctaataaaaatatattgacagaattttaaaatttagggatatatatatatatatgtatatatatatataatttttttttttttgagatggagtcttgctctgtcacccaggctggagtgcagtggcgcgatctcagctcactgcaagctccgcctcccaggttcacgccattctcctgcctcagcctcccaagtagctgggattacaggtgctcgccaccacgcccagctaattttttgtatttttagtagagacggggtttcaccgtgttagccaggatggtctcgatctcctgacctcgtgatccgcccaccttggcctcccaaagtgctgggattacaagcgtgagccaccacgcctggccttttttttttttttttttagacgcagttttgctcttgttgcccaggctggagtgcagtgatcataggtcctcacaaattcaaactcctgggctcaagggatcctcccacctctgtctcccaagtagctgagactacaggcatgcaccactatgcccagccaatttttaattttttttgcaggaatggggtctggctatgttgcccaggctggtcttgaactcctggcctcaagcgatcttcccacctcagcctttcaaagggctgggattacaggtgtgagtcactgtacccggcattagggaaataaatttttatttattagatgtatataaggtatagaaaaatgttgattgtatatgaggcatagaaaaatgcttaaaggaatgatgatctttaataaattcataagactgacccatacatttttcttttttttgagacggagtctcactgtgtcgcccaggctggagtgcagtggcacgatcttggctcactgcaacctccgcctcccgggttcaagcgattcttctgcttcagcctcccaagtagctgggattacaggcacccaccatcacgcccagctaatttttgtatttttagtagagacggggtttcactgtgttggccagtctcgaactcctgacctcatgatccgcccacctcggcctcccaaagtgctgggattacagccgtgagccaccgcaccgggccaaaactgaccaatacatttgtacctgcctctcccacgcaagatgctttcagatatgaatgaaaccaacagctcttggccgggcaccgtggctcacacctgtaatcccagcactttggaaggccaaggcgggtggatcacttgaggccaggagttcgagaccagcctggccaacatggaagaacccggtctactaaaaatgcaaaaattagtcgggcatggtggcatgtgcctgtaatcccaactactcaggaggctgaggcaggagaatcgcttgaacctaggaggtggaggttgcagtgagccgagatagcaccactgcactccagcctggacgacagagtgagactctgtctcaaaaaataaaaaaagaaaaagaaaccaacagctctgaagcactcagactgtccacctcactgtctccagacctggggctcctgctccgattctgtgtctgaaactgcctgacactccacgggaccaaagccagggtgagctgcttcttgctccgtctcccacccaacccccctctccccattccccgccagggatcagggcatctggcttctctctctttttgtcttttcgtccctcccaaagtgctatggattcctttgttggttggttcactcactgtttcaggaatattttggggccttaaaaatgttccaggggccgggcgtggtggctcatgcctgtaatcccagcactttgggaggccaagatgggtggagcatttgaggtcacaagttcaagaccagcctggccaacatagtgaaatcccgtctctaataaaatacgaaaatttttagtagggtgtggtggtgcacgcccgtagttccagctgcttgggaggctgaggccggagaatcacttgaacccaggaggtggaggctgcggtcagccgaggtgacgccattgcactccagccgggacaacagcgtgagagactccgtctcaaaaaggaaaaaaaaaaagttccaagggctggtctgaaagcagtggtttatctcgcctgttcagtaagttacagacccaattccttgttctactctttcctcgctgctcactactgtccttgccgtcaagaaaaaataaaaataaaaaaaggaaagttccagtcactgtgctgggggttgaggacgcactgcacacgacatatcccgggccagcctcaaccttcagggtggcgagggcagcaccgagggaaggagcaggaacccaggcagaggcgcccaggcacacgcagaggagccgcgcaggaggccagaggctgagccctgaggggcggggacaggccgcttccctgcgtgcagtttcacaagctcaagctgctgtgtgcggtccggaaagagtagtatgaggcctgaccactggctttggccgcctggtgagagcagcatccgtgtgacagtgagcacagcggccggctgaagctgccggggaagggggagagtggggcaagtgagcactgccggccctgtcaggagacttggctgctggagagcagagtagagcagcgggagtggaggctggcgatgttaagggagggttttgctttgcttttaagatgagagagacaggagcatgtgtaaatggtgatgaaaatgaatggtgccaggcgcagtggctcagcctgtaatcccagcactttgggaggccgaggcgagtggctcacctgaggtcaggagttcgagaccagcctggccaacatggtgaaaccccgtctctactaaaaatacaaaaaatcaggtgggcatggtgacgtgcacctgtaattccagctactcgggaggctgaggcaggagaatcgcttgaacccaggaggccaagatcacaccactgcactccagcctgagtgacagagaaatactctgtctcaaaaaagaaaaaaaaagaaagaaagaagaaagaaagagagagagaaattgaacggtattaatagtagcgacatctagagcactcacttgtaccagctgctactctatgtcttaaactcacccatgctgcccattttacagttggggaaagtggacgcctaggtggctaagtaatatacccaggatctctctgctggtatgctgtggagctgtgatgtgaacatgtgtgaactggatccagagaccttgctatcaaccacaggcagagttgcagcccagggatggaggaggaagggaatgagatttggggcatgtgaagaaggcctgaggcaggtgctgcgggctgcgggaaggagccctgcctggtgaatcgcaggccacgttagggtccctggaggctggagatcctggatcaggagggcagcattctgggcaggggagggagggcaggaagaaccacaggatgtgagaagggcgaaggctgcccagaaaaggctgaaacgatgcactgaggctggggagggtccacatgcagaccagagcgggctgatgaggaagggcggagctggggagtcacaggtgggggagccaaatatgggtgtggtggagtgattgaagggtgactgggatgggaggtggtgggcagagagggcgcctgtgtccttccagctgtctgatacctgcagctcctccctcatcaatgctgcccatcagttttcctagaacagccagtgacctgctgaaggagtctcatggcgcggatgtccaccctcaccactcctgctccacattgtgctagaggtccaagacagtgcaataagaagagaaaaaaataaagccatacagattggaaaagaagaagtgaaactgtcctttttcacagacaacaggatttcctatgtagaatcaacaaaaaagctattggaactaataaatgggtctagcaaaatggcaggattcaacaccaattcaaaaaaatccattgtatttccttataataatgaacaaatggaaattgaaattttaaaaaacatgcttacaatagcacaaaaaaagaaatacatataaatctaacaaaatggatacaaaatctatatgctgaaaaacacaaaataaggatgaaagacatcgaagaagacgtaaataaatggagaggtgtggcatgttcatgaattcactcaatcttgttagaatgtcaattctccccaaactgatctataggctcaatgaaattccagtgaaaatcctagcagatttttttgtaacaaataataaggaaacaatacaattttttaaatggacaaaagattggaacagacacttcaccatagttacacagatggcaaagaagaacatgaaaatatgcttaaaccattagtcattaggaaaatacaaactgaagccacactgagatgccactacacatgtcttataccggcttaaacaaaaaacaactgacaacatcaaacgttcgtaaggatgcaaagcaattggaattcttatatattacgggtaggaatgcaaaatagtaccactattttggaagacaatttggcaatttattatgaaattaaacattcaggccggacacagtggctcacgcctataatcccagcactttgggaggctgaggcaggcagatcacttgaggtcaggagttccagaccagcctggccaacatggtgaaccccatctctactaaaaatgcaaaaattagcccggcgtggtggctcacacctgttgtcttagctacctgggaggctgaggtgggaggatcacttgaatctgggaggtggaggttgcagtgagccaagatcgagccactgcactccatcctgggtgacagagtgagactccatctcaaacgaacaaacaaaaaaccacattcaattaccatatgaccccttcaagtatttaccccaaagaaatgaaaacttatgttcacatgcctgtacaccagtgtttatagcagctttatttattataatcccccaaactagaaataacacaaacatcttcaattggtaaatggataatctattgaacatccatacaatgcaataccgtacggcaatcaaaaggaataaacgactgctatgagcaacaacatgaatgaatctcgaatgtattgtgctaagtgaaagaagccagactcacaagccaacaatttcagttattctggaaaaggaaagtgataaggacagaggacagatcagtggttgccaaaagccacaggtagggggagaaattgactacaaaagaccatgatctctgatttttgggtgggatggacctgttctaaatattgattgtggtggtggctgcaggactgtatccgtgtgtcagaactcatactgtatactagaaaaggatgagtattacataggtagattattgctcaataaacgactttttgttttggtttttgtttgttttgagacagagtctggctctgtctcccaagctggagtgcagtggcatgatctcagctcactgcagcttctgcctcccaggttcaagagattctctgcctcagcctccaaatagctgggattacaggcacatgccaccatgcctggctaatttttgtattttttgtagagacagggtttcgccatgttggccaggctggtctcgaactcctgacctggcctcaagtgatccacccacctcggcctcccaaagtgctgggattgcaggtgtgggccatgcacccgtccaataaacttggcttttaagaaattctaccctggctctcataccatgatttcatcatcaagcctaaattctccacctgactttctggggttgttttgttttgtttttgagacagagtctcaatctgtcacccaggctggagtgcaatgacacaatctcggctcactgcaacttctgcttcccaggttcaagcgattcttgtgcctcagtctcccgagtagctgggactacaggtgtgccccaccacacctggctaatttttgtatttttagtagaaacagggtttcaccttgttggccaggctggtctcgaactcccagtctcaggtcatctggccacctcggcctcccaaagtgctgggattacaggtgtgagccactgcacccagcctgggcatttttttttaagacagggtcttgctctattgcccaggctggagtgcagtggtgcaatcacagctcactgactgcagcctccatctcccgggctcaaacaatcctcccacctcagcctctggagtagctgggactaaaggcacgtgccaccgtgcctggctaattttttaattttttgtagagatgaagtctcgttttgttgcccaggctggtctcaaactccggggctcaagtgatcctcctgcctcagcctcccaaagcgctagaattacaggcatgagccacggggcacagcttggaactttttcttttcttttcttttctttttttttttttttttttggaggcagagtctcgctctgctgcccaggctggagtgcatggtacgatctgggctcactgcaagctccgcctctccggttcacgccattccccagcctggacctttttaatgtggccaacagaagcagtcgacttggttgcccacaccaccttcttgccccagttagaattgtttcctctccatcctatcaacattccacagactttcaggcttccctgagtttttgcaaaggtgtcccctcacccgcaatgccctcctctccgtcttctgtctctcccgaacccctaagctgcacgtcctaccctaccatgtggtcctccctcaaccctcaatgcctgagtctgcgccacacagctcaggaccggccccctctctgagtgttcgtgggtatctggtgggtgttactctgatttcaggttcctcatcaacacgagtgtggaatgtagccttactcacctctattcccatcgctcaaagaatccaaaccgcctagcacacagtaggcccccaggaaggacagggaccactgagctcccggaggaggcgagattggagcctcttaagagctgggtctggagggacctaacgaggcaccatcgcgggtgggggtcaggctatcagggccaagggcagtggagaaagcgcgggaagcgcggaggtccccgaggtgcaagctgaccacccgcggccccgcgtaccttgcccttgtaggtgcggtcggccgagctcacggacagtgcctggatcagcagcaggagggacagcggcaccaggaggcccgcggcggacacggccaccacgatgctgcgcgggttaaggaaccgggctgcgggacccccacgcctggccccgccccccaggcccgactccgccccgagccccgccccgcccccggacgcccgcccctcaggcccgactccgccccgagccccgccccgcccctggccccgcccccaggcccgactccgccccgagccccgccccgcccccggacgcccgcccctcaggcccgactccgccccgagccccgccccgcccctggccccgcccctcaggcccgactccgccccgagccccgccccgccccccggacgcccgcccacccgccccgtcccctggctccaccctcatcccgcccacccccttgaaagcctgactccaccccgctgtccccgcccgtccagatctgcggtgcacctttagcacccgctccgtgaccccgccagattcctttttcttttcttttcttttcttttgaggcacaatcaccgctcactgcagcctcgacctccctccccggttcaagcggtcctaccacctcagccttccaggtagctgggactataggcgcgagccatcacgcccggctaatttttctatttttttgtagagacggggtctatgttgcccaggctggtctgggtctcgggctgaagcgatcctcccgcctcggcctcccaaagtgccggaattacaggcgtgagccaccgcgccggcccgggggaggcttaacgctccgccccttctcctagccccgcccatcccccgaccccgcccacctcacctcgtcccagactggtcctcccaggcggcttctccctctagccccgcccccatagccccgccctctgcagccccctccttggctgtccccgcctcctctcctgcttccccacgtgggcggatacgcgatggccttgtcggtggagaagggcaggtgggttgtgcgcaccaggaagatgagacaggtgaccagcatggcgcccgagtagaggcacagggacaggacaagcagcatgaagaagcggaagttgcggtgaccgatgcagttattgacccacttgcagtggtggtcaaagtcctgggcgacagggagaggggccaggcttgaggacttctcctctggcccaaattccatcaccccaaatcctgaggccctccccctgccttctaggccacctgcccttggcccatgcactggcttccacccccagggagaaactgagccacagaatgcctcatgctggcatttcccttgttagagcacagttaggactctggtatatacggtcacctgtcagaagacctttagagagaagactggcctggccttctgtgagacacatcctactgtaactctgggcagaacgtaaaccatctctggacctccactttctcatccattcgatgaagatgacagtaacagtaacacccttgcccagccagcctcctgcacttgtaaacctatgcaagccgtgctctcgagagagatggtcactcagagccaggagaccctccaacttggacacccaggcgaggacaggcaaggcctcccagaccaggcgggcagccagcctgaggggcttgggtatctcgtgttagcgagcccaggggtgggacagagggctgcctctcctcccctggcctgacccagcccaggacagatgcggatgccctgtgcatgtcagcacctctgcaggcaacggccagcctcccaggacaggtgcaggtggagaacacatgagtgaccaagggtggctgggagttactgccacccttggcctttagcagtcctgaaaacagcttcacacccagccctggcccctgtatgagggaggctcctggtcccagccagatgtggggcgatggctggtggacaggtagaggggcactcacctccacacagatgttgcaccaggggcagtggtaagtccggggcgggcggtggaagcagcactttggacaccattgcaggcggaaggccccgtggttcacccacaccacgtgcaccgtcaaggggccctgctcagcggagcctggcgtgggaagaggattgggcacagcagaaggccctgcggtcaccccgcggcgggggcagctccacggcatcacagggcacaaggaagggtggggacaaggtgggcaggggaacccctgtccccactgagcaagctgtccaagctcagagaggatggcagtcaaagggaagacgggtttccagccaggagagttttgtatgaaactcaggcgtttggaacagtgagtgctgctttgagtgtcattgtgtagtgaagggaggaagtgcatacagtggtttggaagagcccactggcttctggccctggcctgcccggtcctcccatctaaggcaactgggaaacctcaacaattctgtttttccacaccttggtggcttaagaaacggggtagggccgggcgcgggggctcacgcctgtaatcccagcactttgggaggccgaggtgggctgatcatgaggtcaggagttcgagaccagcctggccaatatggtgaaaccccatctctactaaaaatacaaaaaattagctgggcgtggtagcatgctcctgtagccccagctacttgggaggctgaggcagacgaatcgcttgaacctgggaggtggagcttgcagtgagcggagattgcgccactgcactcccgcctgggcagcaaagcgagactctgtctcaacaaaaagaaaaggaaagagagaaagaaagaagaaaggaaagaaggaaagaaagaaagaaaaagaaagaaagaaaagagaaagaaagaaagaaagaaggaaggaaggaaagagagaggaagaaaggaaagaaggaaagaaagaaagaaagaaaagagaaagaaagaaagaaggaaggaaggaaagagagaggaaggaaggaaagaaagagggagagagagaggaaggaaggaaagaaagaaagagaaagaaagaaagaaaagagaagagaagaaagagtgagcgagggccagagcaatgaagacgtggggtgaaggggtccagaggctggaggagggtcagtaggaagagcactttaggaatcccccctgcaggttcccagcccttgagtgacacctccttttcccagggggctgatgcctcaccttgatgtaagatgccagggtctgagaagttgagtgaaacaagactgaagaaggtaaggacaaagagggagcctgtgataacaggaaaggcccactccccgttctgagccagccacctgcaactgagaccagaggcaggctcggtcctgagcaggggcagcccaaagcccccggcccaaggcctgtggcttgctcaggtcaggacccacagaccttcaagccagatctaaaaatccaggctccaaatacccaggcagactcataatggctccaccaaatgtcaccagcatgaccagccacccaaagctcccaaaatgcacaggcacccttgacctctgcgcctttgcacgtcggttcctggaacagaatatccccttttccctgcccgcacccttgacctctgcacctttgcacgtcggttccctcgaacagaatatccccttttccctgacctctcccccggtcttctgcactcccctgcctccatcctatcatcttctgtttccctggctgtctctttgtgggaaacctaacggcttgcctggaaaactcacgggaatgcgaagaagaggccactgaaaaagaccagcagcaccacattgaaggcagcaaagaggctagggaggaaccagggacgtgggaccagaggcaggggatggggctccttcaccagcggcgtggcatccgttaagagtgtcatggctgggcctccttcgcctccaggggaggtcagagccaccaggcttcctcccccagcccagcttccagagctccatggccacggcagcctcagagccgcagcccagggtgaaag

SEQ ID NO: 1608 - DNA, 23237 bp, Homo sapiens
cgcagtcggagcactcgtacggtttcttccccgcgagtccgcctgtgggtcaggaggcaggagtcctgggagcagctttcccgcactccgcgcagccgcagggcttctcccccgtgtgagtcctctgacgcaggatgaggtgtgacttctggaaaaaggcctttccgcattccctgcagccgcagggcttctcccccgggtgggagcgaaggtgctcgatgaggcgcgacttgtgggaggttttctcacactcccaacacttgtaaggcttcgctccggcgtgaactgtgcccgggacacacaggcgtgtcttccggaagatcgttttaccacttctgtctctagcgggtttctcctttgtgtgagttccctgtttgtcagggcaaagcttctccctgaaaccactcccccgttcactgcacgcagaggacttctcccccgcgtggaccccgtgatgtaccctgaggtccgatctgcagcacaaggctttcccacacttcgtgcattcgtggggtttctcactactggctccctgagctgcaggaactccctcgtcacagcttaaagcactgccacactggtgacctccgcgtggattcgctcctgaaggtggagtttcaagtttcgaatagagaagtttccgtggccgtcgcactgaaatctcctcctcgccaggtaggcgttaggagtgaagtccaggttacacatcaaactctttctgcacaagtcacgtgtgcggacctgctgttttgatggaaggaggtttgggttctgatggagtttttttccaagttcgttacattcatgaagctcatttccggtccagtctttcttgtctagaaacgtatggctcaaatgttggtcttcgtgttgctgttggctatctggctgggtagcaacttgccaaacttcttctagaaaaaaaaaaaacaaaaccacaaactcgtggttttttttttctttgagacggagtcttactccattgcccaagctggagtgtactggcatgatcttggctcactgcaacctctgcctcccaggttcaagtgattttcccgcctcaacctcctgagtagctgggattacaggtgccagccaccatgctcagctaatttttgtattgttagtacagacaggatttcaccatgttggccaggctggtcttgaactcctgacctcaggtgatctgctggcttccgcctcccaaagtgcagggattacaggcgtgagccaccgcacctggccataaatttgttaatcttggagtactgtatcacaaaactattgcagaaaagcttgaagggaggattcattttgtggttttaagcctaattgcctgtaatcccagctactcaggaggctgaggtgggaaggtcgcttgagcctgggaggttgaagctgtactgagccatgatcacaccacggcactccagcctgggtgatggagtgaaactctgtcccaaaaagtagtaaaaccaagtgcccggtccctttcttgaggcctaggttacacagaggccttcactatccacccttcccatgttctcccgacctatgctccctttcattctgtataccaactggattttctcaaagcatgaggtcctttttgttgttgttgagatggagtctcactctgtcgccaggctggagtgcagtggcgcaatctcggctcactgcaacctcagcctcctgggttcaagcgattctcctgcctcagcctctcaattagctgggattacaggcacccaccaccacgcccagctaattttttgtatttttagtagagacagggtttcaccatgttggtcaggctggcctcaggtgatctgcctacctggacattccaaagtgctgggattacaggcttgagtcactgcacccagccatgagctctttattgttaaaggaattatcttagagctagcggcattttctgcagtgacttattctcacgtggacctatggatctttatgatgtccaacagaagaatactagagtacacacaagccatcctggcctcagattccctgctgtctcctgatgcctgtattaccacttgtttttgttttggtgacagggtctcactccgtcacccaggctgaagcatggtagtacaatcatggctcattgcagcctcaaactcccgggctccaacgatcatcccacctcagccttccaagtagctgggactacaggtgcatgccaccatgtccagctagtttttaaaattgtttttgtagatacgggggtctcactatgttacccagggttgtcttgagcttctggcctcaggcgatcctcctgccttggcctcccaatcagctgggattataaaaattagccaggcacggaggctcatgcctagtttctttttttgtagagatggagttttgctatgttgcccaggctagtctcgaactcctggcctcaagcgattcttttgcctcagcctctccaaatgctgagattacaggcatgagccaccacacctggtgtatcttcatttgcattttaaactaaagatgctacctgctgcctcacctgtgaggctcatgtccgactcaagggtgtcactcctctatttagaagttcctggctgggtgcagtggctcaagcctgtaatcccagcactttgggaagcgaacatgggcagatcacctagggtcaggagtctgagaccagcctggtcaacatggtgaaaccccatctctactaaaaatacaaaaattagccaggcatggtggcgcacgcctgtaatcccagctacttgggagactaaggcaggaggagtgtttgatcccgggaggcagaggttgcagtgagccaagactgtaccactgcactccagcctgggcgacagacaacgactctctcaaaaaaaaaaaaaaaagttcctggccaggcgcagtggctcacacctgtaatcccagcactttgggaggccgaggcaggtggatcacctgaggtcaggagttcgagaccagcctgaccaacatggagaaaccccgtttctactaaaaatacaaaaaaattagccaggcatggtggcacatgcctgtaatcccaggtactcgggaggctgaggcaggagaatcccttgaacttgggaggcagaggttacagtgagccaagatcacaccactgcactccagcctgggcaacaagagcgaaattccaacacaaagaaaaaaaaaatagttcctgagctgaactgctgatttttttttttttttttttttttttgagatggagtctcagctctgtagcccagactggagtccagtggcgcgatcttggctcactacaagctccgcctcccaggttcacaccattctcctgcctcagcctcccaagtagctgggactacaggcacctgccaccaagccaggctaattttttttattttttattttttagtagagacggggtttcaccatgttagccagaatggtctcgatctcctgacctcatgatccgcccgcctcagcctcccaaagtgctgggattacaggcgtgagccactgcgcccagcggaactgctgaatttctgagaggtaaagagcacctgttcatctccgccatcagatttctagggtgagacccatccaggggtatttttaaagctccccaagtaattttcgtgtggatcatcaattaattagcagcgtcctgaacaaacacgtgagaaagaatccttgtcctgatccaaagagagattaaaggagtgtcccccagagcttctcgaagaaacacggacaaatgaaataacagctcttctccccatggggttatactgagtacagcccattaggcagaatggagccatattacatggttttgaaagaagaatttaaaagtcatataaaaggtaatgtagtaggctgaatagtagagtaaccagatgcgtgaagtagacaaagttgacattaacctctaagatcggccaggcacagtgactcacacttgtaatcccagcaccttaagaggccggggtgggaggatcgcttgagcccaggagttcaacacaatcctgggcaacatcgtgagaccccatctctacaaaaaaaccttgaagatgagccaagtttttctttcttttttttttttttaagaaacagggtctcgcgtgatcatagctcactgcaacctcgacctcctggactcaagcgatcctccagcctcagcctcccaaagtgctgggactacaggtgacagctgccatgcctggagggtttaattacttctgattccattactggtgccagctgatgttcgatttttgtttttttgagatgcggtcaagcctgttgcccaggctggaggaaccacagcttattgcagcctcaacctcctgggctcacgtgatcctctcccctcagtccccgattagatgagactacaggcgcgtgccaccacacccggctaatttttgtatttttagtagaaatggggtttcaccctgttggccaggctggtctcaatctcctaaacccatgtgatctgcctgcctcagcctctcaaagtgctgggattgcaggtgtgagccaccatgcctggcccctgaataagcatttaatagaaaataacccagccccttcgttttctgcagcagaaacttggtgatcagcatgaatcaacgccacacgaaggtgagctgggagagagacagcaatgatttaacctcatcaagttggccaggtgcaatggctcacgcctgtaatcccagcactttaggaggccgaggcgggcggatcacgaggtcaggagatcaagaccatcctggccaacatggtgaaacaggatctccactaaaaatacaaaaattagccaggtgtggtggtgcgcgcctgtagtcccagctactcgggaggcagaggttgcagtgagccgagatcacgccactacactccagtctggcagacagagtgagactccatctcaaaaatagtcattaagtacactaaaggacaggaatagctttcaccagtttgtgggtattaagaagagaaaggggactaaattttacgtgtagcaaagatgtttttgaggcatttcacagtgaaagaaaaagatgaaaacaacaaatggcacgcccagccaaaatcccaggcttttaagaacagttgcctgaaacaagaggacatccggccaggcgccatggctcacacttgtaatcccagcactttgggaggccaaggcaggtggatcacccgagttcaggagtttgaaaccagcctgaccaacatggtgaaacccagtctctactaaaaatacaaaataagtcacgcatggtggcaagcgcctgtaatccctgctactcaggaggctgaggcaggagaatggcttgaacctgggaggtggaggttgcaatgagctgacatcgcgccactgcactccagcctgggcaactgagtgagactccatctcaaaaaacaaaacaagacaacatccatgggttctgctttgcagacttccaggaacctcatcccccggccccctgcaggccacccgctcacctgggaagctccacgtccttatctcttcctcctccatccatggctccttcccctgctccaaactggagatcacagctggtttgctgacttgacaccctgttggggagaaacagttaaaggatttgtgctgagccagctgggccttccaagcaagcagacagttcagcctgcaaaacaaaaggtggacgtctcagccacataagagctgtttcgcttggcaggataacttcacgaggactccagtgggatcgagactctgaccactgaaacccaaggccaagcacttttatttttcacacagggtcttgctctgttgcccaggctggagtgcaatggcacaatcacagctcactgcagcctcaatctcctgcactccactcaagtggtcctcctgtctcagcctcccgagtagctgggactacaagcatgcatcaccaccctcaactaattttttaatttttttgtagagatggggttttgccatgttgcccaggcaagtcttgaactcgggcctcaagtgatccttccatttgagactcgcaagtagctgggactgcaggcacatgccaccatgcctggctaattttttatttctcgtttgtatagatcgggtcttgcacctgtagctcaagcaatcctcccacctcggcctcctaaagtgctgggatcacaggcatgagccaccatgcccagcttagcccttttagtgcgtgagcagtttcccagttttatacaactaagaaaaagagttcatgtaacccgaggaccacggggaagtcttcctcacccacagagagcaggtggctgtagatctccagcatcacatcctggtacagggtcctctgctccaggtccagctgctgccactctttccgggtgaagcccacagccacgtccccgaatgacagtgacccctggaacagcacatggctgattaatgtggagtggttggcactgggtaccatggcaaaggcgtagaggagattgatcttaaaccttccgacgtcagctttccccatattaggttacataggaagctgagcacacccctaactttgtactacactttgtggaagagaaaaaaataatcattagaaaaaaaatctcgactgggtgcagtggctcacgcctgtaatcccagcactttgaggggctgaaacgggtggattgcttgaggttaggagtttgagaccagcctggccaacatagtcaaatcccatctctacaaaaaatatattagatggatatgctggtgggtgcctataatcccagctaccagggaggctcaggcaggagaatttgttcaacccaggaggcgtacgttgcagtgagccgagatcccgcccttgcactccaggctagacaacagagtaagactccatcttaaaaaaaaaaaaaaaaaaaaagcatgtgagggttggggggctttcgtcactgtggcagaggtcaaggggggatgctgggtagaaagagctgcagtgggtcccccggacacatgctgctggagtggtgagggatgttcataggcaaatgggtgacccaaagtgtccccaatggtgagacaagcgcgtgcagaggaggggcaggaagcagggcacagcccaggggcagcagcagggaccgggagctatgtgggagtggggagaggcaatccacaaagaagcccagagctctgatcaccctacggaccctgggttctcttccagaccacactctgatctctagaaaacttatgaccaagggctaaaggctgctgaagccagtgacttgtttttttgagatagggtctcactgtgttgcccaggctggagtgcaatgtgcaatatcagctcactgcaacctccgcctcctgggttcaagtgattctcctgcctcagccgcccaagtagctgggattacaggcacacgcccagctaatttatgtatttttagtagagacagggtttcaccatgaggccaggctggtctcgaactcccgacctcaggtggtccagctacctcagcctcccaaagtgctgggattacaggtgtgagctatcatgcctggcgtctacgtagtgtagtatatgtatatacattacatatatatatatatatatatatatatatatatataatcaatgtagtttacatacatgtatatatatatacaatgtctacatagtttttatacatacacatacaatgtctacatagttaattcatgtctttgtaatttctatgtaatttattcatacataatttctatataaatatataatttccatgtaaatatgtaatttctatagatatgcctcttatgggtttattcatgaaataacatatgaaaagcacagagaccacaaaagtgctggacagacagcgtttaacgcggtcattgtcatcttcagtacacagactgccctaacacagagtcactcccagtgggatttgccttcctacagtggcttctggctgggcacggtggctcatgcctgtaatcctagcactttgggaggctgaggcgggcagatcacgaggtcaggagatcgagaccatcctggctaacatagtgaaacccagtctctactaaaaatacaaaaaagttagccaggcatggtggcaggcgcctgtagtcccagctactcgggaggctgaggcaggagaatggcatgaacccaggaggcagaggttgcagtgagccgagatcgcgccactgcactccagcctgggcgacagagcaagactccatctcagaaaaaaaaaaaaaaaaaaaaaccaacagtggcttccaagaaagacaacaagcgaaacctccagcttcacccacagggcgggtgtggctcgccaccttgttctagcctctcctactgctctgagacatttctggtgtgaaacacctagacatccctggcttcacaaagcacaaagaaacccaggctctgtgaacgttttccttcctggagtggacagtggtaatgttcacgaggcctcatcttcctctgggaccaggcccttcctgcccctgtgcacagctgcctggacagagggcctaatacacctgagctaggctggaccaacagaatcctccccgaaaagctttcaaaattggatcagtgaagggagattcagtccctcacagcggcagaacttgcagctgggaggagaggagctggggctacgctatttctggccacatagagtcagcatgagaagaaagtcacagaagtgccgggtgcagtggctcacgcctgtaatcccagcactttgggaggccgaggagggtggacatgaggtcaggagatcgagaccatcctggctaacatggtgaaaccccgtctccactaaaaatacaaaaaattagccaggcatggtggcgggcacctgtagtcccagctactggggaggctgaggcaggaaaatggcgtgaacccgggagggggagcttgcagtgagctgagattgcgccagtgcactccagcttgggtgacagagtgagactccatctcaaaaaaaaaaaagaaaaagtcacagaggcagagaacagggaacaaagattcctggcgatacctggtttgccagatgcctctggagcctgactgcacacctgctcttcccaggactcgcatgctgccttatagatttttttttttttttttttttgagacaggctctcccctctgttgcccaggctggagtccaaaggcacgatcacagctcattgcagcctcgacctcctaggctcaagtgatcctcccaccttagcctcccgtgcagctgggagtacaagcatgtgccaccacgcctggctaatttttgtattttttgtagagatggggtcttgccacattacccaggctggtcttgaactcctggcctcaagcaatcctcctgcctcagcttcccaaagttctagaattactttttttttttaaatcctaacctacttctagttggatttctggcttttccaacttcaaggattagaacttctaaccagtgcagtccacactcacacattcctagaacccggggtgaagagcaggaggaggagaatgcttccaggctgatggaaaacactgatgtcactcacatgcaaagagagctaacagccaagtgggcggatcacctgaggtcaggagttcgagaccagcctggctaatatgatgaaactccatctctaaaaatacaaaaattagtcgggcgtggtggcacatgcctatattcccagctacttgggaggctgaggcaggagaatcacttgaacccaggaggtggaagttgcagtgagccaagatcgtgccattgcactccagcctgagcaacagagccagactccatctcaaaaaaattttttttaattaaaaaaacccattatggcaagcaatttcagatgagatcaggcacgttcagggtggtgtggcggtagacatggcaggctgtttcaagaacacgcagttcattcattcgttcctctagataatgcagtgttacatccaggtcacttggcaccgcacaaggctgtctctgtagacctgagtgttcggcatccccaaacaaccagaatcacagacggctgctttggcataatatctgctgtttatacagagaggaagaaaagtcacaagagatttcctgttgtgtttctttcaagatggttgttattgaggaacgggcctgctacatcttgcatacaaagatcaaatatatctttaaatgccctaaagagctgtatttcccctgagaagtagacacggttgtccaaaacagacaacacaagtcatacattagatggaatctgcctgcgtttttaaagtgacagaaatgtcagatataaatttacaaggcatcgggctgggcatggtggctcatgcctgtaatcccagtactttgggaggccgaagtgcgcggatcacttgaggccaggagttcgagaccagcctggccaacgtggtgaaaccctgtcttcactaaaaatacaaaaattagctgtgtgtggtggcaagtgcctgtaaggaggctgaggcaggagaatcgcttgaacccaggaggcagaggttgcagtgagccaagattatgccactgtattccagcctgggtgacagagcaagactccgtctcaaaaaaaaaaaaaatttataaggcatctcataactgcggcagcctctacagtctctccaccctgcccttcccacaaccttgatcttccattctcttcctgttttcaccgatcctgatttccgtttgtattttgttttatcggatacccttttttttttttttttaagacagagtctcactctgtcacccaggctgcagtgcaatggcacgatctcagctcactgcaacctctacctcctgggttcaagtgattcccctgcctcagcctcctgagtagctgggattacaggctcgtgccaccacacctgtctaattttgtatttttagtagagacagggtttcaccatgttggccaggctggtcttgaactcctgacctcaggtgatccgcctactttggcctcccacagtgctgggattaccagcgtgagccaccacgcccagcctttatcagtcatgttcttatgagcatccgaaatccctgctaaaaagggcagtagaaagaaatgccacactcacctgggccatagttcttcttctctattctggaaaagcagacacctgtgaaggcagacatcagggtggggagagaggatatgagaggccacgcttgcccttgggctcccaatcaactgctgggaccacccccgccctctcccaggcgcaggtgggagaaaacctcctctgaagggtccccattatcaaagcaaagccctcaccttacaaatgtcatagagactcaatcttgtgaggccttacttggatttttgttttgttttttgaaatggggtttcactctgtcgcccaggctggaacacagtgatgcaatcacgactcaatgcagccctggactcccaggttccagcgatcctcccaccccagcctccagagaagctgggactataggtgtgtcacatgcccagctaatatatatatatatatatatatatttttttttttttttttttgagacaagagtcttgctctttcgcccaggccggactgcagtgacgctatctcggctcactgcaagctccgcctcccgggttcacgccattctcctgcctcagcctcccgagtagctggtactacaagcgtgcaccaccatgcttgaataattttttgtatttttagtagagacggggtttcaccgtgttagccaggatggtctcgatctcctgacctcgtgatctgccctcctcggcctcccaaagtgctgggattacaagcgtaagtcactgcgcccagccatgcccagctaatttttaaattttttggtagagacagggtctcactgtattgcccaggctggtctcaaactcctgggttcaagcaatctgcctgcctcagcctcccaaaaccttgggattacaggggtgaaccaccacgactgactgaagtttttcttaatgagtatgtgcatctgtgtctcagtaaccaatgtgcaatttactacaatccccacccattacccaaaaatgtaattactagaaatttattctgaagaaacaggccggacacagaggctcacgcctgtaatcaccacactttgggaggccgaggcaggtgcatcacctgaggtcaggagttcaagatcagcttggccaatatggtgaaaccccatctctactaaaaatacaaatatcagccgggtgtggtggcatgtgcctgtaatcccagctactcaagaggctgaggcaggagaatctcttgaacttgggaggcagaggttgcagggagccaagattgcaccataccactgcactccagcctgggcgacacagcaagactccatccccctcaaaaaattataagaaaacttttttgaggggatagggtcttgctgttgcccagactggagtgcagtggcgtaatctcggcttcctgcgacctgtgcctcctgggttcaagtgattctcatgcctcagcctcccacatatctgggattacaggcacacaccagcaagcctggctaattttttgtatttttactagagatggggtttcaccatgttggccaggctggtctccaactcctgacctcaggtgatccacccacctcagcctcccaaagtgctgggattacaggcgtaagccaccatgcccggcctatttttattttttgtagaggccaggcgcggtgtttcacccctgtaatcccagctacttgggaggctgaggcaggagaatcgcttgagcctctgaggtggaggtggcagtgagctgtgatcgtactactgttctccagcctgggcaacagagtgagactccgtctaaaaaaccaaaacatatatatatgctttttgtagagtcagggtcccgctatgttgctcaggctggtctcgaactcctggcctcaagtgatcctcccgccttggcctcccaaagtgctgggattacaagcatgcatcactgtgcctggcctgtttcttgtttgtatacatcaactacaaactacagcacatgtaataagtttgtaaacatacatctataaacaaaaaattctgggccaggcacagtggctcaagcctgtaatcccagcactttgggaggcggaggcgggtggatcacttgaggtcaggagttcgagaccagcctgaccaacatggtgaaaccccatctctactaaaaatacaaaattagccgggcatggtggcgggcgccagtaatcccagctacttgggaggccgaggcaggagaatcacttgaaccagggaggcggaagttgcagtgagccaagatcgagccactgcactccagcccgggcaacaaagaaaaaccccatctcaaaaaataaaataaaaaagattctgaagaaaagacacagaatattaacaatgattatctttgcatggtaggacttttgtttggttggttttgttttggtgttttctcttcagatagggtctcgctctgtcgcccaggctggagtgcagtggcacattcacagctcactgcaacctctgcctcccgggctcaattgatcctccggcctcagcctcccaagtagctgggactacgacacatactaccatgcctggctaatttttgtattttttgtggagacagggtttcaccatgttgcccaggctggtctcgaactcctaggggctcaagtgatcctcctgcctcagccacccaaagttgctggtattacaggcatgagccgcctcactgggcggatttttttcttaacatattgatattttctaatttcttcaacaagaaattggtgctgtttcacatgtaaatatttcataacaatatacatgcattttactgggttttctccccatgggctcctatcaaagtccttcccctggtgaaagggaagccatggggagggctgaaggcagagaaggtgggacgggccaagtcttagccatgattgtggaacagtggaagaagagcctgtctggtgctcgggggccctgggtgtgagtactggctcaccctctactgtgcgtggcggttctgaatgtctctctcacacccattttgtttagtctttgacgtgagaaggagaaacaaaaaactcaggttaagaaagcaaactctggccaggcgtggtggctcacgcctgtaatcccaacactttgggaggctgaggcaggtggatcacctgaggtcaggagtttgaggccagcctggccaacatggcaaaaccccatctttaccaaaaatacaaaaattagccgggtgtggtagtgggcgcctgtaatcccagctactcgggaggtggaagcaagagaatcgcttgaacccaggaggcggaggttgcagaatgccgagatcagtcactttaaaaaaaaaaaaaaaaaaagattggctccccccgcaacccccaccccaaagaaagcaaattctatggcttgactatagtgtaggatccagggacagtgtggtccgggcttgtcctctgagcaccagggacatgctctggccctgagcccacaaacttgtactccctaaagcaagagcctctttctcctcctagcaaaccttccactcaactgaaacctagatgatccctcaacgtgaccacccagcaaacccatgtttgctctgtcccccagcgggctgggaccatttcaggcacatggaccttgggtttttttatggagttttgctcttcttgcccaggctggagtgcagtggtgcgatcttggctcactgcaacctttgcctcctgggttcaagcgattctccagcctcagcctcccgagtagctgggattataggcacccactaccacacccaggtaatgttagtatttttagtagagacagggttttgccatgttagccaagttggtctcaaactcctgacctcaggtgatctgcccgcctcagcctcccaaagtgctgggattacaggcatgagccaccatgcccagccccaggtacatggaccttgggagctgccaccctccacgtgaccctccggcttcagccctaagctatgtgaagaggtctcagaactggggtctcgctttccaaagtagattcctgctccccgttgtcaagttcttcacaggaatgcttttactcccagcatgcctgggtctcgaacacttgggcaactccacttggctgccaaggctctgctcccctactgagaacttaccttcaggtggggactcaagcttcagcctctgaggttctcgggaccagggtagaaacaagcttgctatgctgagaggagggacccaccttgctgacaaagtccgatcctgagcttttgcaaagacaccaggaaaacctgaaattaaaatgacgcagggaggctcacatgaaaatattagcacacctgtcatctcagtactttgggagcctgaggcaggacaattgcttgaggccaggagttcgagaccagcctagtcaacaaacaccccacctctacagggggaaaagaagacattggcagggttacctttaccgctgatagagagaaaccaatctgtggcagaagggaaagtcagaaagcctagaacacgagacagagtccatgctctgtttctggctttgaaaatggagggaccggctgggcacggtggctcacgcctctaatcccagcactttgggaggccgaggtgggtgcgtcgcctgaggttagcagttggagaccagcctggccaatatggtgaaaccctgtctgtactaaaaatacaaaaattagccaggtgtggtggcgcacgcctgtaatcccagctactagggaggctgaggcaggagaatcactggaacgcgggacgcagaggttgcagtgagctaagctcgcaccactgcactccagcctgggtgacagagtgagattctgtctcaaaaaaaaaaggagatcccattggaaagcaagctggtgggcttcgggagctgagcatggcccccagctgacagccagcaaggaatcggggacctaagtcttaagacagaattctgcaaaccccgaatgcactgacaagcagattcttcccagaacctctggctaaaagcccagcccagcccacgcctttctcagagcctgatgctacctggagcgtggaacccataggtgaggccaccaggatttctgacctcccaaactctgtgttagtaagtgggtgtggttttagtcaccaaatgagtggcaatctgtcatacaacaatagaaaattactacaggccaggcacagtggctcacgccagtaatcccagcactttgggaggccaaggcaagtggatcacttgaggtcaggagttcaaaaccagcctggctaacatcgcgaaaccctgtctctactaaaaatacaaaaattagccaggcatggtggtgggcgcctgtaatcccagctacctgggaggctgaggcatgacaatcacttgaacccagaaggcagaggttgcagtgagccgggattgcactgctgtactccaccctgggtgacagagtgaaactccatctcaaaaaaaaaaaaaaaaaatggcaagcataaagagcaaacctgaataccaaaagaaaaatatatatattgcagccaggcacggtggctcacgcctgtaatcccagcacttcgagaggctgaggtgggcggatcatgaggtcaggagatcaagaccatcctggttagcacagtgaaaccctgtctctactaaaaatacaaaaaaatcagctgggtatggtggcaggcgcctgtagccccagctactcaggaggctgaggtaggagaatggcgtgaacccaggaggcagagtttgcagtaagccgaaatcgcaccactgcactccagcctgggcgacagagcaagactgtctcaaaaaaaaaaaaagaaaagaaaagaaaagaaaagaaaaatacatatattgcatagatcccactgactcaaaaaacaatacaattagaaaataaaaagaatgcaaaaaaaaattaaatcaccaaatatgaaatgaatccatactcaaaaatattcccaaagaaacacgaggcctatatgtttttcaggaattttataaaactgtcttcaagacttttgcaatgtgtataagtggtttattcaggttttctatatgtcagtcaattttagcaatttacaattttctacaaatgtgtcttacttaatttcagagttatgccattaaatgatttatagtaacatctcattttttaaaaatctactggccaggcacggtggctgatgcctgtaatcccagcactttgggaggccaaggcaggtggatcacctcaggtgaagagttcgagaccagcctggtcaacatggtaaaacctcgtctctactaaaactacaaaaaaaaaaattagctggacatggtggcacatgcctgtagtcccagctactcagggaggctgaggcaggagaattgcttcaacccaggaggttgaggttgcagtgagccaagatcatgccactgcactccagcctgggcgacagagggaaactccatctcaaaaaaaaaaaaaaaaaaaaaaaagaaggccaggcacggtggcttacgcctgtaatctcagcactttgggaggctgaagagggcagattgcctgaggtcaggagttcgagaccagtctggccaacatagtgaaaccccatgtctactaaaaatacaaaaaaattagccgggcatggtggcgtgtgcctgtaatcgcagctactccagaggctgaggcaggggaattgcttgaaccagggagatggaggttgcggtggagccaagatcgcactactgcaccccagcctgggtaacagagcaaactccatctcaaaaaataaaaataaataaaaataaaaataaatctactgtatctgaaatcatctcatcttccattctaaaaatagcttattttggccaggcacagtggctcacacctgtaatcccagcactttgggaggccgacacgggcagatcacaaggtcaggagatcgagaccatcgtggctaacacggtgaaaccccgtctctgctaaaaatacaaaaaattagccgggcgtggtggcaggtgcctgtagtcccagctactcgggaggctggggcaggagaatggcatgaacccaggaggtggaccttgcagtgagccgagatcgtgccactgcactccagcctgggtgatagagtgagactccatctcaaagaataaaaaataaaaaaataaatagcttatttctattctcccttcatcagtgcagactgaagtttgtctaatttattagttttaaatacaaatcaaatttttttttggaggggggaggtttaacaaatcctttccaataagtgattttattttatttatttatttatttatttatttattttttgagacggagtctcgctctcttgcccaggctgaagtgcagtggcacaatctcggctcactgcaagctccgcctcccgggttcacgccattctcctgcctcagccccccgagtagctgggactacaggcgcccaccaccacgcccggctaattttttgtatttttagtagagacggggtttcaccgtgttagccaggatggtctcgatatcctgaccttgtgatccacctgcctcggcctcccaaagtgctgggattacaggcatgagccaccacgcccggccccagtaagtgattttagctttttaactttttacttgagtgacttgagactcaaaggaaagtctcaagaatagtacaaagaatttccaaatacccttctcatctagatctcccaaatattaacattttaccacatttgcgcaggcggctgatgaaaaaggtcccaccacaaggtggcagagtaaacacgacagcacctgggcgaggctttgtgcaggcaggaaggccctcacaccagaggccgtcccagggctgtggcatgggggccattacccaggagagggcacagggccagctcctgggtatctctgagagccttagggtccttttgttgttgttgttttgatatggaatcttactctgtcacccagtctggagtgcaatggcacgatctccaacctccacctcccgggttcaagcgattctcctgcctcagcctcccgagtagctgggattacaggcccctgccattatgcctagctaatttttgtagagacagggtttccccatgttggccaggctggtcttcaactcctgacctcaggtgatccgcttgcctcagcctcccaatatgctggggttaaaggcatgagccaccgctcccagctagccttggggtcttaatagccacatggtttgtcttatacatggccggcagatgttgggtacagtttcccaggtatgcacaccaagagatctctaaatcactacaaatctgcatgtacttgggctatgattcaaacaactggggccaggcatggtgcctcacacctgtaatcccagcactcagggaggccaaggcgagaggatcccttgagcccaggagttcaaggccagcctgggaaacatagcgagacccgtctctattaaaaaataaaacaggccaggcgtggtgggtcacgcctgtaatcccagcactttggaaggccaaggcgggtggatcacgaggtcaggagatcaagaccatcatgctagctaacacggtgaaaccctgtctctactaaaaatacaaaaaattagccaggcgtggtggcgggtgcctgcagtcccaaactactcagtaggctgaggcaggagaatggcgtaaacccgggaggcagagctggcagtgagccgagatcacggcgccactgtgctccagcctgggcgacagctcaaaaaaaaaaagatttgtaacaaaataaaacaactggggccaggcatggtggcttacacctataatcccagcactcagggaggccaaggcaagaggatcccttgagcccaggagttcaaggccaaactgggcaacatagcaagacccctgtctctattagaaaataaaaaaggccaggtgtggtggctcacgcctataatcccagcactttgggaggccaaggcaggtggatcacctaagattagcagttcaagaccagcctggctggtcttgatggtgaaaccatctctactgaaactacaaaaattagccaggtgtggtggtgggtgcccgtaatcccagctactggggaggctgaggcaggagaatcacttgaacgcggggggcagaggttgcagtgaactgagatagtgccactgcactccagcctgggcaacagagcaagactgtctcaaaaaaaaaaaaaaaatactcaatttaggtttaatgtctcatgatttgattcaggtgatacatttgtggcagaaatttttttgttttaacttgctctatttttttgttttaagtgggaaaacactttattccataaaacagagtaaatgttcctctcttccttttaatttctcctcatatgcttttagctttgggggtttgcgctttttctcttttcttttcttttttttgagactgagttgcgctctgtcgcccagggtggagtgcggtggcgcaatctctgcttaccacaagctccgcctcccaggttcacgccattgtcctgcctcagcctcccgcgaagctgggactagaggcgcccaccaccgcacctggctgattttttgtatttttagtagagacggggtttcatcgtgttagccaggatggtctcgatctcctgacctcgtgatccgcccgcctcggcctcccaaagtgctgggattgcaggcatgagccaccatgcctggcttttctcttttttaaatatctttttctgggagacacagactggacaaatgggagtggatgtgccctattcctttttatatgctaaccacctgagctgaatgtcattaagtttcattctttttatttaatacatatattaggactacaataagttaaaaagaaaaaacttaaatcaattcttggaaaggttttattaaaactaataaaataattggtttgtatttaagattaataaaatcgaccagaatccaggcacaattgagcaagagaaggcatgaaaaagacaatttcagatacggtcgaggtttgattttttttttttttttttttttttttttgagatagggtgtcactctgtcgcccagacgagagtgaagcagcatgatcttggctcactgcaacctccgcctcccaggctcaagcgattctcttgcctcagcctcttgagtagctgggattacaggcgtgtgccactactgcccagctaatttttttgggggggtatttttagtagacacggggttttaccacattggccaggccggtatccaactcctgacctcaaatgatacacctgccttggcctcccaaagtgctgggattacaggagtgagccacagcacccggccatggtcgagttttataattgtaagattactctaagcctggcgtgatggctcatgcctgtaatcccagcactttgggaggccaaggcgggcggatcacgaggtcaggagttcgagaccagcctgaccaacatgatgaaaccccatctctactaaaaatacaaaaatcagcctggcgtgggggtgcccgcctgtaatcccagctatttaggaggctgaggcaggagaatcgcttgaaccggggagttggaggttgcagtgagctgagattgtgccactgcactccagcctgggcgacagagtgagactcagtctcaaaaaaaaagaaaaaaaaaggaaaagaaaaacctctttcagtaagacccaagcgcaagtgtgatagaaaaaccaccataaaaacatttgctcttatcaagatttaaaaccatagtaccagtttcattctctccccaaatcaagtgagtttcatcttaaaaaaagcatcagacagacatcctccgccaactccatcacatcacaccaccccgagtgttgctcacctttcttcaccaagggctagaaaagaacagtctacacggaactggcgcagccgcctccttctccgccagtctccaacagaggtgctggcactgtcccgccttagtctggcgtctcccgtctccctactcaattttctcacaccctcagtccaaccctcataactctacttcctgcaggggtactttgaccaacacccaaatatgatcatgcctctgccttgaagtactgcatttgcagctggagcaagagggagaccccagcctcggaccttgctggtcaggcccccaccccgcccccagcctcacggggcgccccccctgtgccgagtcctcagtatcacccatcattactccttagggatgctcctccctggtcctcaaagaccctattgtcctttcatctgcaacatcttatttttctttaagtctgacctgaagtcagttgaccttccccagttgaaactgatcctccctcccctgggtgtccatgcatcctgacagttgaggtaactaacagggcgcctacccctggatcgcccccacatgttaacgtgaccaacacctctgtaggactgcatccaacgagggaccccagctccgtgctcccccagatcggacccaggcactcagtagatgttttgaatgagcccagacgcctgaaataacccccctccacaccctgccttcgtttccctcctagctcagtgcccaccactggctgtgatcagggttctgcatgagccaggttggagaggaagaagggggttaccctctgcaagagacggggactttccccaacagccccactcttccccctagagacccaggcaccgcagtgcagtggagatcaggggcctggatgggcagagaagctccaggggaagggacggcaacaaacccactcttggggaagagcggggtcccctgtgcagagaacaagcccccagctcacccgcgtccaagtggtcacagtggcaggtgccctgcgcgagcttccaggggacggtggggtccgaggaggcagagctgcggggaggggcagtgagatgaggggccagccgctgctcgggacccaccactacctgtggcgtcccccagcccaacttggcagcacccgacaacccgcggagacgtctggaggagccgcccccaggaccccagtgcagtgccggctctgcagcaagtgggtgccggccacgctggcgctgcgcacagcccgggagccaagacgccgttcctcccacacgtgtct

SEQ ID NO: 1609 - DNA, 31276 bp, Homo sapiens
tgcttttacgcagtgttttgaggtgcaggactgcaatgcccgcacttccggaccccagactcttcctacggcgactgacacctcagacacgcgttgtggggggcggcgctctggctccggggctgtgcccagcgcgagcgtggccggcacccacttgctgcagagccggcactgcactggggttcttgggggcggctcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcaggtgagctaggggcttgttctctgcacaggggatcccgctcttccccaagagtgggtttgttgccgtcccttcccctggagcttctctgcccatccaggcccctgaagtccactaccctgcggtgcctgggtctctagggggaagaagggggctgttggggaatgtccccgtctcttgcagagggtaacccccttttttctctcctacttggctcatgcagacccccgatcgcagccagtggtgggcactgagctaggagggaaacgaaggcagggtgtggaggggggttatttcaggcgtctgggctcattcaaaacatcttctgagtgcctgggtccgatctgggggagcacggagctggggtcccttgttggatgcagtcctacagaggtgttggtcacgttaacatgtgggggcgatccaggggtagccgccctgttagttacctcaactatcaggatgcatggacacccaggggagggaggatcagtttcaactggggaaggagtgacttcaggtcagacttaaataagatgttgcagatgaaatggcaatagggtctttgaggaccagggaggagcatccctgaggggtaatgatgggtggtactgaggactcagcacaggggaggcgcccagggccgtgaggctgggggcggggtggggggctgaccagcaaggtccgaggctggggtctccctcttgctccagctgcaaatgcagtacttcaaggcagaggcatgatcatatttgggtgttggtcaaagtatccctgcaggaagtagagttatgagggttggactgagggtgtgagacaattgagtagggagacaccagatgaaggcgtacagtgtgagcacctctgttgtagacgggtgaggagaaggaggcggctgccgcagttctgtgtagactgttcttttccagcccttggtgaagaaaggtgagcaacacttggggtggtgtgatgtgatggagttagcagaggatgtctgtctttgatgtttttttttttttttttaagatgaaactcacttgagttggggagagaatgaaactggtactatggttttaaatcgtgataggagcaaatgttttcgtggtggtggtttttctatcacgacttgcacttgggtcttactgaaagaggtttttcttttcttttttttttttttttttgagactgagtctcactctgtcgcccaggctggagtgcagtggcacaatctcagctcactgcaacctccaactccccggttcaagcgaattctcctgcctcagcctcctaaatagctgggattacaggcgggcgccaccacgcctggctgatttttgtatttttagtagagacggtttcaccatgttggtcaggctggtctcgaactcctgacctcgtgatccgcccgcctcggcctcccaaagtgctcggattacaggcatgagccaccttgcccggcctgaaggagcttttcctatgacatgtccataattcttttttgctatttttgattagtaatattggaagagatctaaatacatagcaaagtaaaagaaaatggagcctttgtactcatgatccaaattgagcagatgtcaaaagtttacttcattctgagccgaatggatgtgaaaaaaaaagtatgctgggttcagattttcttacagaactaaaacctcctaaatactgttgacgaccctttgtactctccctcactgagattaaacttaaaattgctatatatcttttattttggggggttgagtctcttgtcgcccaggctggagtgcagtggctggatctgggctcacggcaacctctgtctcccgagtaggtgggatcacaggcgcccacgaccacacctggctaatttttgtatttttggtagagacgggtttccccatgtcgggcaggctggtgttaaactcctgacctcaagtgatccacccaccttggcttcccagagtgctgggatcacaggcgtgagccactgcacctggccaaaattgatacgtgtttttgtttatttactagacaggagtgtagccataaacagtataagattgctttgtatgttcatcacctttgcctgtatttccttcagggttgtctttttcttatttttagcatttttttcatattttttagatataaattcactttgagttacagacattgcaaaaatcttgagtagaatgtaatgaattcctggtgtttccccgatggctgtattttttaggatggatccacttaatgttgagtggcttattctggttttctgtttgccagtcaattttagtaatttatattttctaggaaagtgtcccatttaattttgaatttatggcaattatttagagtaatcttataaacctcgaccatggctgggcgctgtggctcacacctgtaattgcagcactttgggaggtcaaggcgggtgtatcacatgaggtcaggagttggataccagccgggccaacatggtgaaaccccgtgtctactaaaaataccaaaaaaaaaattagctgggcagtagtggcacacgcctgtaatcccagctactcaagaggcagaggcaagagaatcgcgtgagcctgggaggcggaggttgcagtgagccgagatcacgccactgcactcttgtctgcgcgacagagtgagaccctatctcaaaaaaaaaaaaaaaaaaatcaaaccttgaccatatctgaaattgtctttttcatgccttctcttgctcaattgtgcctggaatctggtcgattttattaattttaaatacaaaccagttattttattagttttaataagacctttccaaaaattgattttttttctttttaacttattactgtagtcctaatatatgtgttaaataaaaagaatgaaacttaatgacattcagctcaggtggttagcatagaaaagagaataggggctgggcatggtggctcatgcctgtaatcccagcaatttgggaggctgaggcaggcggatcacgaggtcaggagatcgagaccgtcgtggctaacacggtgaaaccgcatctctactaaaagtacaaaaaattagccgcgtgtggtggcaggcacctgtagtcccagctactcgggaggctgaggcaggagaatggcgtgaacccgggaggcagagctggcagtgagccgagattgtgccactgcactctagccggcgcgacagagcgagactccctctcaaaaaaaaaaaagaaaaaacaagctcaaacccccgaaagtaaaagcatatgaggagaaattaaaaggaagagacgaacatatactctgttttatggaattaagtgttttcccacttaaaaaaatagagcaagttaaaacaaaaaaaatttctgccacaacgtatcacctgaatctaatcatgagacattaaacctaaattgaataatttattttttttttctttttgagacagttgctctgttgcccaggctggagtgcagtggtgtgatctcggctcactgcaacctctgccccccgggttcaagtgattctcctgcctaagcctccccagtagctggtattacagtcacccaccaccacacctggctaatttttgtagtttcagtagggacagggtttcaccatgttggccagggtggtcttgaactcctaatctcaggtgatccacccgccttggcctcccaaagtgctgggattacaggcgtgagccaccacgcctggcctgttttattttctaatagagacaggagtctcgctatgttgcccaggctggccttgaactcctgggctcaagggatcctctcaccttggcctccctgagtgctgggattacaggtgtgagccattatgcctggccccagttgtttgaatcatagccgaagtacatgcagatttgtagtgatttagagatctcttgctgtacatacctgggaaactgcacccaacatctgctggccatgtataagacaaaccatgtggctttcaagaccccaaggctagctgggcacggtggctcatgcctttaaccccagcacattgggaggctgaggcaggcggatcccctgaggtgaggagttcacgaccagcttggccaacatggggaaaccccgtctctacaaaaattcaaaaattagctagacatgatggcaggggcctgtaatcccagctactcgggaggctgaggcaggtgaattgcttgaacccgggaggcggaggttggagatcgtgtcactgcactccagactgggtgacagagcaagattccatatcaaaaaaaaaaaaaaaaaaaaagaccctaaggctctcagagatacccaggagctgtccctgccccctctccttctgggtaatggcccccatgccacagccctgggatggcctctaacctgagggccttcctgcctgcacaaagcctcgcccaggtgtgtactctgccaccttgtggtgggacctttttcatcagccgcctgcataaatgtggtaaaatgttaatatttgggagatgtagatgagaagggtatttggaaattcttcatactattcttgagactttcttttgagtctcaagtcactcaagtaaaaagttaaaaagaaaaagctaaaattacttattggaaaggatttgttaaaaacaaacaaaaatttggttgtatttaaaatgaataaatttagacaaacttcagtctgcactggtcgagggagaatagaaatcggctattttagaatggaagagatgatttcagatacagtagatagattttttttttttttttttgagacggagtcttgctctgtcgcccaggccggagtgcagtggcgtgatcttggctccaccgcaacctccatctccctggttcaagcaattcccctacctcaccctctggagtagctgggattgcaggcgcacgccaccatgcccggctaatttttttgtatttttagtagagatggggtttcactatgttggccagcctggtctcaaactcctgacctcaggcaatccacccacctcagcctcatgacttcaggcaatccgcctgcctcagcctcccaaagtgctgggattacagcatgagccaccatgcctggccttttgtttgtttgtttgttttttgagatggagtctccctctgtcgcccaggctggagtgcagtggcatgatcttggctcactgcaatctccacctcctgggttgaagcgattctcctgcctcagcctccccgagtagctggggctacaggcatgcgccaccatgtccagctaatttttttttttgtagttttagtagagacaaggttttaccatgttgacgaggctggtctcaaactcttgacctgaggtgatccacccaccttggcctcccaaagtgctggtatgacaggtgtgagccaccgcacctggtcagtagatgtttataaaaagtgagatgttactataaatcatttaatggcataaatctgaaattaagacacatttgtagaaaattgtaaattgctaaaattgactgacatatacaaaacccaaataaaccacttacacatgtcgcaaaagtcttgaagagagtttgataaaattcctaaaaaacatacaggcttggtatttctttgggaatacttttgagtatggattcatttcatatttagtgtatttagtggtttaaatatttttttgcattctttttattttctaattttattttttgagtcagtgggatctatggaatgtatgtatttttcttttagtattcaggattgcttttgatgcttgcctttttttttttttttttttttttttgagatggagtttcactctgtcacccaggctggagtgcagcagtacaatcccggctcactgcaacctctgcctcctgagttcaagtgattctcacgcctcagcctcccaagtagctggtattacaggcacccaccaccacacctggctaatttttgtatttttagtagagacagggttttccccatgttggccatgctggtcttgaattcctggcctcaagtgatccacccaccctggcctcccaaagtgcagggattataggcgtgagccactgtgtctggccaaaattgctatatatctatgtttttgtttatttactagacaggagtgtagccatgaacagtgtataagattgctttgtatgtttatcacctttgcctatatttctttaggggttgtctttctcatttatttttagcatatattttatatataaattcactttgtcttatgaacactgcaaaaatcttgagtagaatgtggtaaaattcctggtgtttccccaatggctatattttttaagatgaatccatttcatttaatgttgagtggtttattctggttttctgtttgtcagtcaattttagtaatttatattttctagaaaagtatcccatttaattttgaatttatggcaattgtttatactgatcttacaattataaacctcgaccgtatctgaaattgtctttttcatgtgcacaaatggtttatctttgccttctcttactcaattgtgcctggcttccggtcaattttattaatcttaaatacaaaccaattactttattaggtttaatcaaacctttccaagaattgattttagttttttctttttaatgtattattaaagtcctaatacctttttttttttttttttttttttttttttgagatggagtctcgctctgtcgcgcaggctggagtgcagtggcatgatctcggctcactgcaagctccgccttccgggttcatgccattctcctgcctcagcctcccgcatagctgggattgccagtgcctgccaccaagcctggctaatttttgtgtgtgtgtgtgtgtgtgtgtttttagtagagactaggtttcaccatgttagccaggatggtctcgatctcctgacctcatgatccgcccacctcggactcccaaagtgctgggattacaggagtgagccactgcacccggctagtcctaatacatatgttaaatacaaggagtgaaacttaatgacatttagctcaggtggcttccacagaaaaaagaatagggagcatctacccccattgtccagtctgtgtcttccagaaaaagatatttaaaaaagagaaaaaaagagcaaaaccccaaaggtaaaagagaatgagcagaaatttaaaaagaagggaggaagatggccaggcgcgggggctcacgcctgcaatcccagcacttcgggaggccgaggcagcaagatcacctgaggtcaggagttcaagaccagcgtggccaacatagtgaaaccccatctctactaaaaatacaaaaattagctgggcgtagtggcacgtgcctgtaattccagctacttgggaggctgaggcaggagaatcacttgaacccaggaggtggaggttgcagtgagctgagatcacgccactgcactgcagcctgggtgacactgtctcaaaaaaagaaaaaaatcttttactgtgatggaagatgtattggtttctcttccttttgtctttttggttttggattttgtgttcgtttgcagcgcatctccgtgacatacacttgctgatgctgacctgagatggaattaatatctgtttgttgctgagatggaattaatatctgtttgttgctttgcttcttttcagtgggttgttttttccgtttccatctctggctagtcttgaaggctagacttgcgtaggagagcagacacgaggacatgagccagttctgctgagctgttactgtgtaaggagcagggagcgctggagggtggttgaaccgtgtccagccaggagttgagtgggcggtgggctggtcaccatggttaccgcagtgggccactagcttcacaattccgtagcatcgctttgtgctgcgaatgggaccttccgctcttgatcccctccttgtgttgacggctgctgcttgcatctccaggcctgtgggtggaggggttctctttgtcttctcagtccagggtgggccctgggtctctgagtcacagtgatcctgtccctcccctcgtgtcaggagacctttaagcctgagcccaggatatattcctgtccctggttcaaggaggaaggcacaaggtcttgcctgtgttctggtggcaacagggttgactgccattcccctggcagcttgaggcttttgttcctcagaagagaaagttcgggagggggcttcgcatgtttccctccacggcagccgcatccctcctccagaccttcactcccaaggaagtctctctggtcttctgcccagccccgatctttctcgtgagcacccagagagcatttgtattaatcagtttatttttatgtttgttttttttgatatggaatctcgctcttacccaggctggagtgcagtggtgtgatctcggctcactgcagcctccaccccctgggttcaagcaattctcctgcctcagtctcctgagtagctgggattacaggcatgcaccaccacacccagctaattttggtatttttagtagagacagggttttgccatgttagccaggctggtctcgaactcctgacctcaagtgatccactcaccttggcctcccaaagtgctgggattacaggcttgagccactgtgcctggcccagaattttttctttatagatgtatgtttacaaacttattacatgtgctgtagtttgtagtcgatgtatacagacaagaaacaggccaggcacagtgatgcatgcttgtaatcccagcactttgggaggccaaggcgggaggatctcttgaggccaggagttcgagaccagcctgagcaacatagcgggaccctgactctacaaaaagcatatatatatatatatgttttgagtttttagacggagtctcactctgttgcccaggctggagtatagtggcgcaatcacagctcactgccacctccacctccgaggctcaagcgattctcctgcctcagcctcccaagtagctaggattacagggacaagtcacaggaagccaagattgtgccgtaccactgcactctagcctgggcaacagagccagaccccatcccccaaaaagttttcttatcattttttggggggatgcaagctcgctttgttgcccaggctggagtgcagtggtacagcacaatctcggctccctgtgatctctgcctcccaagttcaagagattctcctgcctcagcctcttgagtagctgggattacaggcatgtgccaccacacctggctgatttttgtattttagtagagatggggtttcaccatattggccaagcgggtcttgaactcctgaccttaggtgatgcacctgcctcggcctcccaaagtgtggtgattacaggcgtgagcctctgcatctggcctgtttcttcagaatagatttctaataattacatttttgggtaatgggtggggattgtagtaaattgcacattggttactgagacatagatacacatattcattaagaaaaactccagtcagtcgtggtggttcacccctgtaatcccaaggttttgggaggctgagatgggcagattgcttgaacccaggagtttgagaccagcctgtgcaatacagtgagaccgccttctctaccaaaaaatttaaaaattagctgggcgtgtgacacacctatagtcccagcttctcgggaggctgaggtgggaggatcgctggagcctgggagtccagggctgcattgagttctgattgcatcgctgcattccagcctgggtgacagagtgaaaccctgtctcaaaaaacaaaacaaaaatccaagtcaggcctcatgagattgagtccctatgacatttccaaggtgagggctttgctctgataatggggatccttcagagaaggctttctcccacctgtgcccgcgaggcggggggtgggggtggtctcagcagttgatcgggagcccacgggcaagcgtggcctctcatatcctctctccccactctgatgtctgccttcacagatacctgctttcccacaacagcaaggaagaaccatggcccaggtgagtgtggcatttctttctactgcactttttcagcagggattttggatgctcataagaacatgactaataaaggctgggtgtggtggctcacactggtaatcccagcactgtgggaagccaaagcgggtggatcacttgaggtcaggagtttgagaccaacctggccaatgtggtgaaaccttgtctctactaaaaatacaaaattagatgggtgtggtggtgggtgcctgtaatcccagctacttgggaggctgaggcaggagaaccacttgaacctgggaggtggagattgcagtgagctgagatcataccactgcacttcagcctgggtgacagagtgagactctgtctcaaaaaaaaaaaaaaaatctgataaaatgcaaacagaagtcaggatcagtgaaaacaggaagagaatggaaggtcacggctgtgggaaggacagggtggagagactgtagaggctgctgcagttgtgagatgccttgtaaattcttttttgagacagagtctggctctatcatctaggctggagtgcagtggcataatctcggcccactgcaacctctgcctcctgggttcaagcaattctcctgcctcagcctccttacaggcacctgcttacaggcacctgctaccacacacagctaatttttgtatttttagtaaagatgaggtttcaccacgttggccaggctggtctcaaactcctggcttcaagtgatctgcccacctcggcctcccaaagtactgggattacaggcgtgagccactgtgcccagcccgatgccttgtaaatttatatctgacattcctgtcacttaaaaaaggcaggcagattccatctaatatatgacttgtgttgtctgttttggacaaccgtgtctaattctcggggggaatacagctctttcaagatttaaagatgtatttgatctttgtatgtaagatgtggcagacccgttcctcaataacaaccaccttgaaagaaacacaacaggaaatctcttgtgacttttcttcctctctgtataaacagcagatattatgccaaagcagccgtctgtgattctggttgtttggggatgccgaacactcaggtctacagagacagccttgtgtggtgccaagtgacctggatgtaacactgcattatctagaggaacgaatgaatgaactgcgtgttcttgaaacagcctgccatgtgtaccgccacaccaccctgaacgtgcctgatcttgtctgaaattgcttgccataatgggttttatttttttaattaaaaaatttttttgagatggagtcttgctctgtcgcccaggctggagtgcagtggcactatcttggttcactgcaatctctgcctcccgggttcaagtgattctcctgcctcagcctccggagtagctgggaatataggcatgtgccaccatgcccgactaatttttgtatttttagagatggagtttcatcatattagccaagctggtctcgaactcctgacctcaggtgatccgcccacttggctgttagctctctttgcatgtgagtgacatcagtgttttccatcagcctggaagcattctcctcctcctgctctgaaccccgggttctaggaatgtgtgagtgtggagtgcactggttagaagttctaatccttgaagttggaagagccagaaatccaactagaagtaggttaggattaaaaaaaaaaaaagtaattctagaactttgggaaggtgaggcaggaggattgcttgaggccaggagttcaagaccagcctgggtaatgtggcaagagcccatctctacaaaaaatagaaaaattatccaggtgtagtggcacatgcctgtactcccagctgcaggggaggctaaggtgggaggatcacttgagcctaggaggtccaggctgcaatgagctgtgatcgtgcctttggactctagcctgggcaacagagggagagcctgtctcaaaaaaaaaaaaaaaaaaaatctataaggcagcatgcgagtcctgggaagagcaggtgtgcagtcaggctccagaggcatccggcaaaccaggtatcgccaggaatctttcttccctggtctgtgcttctgtgactttttttttttttttttttttgagacggagtcgcgctctgttgcccaggctggagtgcagcggcgcaatctcagctcactgcaagctccccctcccgggttcacaccattctcctgcctcagcctccccagtagctgggactataggcacccgccaccacgcctggctaattttttctatttttagtagagatggggtttcatcatgttagccaggatggtctcaatctcctgaccttgtgatccgctcacctcagcctcccaaagtgctgggattacaggcatgagccactgcacccggcgcttctgtgactttcttctcatgctgactttgtcagtgtgcccagaaatagtgtagccccagctcctctcctcacagctgcaagttctgccacggtgagggactgaatctcccttcagtgatccaattttgaaagcttttcggggaggattctgttggtccagcctagctcaggtgtattaggccctctgaccaggcagctgtgcacaggggcaggaaggggctggtcccagaggaagatgaggcctcgtgaacattaccactgtccactccaggaaggaaaacgttcacagagcctgggtttctttgtgctttgtgaagccagggatgtctaggtgtttcacaccagaaatgtctcagagcagtaggagaggctacaacaaggtggcgagccacacccaccctgtctgtgaagctggaggtttcccttgttgtctttgtcggaagccactgttttttgttttttgttttttggagagtgagtctcgctgtgtcactcaggctggagtgcagtggcgcgatctcagctccctgcaacctctgcctcccgggttcacgtcatgctcctgcctcagcctcctgaaaagctgggagtacaggcgcccgccaccacgcccagctaacttttttgtatttttagtagagatggggtttcaccgtgttagccaggatggtctggatcttctgacctcgtgatccacccgcctcggcctcccaaagtgctgggagtacaggcgtgagccaccgcgcccggccagaagccactgttttgtagaaagccgagtcccactgggaatgactccctgttaggggaatctgtactaaagatgacaatgactgggttaaatgctgtctgtccagcactccgtggtctctctgcttttcatatgttatatcatgaataaacccatgagaggcatatctatagaaattatatatttacatggaaattttatgtttatatagaaattagatatgaataaattacatagaaattaagacattatgtagacattgtatgtgtatgtataaaaactacatagactgtctatatatatactagacatgtatgtaaactacatagactatatatatatatatatatatatatatatatataatgtatatacatatacatacactacatagactcgtgatagctcacgcttgtaattccagaactttgggaggctgaggtaggcggaccacctgaggtcaggagttcgagaccagcctggccacatggtgaaacccgtttctactaaaaatacataaattagctgggtgtgtgcctgtaatctgaggtactcaggtggctgaggcaggagaatcacttgaacccaggaggcggaggttgcagtgagccgatattgtacattgcactccagcctgggcaacacagtgagaccctatctcaaaaaaaaagtcactggcttcagcagcctttagcccttggtcataagtttttctagagatcagagtgtggtctggaagagaacccaggctctgtagggtgattggggctctgggcttctttgtggattgcctctccccactcccacatagctcccggtccctgctgctgcccccgggctgtgccctgcttgttgcccctcctctgcacgcgcttgtctcaccactggggacaatttgggtcgcccatttgcctatgaacatccgtcatcaccccagcagcatgtgtccagggggcccaccacagctctttatacccagcatccccccttgacctctgccacagtgatgaaagccccccgactctcacatacttttttttttttttttttttttttttttgagacagactcttgctctgtcacccaggctggagtgcagtggcacgatctcggctcactgtaagctccgcctcctgggttcaagtgtttctcctgcctcccgagtagctgggattacaggtgcctggcaccatgcccagctaattttttttttttttgtatgtttagtagagatggggttttaccatgttggccaggctggtcttgaactcttgccctcaagtgatccacctgcctcggcttcccaaagtgctgggattacagacgtgagccaccctgtctgatctccttcaaattatttaaactttgattaaacaacatagtgagaccccaactctacaaaaaatttaaataaaaccagctggcctatgcctgtaatcccagctactcgggaggctgaggcgagaggatcacttaaacccaggaggtagaggctgcagcgagccatgatcacaccactgcactccagcctggacagagagagaccctgtcccaaaaagagaagatctaaggccaggggcagtggctcacacctgtaatcccagcactttgggaggctgagacaggtggatcacctgaggtcaggagttcgagaccagcctgaccaacgtggagaaaccctgtctctactaaaaatacaaaattagccaggtgtggtggcacaagcctgtaatcccagctactcaggaggctgaggcaagagaattgcttgaacccagcaggcagaggttgcggtgagccaaggtggcaccattgcactccagcctgcgtgacaagagtggaacaccctctccaaaatagaaaatctctctttctctctatatatatctctatataatatataaatagataatatctatatgttatatatatattttatatacatcctcatattttctaataggtataaattgaagatgtttaaatgggggtctttaattcattgagagaggggatgggatgggtgaaggaggccaagccctgttctgcatctgtggaaccccttctctgcatttctcttgctgttttaattttgagcactagcttacattgaggattagaatcatgtgataatttagctcctgctatcctcccttccggtggctcccaccttttttccacatcagatcatctgtagttcccctccgtaaataccgtgaggtgggagtctgcatttcctacagggaaaaaaaaaatcacttctacccgtggctggtacgctctctccctctcccacacacgccttacacccggcattttcattctctttgtagtttctacgagacttttctgtgcctcctttgcccatgccaggcctcttgctaggaatatccttcagacatcagatcattctgtttatctttcgtgattctactcccctgtgatctcctaggaagcttcacttgacagtacgttggatctggctgctgtcttcctcgtgcccattctgtatgtaactacatgtctaccaccgcctatagtgtaatcttacggtacagctgtcttcctgtgttcatctggcagcaacactcctaactaccttcagaacaggaacaattttgtgttcagccctcgaccccaagcgcctggtagaacaccagcagtgtgcgaggtccctgaaagacacttgatcattgaaggaatgaatggagatccagtagtgagatttatttatttatttttgagatggagtctcactctgttgtacagcctggggtgcaagggcgggatctcagctcactgcaagctacgcctcctgggttgaagcaattctcctgcctgagcctccctggtagctgggattacaggcacccaccagcacgtccatctaatatattttttgtagagatggggtttcaccatgttggccacgctggtctcaaactcctaacctcaagcaatccacctgtctcagcccctcaaagtgctgggattacaggcgtgagccactgcacccggttgatattttttctaacaattttttttttctcttccacaaagtgtagtacaaagttaggggtgtgctcagctttctatgtaacctaatatggggaaagctgacctcggaagggggtaagatcaatctcctctacgcctttgccatggtacccagtgccaaccactccacattaatcagccatgtgctgttccaggggtcactgtcattcggggacgtggctgtgggcttcacccggaaagagtggcagcagctggacctggagcagaggaccctgtaccaggatgtgatgctggagaactacagccacctgctctctgtgggtgaggaagacttccccgtggtcctcgggttacatgaactctttttcttagttgtataaaactgggaaactgctcacgcactgaaagtgctaagctgggcatggtggctcatgcctgtgatcccagcacttcaggaggccgaggtgggaggattgcttgagccacaggtgcaagacccgatctatacaaacgaaaaataaaaaattagccaggcatggtggcatgtgcctgcagtcccagctacttgcgagtctcaaatggaaggatcccttgaggcccaagttcaagacttgcctgggcaacatggcaaaaccccatctctaccaaaacattaaaaaattagttgagggtggtgatgcctgcctgtagtcccagctactcgggaggctgagatgggaggatcacttgagtgcaggaggttgaggctgcagtgagctgtgattgtgccacttcactccagcctgggcaacagagcaagaccctgtgtgaaaaataaaagtgcttggccttgggtttcagtggtcagagtctcgatcccacttggagtcctcgtgaagttacctgccaagcgaaacagctctctgtggctgagatgtccaccttttgttttgcaggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccaggtgagcaggtggcctgcagggggccgggggatgaggctcctggaagtctgcaaagcagaacccatggatgttgtcttgttttgttttttgagatggagtctcgctcagttgcccaggctggagtgcagtggtgcgatgtcagctcattgcaacctccacctcccaggttcaagccattctcctgcctcagcctcctgagtagcagggattacaggtgcccgccaccatgtgtgacttattttgtatttttggtagagactgggtttcaccatgttggtcaggctggtttcaaactcctgaactcaggtgatccacctgccttggcctcccaaagtgctgggattacaggcgtgacccatggcgcctagccggatgtcctcttgtttcaggcaactgttcttaaaagcttgggatcttggctgggcatggtcgctcacacctgtaatcccagcactttgggaggccaaggtgggtggatcatgaggtcaggagatcaagaccatctggctaacacggtgaaaccccgtctctactaaaaattagctgggtgtggtggcacgcacctgtagttgcagctactcaggaggctgaggcaggagaatcgcttgaacctgggaagcagaggttgcagtgagccgagattgtgccactgtgctccagcctgggtgacagagcgagactcatctcaaaaaaaaaaaaaaaaaaaaaccctggatctttgcaagcagctgtggacatttggccttaaaccttgagatgccttagtgatcctgccacctgcacacatcactacacgattcctttcctgtctctggattttagagaaaggcatagtctatttttttcttttttttttcttttttttgttttttttttttttgagacagtctggctgttgcccaggctcgagtacagtggtacgatcttggctcactgcaacctccgcctcccaggttgaagtgattctcctgcttcagcctcctgagtagctgggattacaagcacgtgccaccaccatgctcggctaaattttttttttttttttttttttttcagtagagatggggttttgctatgttggctggccaggctggtcttgaacttctgacctcagatgaccctcccacctctgcctcccaaggtgctgggattacaggcgtgagccaccacgcctggccctcttttttcttgttttgagagactgtcttgctttttcacccagactggagtgcagtggagtgatggtagctcactgcagcctccaactcctgggctcaagtgatcctcttacttcagcctccttagtagctgctacttcaggcacatgccatcacactgagccactgagctcattttttttttcatttttgtagagatggggtctccctatgtcgtccaggatggtctcaaactcctaggctcaagcgatcctcctgccttagcctcccaagtagctgggactacaggcatgagccatatgcctgaccatctattttcatttgtcctttgattctgctctgctgtcccccactaagacctcgattgccaagtcttcctgtagaatcttcagtattttccctgtggttataaaacaggttttctcctgtgttcagagattcattgatctgccctatgttaaaatagctgttattttgtgctatttgttcttcttttcatcgttttcttttactgtgaaatgcctcaaaaacatattttctacacgtataatttagtcgcctctctcttcttcacacccacaaactggtgaaagccattgctgtcctttagtgtacttaatgactttatttatttgtttttgaataaataatccagtgttgcccacactggagtgtagtggcatgatctcggctcactgcaacctctgcctcccgagtagctgggcctacaggtgcgcaccaccatgcctggctaatttttgtatttttagtagagataccgtttcaccatgttggccaggatggtctcgatctcctgacctcgtgatccgcccgcctcagcctcctaaagtgctgggattacaggcgtgagccactgcgcccggccaacttgatgaggttaaatcactgctgtctccctcccagctcaccttcgtgtggcattgattgatgctgatcaccaagtttctgctgcagaaaacgaaggggctgggttatttggagctggcaccatcttttctattaaatgctcatttaggggccaggcatggtggctcacgcctgtaatcccaacagtttgagaggctgaggcaggcagatcacatgggtttaggagtttgagagcagtctagccaacgtggtgaaaagccatttctactaaaaatagaaaaattagctgggtatggtggcatgtgcctatagtgtcatctaatcaggggactgaggggagaggatcacttgagcccaggaggttgaggctgcaataagctgtggttcctccagcctgggcaacagagcttgaccgcatctcaaaaaaacaaaaatcgaacatcagctggcaccagtaatggaatcagaagtaattaaaccctccaggcatggcagctgtcacctgtagtcccagcactttgggaggctgaggctggaggatcgcttgagtccaggaggtcgaggttgcagtgagctatgatcacgcgagaccctgtttcttaaaaaaaaaaaaaaaaaaaagaaaagaaaagaaaaacttggctcatcttgaaggtttttttgtagagatggggtctcacgatgttgcccaggattgtgttgaactcctgggctcaagcgatcctcccaccccggcctcttaaagtgctgggattacaagtgtgagtcactgtgcctggccgatcttagaggttaatgtcaactttgtctacttcacgcatctggttactctactgtccagcccagtacattaccttttatatgacttttaaattcttctttcaaaaccatgtaatatggctccattctgcctaatgggctgtactcagtataaccccatggggagaagagctattatttcatttgtctgtgtttctgcaagaagctctgggggacactcctttaaatccctctttggatcaggacaagaattctttgtcacgcgtttgttcgggacgctgctaattaattgatgatccacaccaaaatcacgtggggaacttcaaaaatatccctggctgaatctcaccctagaaatctgacgggggagatgaacaggtggtctttacctctcagaaattcagcagttcagctcaggaacttctttcttttttcttttttttttttttgagacggagtttcactcttgtagcccaggctggatgcaatggcacgatctcagctcaccacaacctgtgcctcgcaggttcaagcgattctcctgcctcagcctcccgagtagctgggattataggcatgtgccaccgcacctcgctaatttcttgtatttttagtagagaggggggtttctgcatgttggtcaggctggtctcaaactcctgacctcaggtgatccgcctgcctcggactcccaaagtgctgggattacaggtgtgagccaccgcacctggccaggaactttttttttttttttgagagagagcctttctctgtcacccaggctggagtgcagtggcacagtcactgcaacctccgcctcctaggatcaagcagtcctcctgccttagtctcccaagtagctgggattacaggcacgcgccactgtgcctggctaatttttctatttttagtagagacagggtttcaccatgttgaccaggctggtctcagactcctgaccccaggtgatctgcccaccttggcctcccaaggtgctgggattacaggtgtgagccactgcacccagccaggaacttttttttttttcttttctccttttatttttttgagacagtgtttcgctcttgttgcccaggctggagtacacaatggcatgatctcggctcactgcaacctctgcctcttcggttcaagtgattctcttgtctcagcctcccaagtagctgggattataggcatgtgccaccacgcttagctaattttgtactttcagtagagacgggggtttcaccatgttggtcaggctggtctcaaactcccgacctcaggtgatccgcctgcctcggcctcccaaaagtgctgggattacaggcgtgagccactgtacccagccaggaacttctaaacagaggactgacatccttgagtcagacataagcctcagaggtgaggcagcaggtagcgtctttagtttaaaatgtcaataaagatacaccaggtgtggtggctcatgcctgtaatcttagcatttggagaggctgaggcaaaagaattgcttgaggccaggagttcgggactagcctgggcaacatagcaaaactccatctctacaaaaaaagaaactaggcatgagccactgtgtctggctaatttttataatcccagctgattgggaggccaaggcaggaggatcgcctgaggccagaagctcaagacaagcctgggcaacatagtgagacccccatatctacaaaaacaattttaaaaactagctggacatggtggcatgcacctgtagtcccagctacttgagaggctgaggtgggaggattgccggagcccggaaatttgaggctgcagtgagccatgattgcactaccgtgctccaacctgagtgacggagaccctgtcaccaaaacaaaaacaacaaagtggtaatacaggcatcacgagacagcagggaatctgactctgaggccagggtggcttgtgtgtactctagtattcttctgttggacatcataaagatccataggtccatgtgagaataagtcactgcagaaaatgccgctagctctaagataattcctttaacaataaagagctcatggctgggtgcagtggctcacgcctgtaatcccagcactttggagtgtcgaggcaggcggatcacctgagaccaggagttcaagaccagcctgacgaacatggtggaaccctgtctctactaaaaatacaaaaaattagctgggcgtggtggtgggtgcctgtaatcccagctgctcgagaggctgaggcaggagaattgcttgaacccaggaggctgaggttgcagtgagccgagattgtgccactgcactccagcctggtgaaagagtgagactccatctcaacaacaacaaaaaggacctcatgctttgagaaaatccagttggtacacagaatgaaagggagcataggtcgggagaacatgggaagggtggatagtgaaggcctctgtgtaacctaggcctcaagaaagggaccgggcacttggttttactactttttgggacagagtttccctccatcacccaggctggagtgccgtggtgtgatcatggctcagtacagcttcaacctcccaggctcaagcgaccttcccacctcagcctcctgagtagctgggattacaggcaattaggcttaaaaccacaaaatgaatgctcccttcaagcttttctgcaatagttttgtgatacagtactccaagattaacaaacttacggccaggcgcagtggctcacgcctgtaatccctgcacttcgggaggccaaggccagcagatcacctgaggtcaggagttcaagaccagcctggccaacatggtgaaaccccgtctctactaaaaatacaaaaattagctgggtacggtggctggcacctgtaatcccagctactcaggaagctgaggcaggagaataacttgaacctgagaggcagaagttggagtgagccaagatcactccagtacactccagcttgggcaacggagtgagactccgtctcaaaaaaaaaaaaaaaaaaaaaaaaatccccacaagtttgtgttattttttctagaagaagtttggcaagttgctacccagccagatagccaacagcaacacgaagaccaacatttgagccatacgtttctagacaagaaagactggaccggaaatgagcttcatgaatgtaacgaacttggaaaaaaactccatcagaacccaaacctccttccatcaaaacagcaggtccgcacacgtgacttgtgcagaaagagtttgatgtgtaacctggacttcactcctaacgcctacctggcgaggaggagatttcagtgcgacggccacggaaacttcttctctgttcgaaacttgaaactccaccttcaggagcgaatccacgcggaggtcaccagtgtggaagtgctttaagctgtgacgagggagttcctgcagctcagggagccagtagtgagaaaccccacgaatgcacgaagtgtgggaaagccttgtgctgcagatcggacctcagggtacatcacggggtccacgcgggggagaagtcctctgcgtgcagtgaacgggggagtggtttcagggagaagctttgccctgacaaacagggaactcacacaaaggagaaacccgctagagacagcagaagtggtaaaacgatcttccggaagacacgcctgtgtgtcccgggcacagttcacgccggagcgaagccttacaagtgttgggagtgtgagaaaacctcccacaagtcgcgcctcatcgagcaccttcgctcccacacgggggagaagccctgcggctgcagggaatgcggaaaggcctttttccagaagtcacacctcatcctgcgtcagaggactcacacgggggagaagccctgcgactgcgcggagtgcgggaaagctgctcccaggactcctgcctcctgacccacaggcggactcgcggggaagaaaccgtacgagtgctccgactgcgggaagacctcccggaaggcgaacctcatccgccaccacgggatccacacgagggagaagctgcatgggtgaagagaccgtgggatcgtcacaaagtcacatcacgaggtcgccgaacctctaggagggacatcgccagggaaacagccctcaaccaaaactacgacgccaccctaggcagaggtcccatatcggggtgaaattcggccactttggtggcttaaggaaggcatggtcagctgggcgctgtggctcacgcctgtaatcccagcgctttgggacgccgaggcgagtggatcacctgaggtcaggagttcaagaccagtctggccaacatggtgaaagctcggctctactaaaagtacaaaaaattagccgggaattgtggcaggcgcctgtaattccagctactcgggaggctgaggcaggagaatcggttgaacctgggaggcggagattgcagtgagtcgaggtcgcaccactgcactccagcttgggtgacagagtgagactcagtctcaaaaacaaacaacaaaaaagcatggtctgttaaaactaacgacggaagggtaatggtatgctagagtgatctattttcgtaggtgtactttttttttttgagacggagtcctcgttctatcgcccagtctggagggcagtggtgccatctcggctcactgcagcctctgcctcccgggttcatgtgattctcttgtttcagcctcccgagtagctggtattacaggtgcctgccagcgtgccgggccaattttttgtgtttttagtagagatggagtttcaccatgttggtcaggctgttctcgaactcctgacctcatgatctgcccacctcagcttcccaaagtgctgggattacaggcgtgagccactttagccaggatatacttaattataaagacaactgtggatatgaagtttttttttcttttgagatgaagttttactcttgttgcccaggctatgggaagaaatgaaatcattacgactaacagatctaaaaagcgtgagaacatcccagagggacgcaggggtgtgttccaagtgtgctacagacagataatttttatttttgtgttgcactggtgaacagaacataattgtgaatctgtagacatacataccataatatatagaagatctatggatactttctatgctaaattatacccttctgtgtttgtgatatagaactggaataagatgaatatattattaaagcagagaggcccactgcagcagcacataccatttcttctgtttgtcatcacgtattacagagcccctgaacttggaagctaacaatttcatgacatctgataactcacagtcaactagtttataagttatatttttggctgggctcggtcgctcacacctgtaaacccaacactttgggaggctgaggcaggcagatcacatgaggtcaggagtttgagaccagcctggccaacacggtgaaaccccgtcactgaaaaatataaaaattagctgagcatgctggtgattttctgtaatcccagtaatcccagctacttgggaggctcaggcacgagaattgcttgagcccagcaggcagaggttgcagtgagctgagattgtgccacttcattccagcctgggcgacagagcaagactctgtctcaaaacaagttatatttctatattaggactccattttctggcaatacggtggaccgtctaaagtgaaaatcaccggggcagtggctcgtgcctgtgatctcagcacttgggaaagtcaaggtggacaggtcacttgaccccaggagttcaagaccagcctgggcaacacggtgagaccctgtctgtaccaaatacatatatatattagctgggcgtggtggcacgtgcctgtaggaccaggtacttgggaggctgaggtgggagaatcccttgagcccaggagtttgaggctacagtgagccatggtcgtgccactgcgcaccagcctgggtgacagtgagaccctctctcaatagaaatgaagtgaaaacccactgaaaacaactggacatgacggacaacaaccgctgacatccttttagatacataattcagctctcaggaaaataagtatccaggtgccagctatgtagaaggtactgaaaaacaaagtctgtgagttgatgctgtagctgttctatgggtttttgtttacttggaacttgaatgttaaatggtatagaagggtaagaaacaagaacttgggggctacacaagacagaactggccttgaaataactcagatgcgcagaactttccacaggctgtacatcaagggagacggcagactggagacagaaagcttgcctgtctgtccttgggctctgggtagggcaagattttacctggatgagtccatgtgcactggcctgcatgtcatctaagttagaatttgaacttgccctactcatgttccaattgagaaactgaacaatcaggccgggtgcagtggctgtaatcccagcattctgggaggctgaggagggtgaatcacccgaggtcaagagtttgagaccagcctgcccaacatggtgaaaccccatctctactacaaatacaaaaagctgggcgtgatggcagacgcctgtagtcccagctactcgggaggctgaggcaggagacttcgctcgaacctgggaggcagaggttgcagtgagccgagatcgcaccactgcactccggtttgggcaacaagcaaaactcttgttaagaaaaaaaggtagacacagcatgagtccacttatataaggtacctagaatagtcaaactgataagagacagaaaaaaagtaaaacgttggttatcagagcttgggggtaagggggatggagagtgagggttaatggggacagtttcagtttgggaagatggaaaagtgctggagatggatgatggtgatggttgtacaatattttgtttttctcttttttttttttttgagatggagtctcgctctgtcgccccaactggagtgcagtggtgcaatctcggctcaccgcaacctccacttcccgggttcaagaaattctcctgcctcagcctcctgagtagctgggattataggtgcacaccaccatgtccagctaatttttgtatttttagtagagatggggttttgccacgttggccaggctggtcttgaactcctgacctcctgcccgccttggcctcccaaagtgctggtgttataggcgtgagccaccatgcccagcctggttgcacaatatttttgatgtaataaatgccactgaattgtaccctcaaaaatagcgaaaatggcaaattttatgttacgcatattttaccacaattaaaaaaaaaaaagtgtaggatccactcccagctggtgctctggccctgccctggccccacagtggaggaaggtgcttctctcccattaacgtggacacgccttgaccaggactttgagcgtgtggtttttcccttccctagcccgggcctcggaccttctatgacaatccgctttcctcttatatgtgattttactttcccagactggaacatttgctttctgttcactttactgaacaacacttagacatccaacctctctctgtcctctctcttccctgaagcttccttggcacacaacacacctaggcaagcctgggtgggtacaggagtggttcactgcatccctggaacaggctcaggggttttcgggcataaaggcctcctccctggcttgatggtcaacctgtgcccagtgtcacatccatcaaatgactttgtatttcacagcttctcttccacccccactctcttgggagaggtcaggcccttccagcccagagtgggggtcagtgtggacctgggatttgatgtatactctaagcttggggaaaaaaaatggttaaaaagtcccccaagggcagcaggaaatcgggctctggtcccagatgcatttgtgatgaaagggattagactctgcagctcctgttaaaatcaaccaccgcgtccatgggttgatccaagaattctgtgcaaagtctgtaaaactccgtccttggtcttgcttgctttaatgacagtctttcacatttttgtcctaacatgtttcttctcagcctgatttttttaacaaactggcaactttgaaatgtaaaacagtgaaatctagaattttctcccagagaaaacttttccagagagaacacacacacacacacacgcccatcaattgagaaccatatgctaagagcaactatgtttactttacaaaagaataatgtcttggctgggcacggtggttcacgcctgtaatcccagcactttgggaggccgagacaggcagatcacttgagctcaggagtttgagaccagcctgcgcaacatggtgaaaccctgtctctacaaaaaaaattagccggacgtggtagcatgtgcctgcagtcccagctactcaggaggctgagatgggaggatcgcttgagcctgggaagtggaggttgtggtgagccaagattgcgccacggcactccagcctgggagacagagtgagatgctgcctcaataacaataatcacaacatcttgaaataaccgtttctgtctctttcttgccactggagacagaagagttagccaggttgcagttttttttcccgttcctcactcctggagacacccaggccactgggttctgagctccttgtctccagggagttaagatgaacatgctagagtcagcttgcttcaagtctcagctctaccatttgctaactttgggtaaatcattcaagcctcagtttcctcatctgtaaaacaagattatcaatgtaactacatcctacatggagtaggcagcagactacaagggtctctcgagaccagcagaggcaacatagtcttgctctgtcacccaggctggagtgcagtggtgcgattatagctcactgcagccttgaacttctggggctccagcgatcctcctgccttatcctcccaagtagctgggactacgggcacatgctatcacgcctcactaactttttaactttttcatagagatggggtctcgctctgttacccaggctggtctcaaactccttgcctcaagcattcctcttgcctctacctccccaagcagtgggattacaggcgtgagccactgcacctggctaatttttaaatttgtagcagagatgggtgtcgcacgatgttgcccaggctgagtctatattttcatacggtcattattccccatgttaaacttagaggcaaagtcttattattatggttgtagttgagaaaacctgggctcagcaatataataaggttcatctgaggtcagccagtttatagcacacctgagttgggactggaccccacccccccacccccccaccgaccccccgccctcaactcttctgtcgggtataaggtgctgcctacataatgcaaaatatccacagtaaattacagcgaggtgaggctggagctgtagtctgcatgacaaagcagtctttaacacacaaacacactgcagtaatcactgtgtacagtattcccctgtgagagttagttggcttttaggttgaaaataagctgagtctctgaaacaagaaacatgtcagattgctttgccaaaaagagattcacacaattttttttgagacactgtcttgttctgttgcccaggctgagtgcagtgatgcaatcatggctcactgcagcctcgacctcctgggctcaagtgatcctcctgcctcagcctcctgagtagctgggaccacaggcatgcaccaccgcacctggctaattttttattttttgaagagatagagcctcactatgttgtccagtctggtctcgaattcttgggctcaagcaatgctcccgtctcagcctcccaaagtgctgggattactgggattacaggcatgagccatagcacccggcctcagacacgtaggacgaaatctccaaactgcttctctataaaggacagagggtgactcaagaacatgagctcggccaggtgtggtggctcatgcctctaatctcagcactttgggaggccaaggtgggtgggtcactggaggtcaggagttcgaggccagtctggctaacatggtaaaaccccatctctactaaaaatacaaagccaggcacgatggcaggtgcctgtaatcccagctactcaggaagctgaggcaggagaatcacttgaacctggggggcggaggttgcagtgagccgacatagcgccattgcactccagcctgggcgacagagtgaaactccatctcagaaaaaaaaaaaaaaacgtgagttcaaggaacctgaccctcacgctgtcttatttccaccttgggcgtttatttccttgtttatttgtgtttcttttctcctccccagaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagtaaaggctgtcactctatcttgggcg

SEQ ID NO: 1610 - DNA, 22584 bp, Homo sapiens
tcagtctcagatttaaaaaacatttattttaataagactattgcaaacacattaaaaaaactaaatagtaatattacaaaatctatatacttgcacatttagtatttgtcaatgtgccagaggttttcttcatgaaatttgacttctttgaagtgaaggcttttttccatcatctcttatagctctgactgaataagtcttaatgctttcttcatgttttctatcactgaaataagagttaatatatattatgctattaataaatgaaagtacaaatgctatgatctattaactctagaacctgaaattggcccatttaaattaatagctttgaacatgggaattcgtctatgacattaaagaatatgctaaaagtgtacatgtaaatttagggattagaccattgagagctggttggtcaactttatgttgaacaatttcatcagaggggttttgaggagtacctctttttttttaatgcatcactttgtattagtattgctagatcttacaggcacagttgtcttattaaatatagttgataatgaatgttgtaaaaaatagatttggccaggcatggtaggtcatgcttgtaatcccagcattttgggaggctgaggtgggaggatcacttgaggccaggagtttgagaccagcctgggcaacataccaagaccctgtctctacaaaaaagaaaaaaaaaggattaaagtcctaggtaagactgtacctccttgcttataggcattaaagaaagatgaaatgattttactatcatttgatgaaatcacatgagatctttgatactaggagaatggactgtctcaagtttgtgtcattttaatgtgtactatattctttttagtgagctcagaatttagtaatcctaaaatcccttagacatccctgttaaaatagattctgaggtacccccaaaattctgattttggtgggagctagaagttggcatttaaacaccaccactagcctcagtgactggtgtgtagaagcactgatgtagggcttcactagcccttaacaaatagtcaggggtcagctatgaccactgtttgagatcatttgtgaatacttacataggggtaaatcccgaggctcatatgtgtacaatctgttagagtatcttccagctatgtcagctctaactgttaaagaagggtctgtcaaggaaaaaaccaagtcacgaaagtataatttagcatgttcttttctttactcttgtaaaaacttaattattattttatatgtgggggttatgtgtacaagtttgttacacagatatattgtgtgatgctgaagtttgggcttcagctgaacccaacaccctaatagtgaacatagtagccaacagttagtttttcatcctttggctccctccctccttcccccgttttggagttcctattgtctatttttcctctctttatgtccatgtgtaaccagtgtttagctcatatttatatgtgtgaacattcactatttggttttctgtttctgtgttcatttgcttaggataatggcctctggctacatccataaaacgttcttaaaatcatttttgtttcttaatctaaaacaaatgtcaaaccaatttataatctaaaacaaatgtcaaaccaatttataagcaaaattagttttcatacatgtcagttcatgaattaacctgaattctccttttagtgtgtcataggtctctgtcaatctagtctggggcactgtgttgaaagtacattgggatatagatttaatagcatacatgctttgaaaaaatatttaaaattttcaaattacagatatagtggattttgattgtagaactaacaagagctgatattattggattagaaatgacttctctttaaaaagaatagtacttgaactagcatttaaaaataaaagcaagaatgctgatttctactaattttgtagatctgatgaaatgagatcacatacatacctacaaacatgattctaggcacatattgcccatcaggtgataaattcttatcagtggtttcatgctagcaggagaagaaaaaaaaagaatgttattggattcatttgtttttgatagtttcaagatgattttgtgtgactgtcagtaaattctattttggccttttataattccatacaactttctgtattaaccaatatttagctctttgtgctttaaaaatagaaaaaaaggaggctgggcatggtggctcatgcctgtaatcccagcactttgggaggctgaggcgggtggatcacctgaggtcaggagtttgagaccagcctaaccaacaaggtgaaaccctgtctctactaaaaatacaaaaattagctgggcatggtggcaggtgcctgtagtcccagctacttgggaggctgagacaggagaactgcttgaaccagggaggctgaggttgctgtgagcccagattacgccactgcactccagcctgggtgacagagcgagactctgtctaaaaaaaaaaaaaaaaaagaaaaaaacggattcaaaatttccatgaaattatagtattaagaaaacatcacaaagtttatgtaccataaggtttagcatgatgaacttattctgagccatttcttgtatttcttcattttgggcaaatactttctttagtgctataggggaaaacaaaattgccagttagttttaaggatcaagagacctttaatgtaacatagcaaaataaagctaatatttagcatttgtttgcatatataactcaggtgtaaatattaatagttcattggcctattgccactttgtccctcattggaaagcaatgagggacagtctgttcaaggagacatcaaaggataatcacagtgaagacactagtttttataattttatgtaactcattgactcattggttaagacaacgactttttttcagtgtttctacaccttctcagctcacccctttcttttcatgggaagaagaggaatatgtaattcccaagggaatataatagaaatattcagtagattggtaacaatcattgtggtctttaagcaccttagtaaaatgatggtactctggcagttgtctattttttttaatgggatttgctgagcgccttcttagctattattaccaggtcacttttcctattttatattggaaatattatatattataataagatatcaggggctaaaattaccttgagagtattgacaatcctccaggtgatgaataaccattaatggcttcttactaaacaaagaaagtatggaattaagtcaaatgattaactttgggtcaaaatatacagtagagttagatttaaaattttattagcttcaataaggcttacagtagtaatctcagatttacaaatcatagcactatagtcaatagcagtgttactctatttgtggcctcagaactgatagtatcagtatcactaggtagcttattaggaatttaaattcaaaggctccgttcccaaatcaggaaagcctccattccaaaattagctgggcacagtggtgtgagcctgtagtcccagctgctctggaggctgagacatgagaatcgcttgaacccaggaggtgaggttgcggtgagccgagatggcgccactgcactccagcctgggtgacagagcgagactctgtctcaaacagacaaacaaacaaaaaaccaaaggcttcatcccagacccactcaatcagaatctctggggttaggggtggtttcaggaatctgtagcttaacaaacttattaggtaattcttatgtactctatagtgcagttagagaaaatcaattctgtatccagagataaagggttattatgaacaatgtattcatttccaatgaacacttagtataagatttcaggaaagtcaaagacttttacatttagttttttaaaaagtttttacaaaaaagctgttaatatttggctattttcacatcctttcattcttgcacgttgcagaatatacaaacaacctgagtgggagttccctatttcatacatttttggggggtcattttgattttaaccataaaaagttaaaaagataaaaattcttcctcctactgctaacttctataactatgctgtattactttttcttatattttctcccagaggttttcaggtcatataactgaaaatctatatgaatatgtttatatattgtatatacccagatgcatgttcacatttatgtgtatgtatttctttttaaaaaacaaaaatactagcacacaagtatctacattttgcttttaaaatataaatcttagatatgccactgttcttttatattatattctattatattaatattttatcttattagtctccccaaagatggatatttaaattgtttccaatctcttgtgtttagattgttcctaaacatttacatttgtacacttatttgctaaacatgctttttttttaaggcacgcagtttctttacacccataattgcatcctaaactcttgtatagttcatatttacagccccccataaagtttttgcattctgaattagtccttcacattttgatatttggcataatgttcaaacacactttatacacactgacctctccttaaaccactcatagatttaataaatcctacagaaaaacattcagagattacttgaaagcttgatcttctatttacttcaaggtgacagaagagttagtttttcgtgatgaaagactacaggaacggagaattaacaaactgttgtgtaattcatcagagaagtatattaactctgctgaagtaccactgaatgaaacaaaaatgaatctgtgaagtagcaatctgattagcaggctggcttctatgtcccatcactctcatagtcttctattattatattttcttccacgtctccttgggctgaaaagagctgaggctggctggcaggcagttcactggcactattctgactcagaggaagagaccaggtttccagctctgtgtcctgtgcgggttcacccagagattcctctgcagaatgtcctccgttaagctgggcttcatctccactgtcagggtcgatcattccatgttccctgtcagtcagggcttccattttcagtcttccgaagtgttgcttcagagggagccttccaatatcttggataagagaaatctgagcttgatttctcattggaatggttattagagcaaggtatggcagtagctgagtttggaggcataaagctggtaggcagaagtcaggaaaaagtgcttttgctgccaggcaattttccccatactttttatgtattagaaaccactgcggtgtgtgcgagggtcaaaaacttgatccttctccttggcaatgagcatatcctccggctttgttggaatgtatcacacctcttgtagctatagatgtcctatatttcctgagtaaagagcgtgtattccagtcaccactgaggatacctgcaaaacttagaaattcactggctctcacaatatcatcaatttccatgaagaagtctatgtagttttggtgaagatataaattaaataagtctcctggcatgtgtgacatttctactacctcctcaggttcaacaagtatgtatcctgttcatattctgataaatgagagggcaaccaagatgagtctgattctgttaaagatgctcttttactgtataaaattttccccaaagctcggaagagaaacagagaaacgtctttgccaccagtagcttggacctcttgactttcaaaaaccctatcagttttttttctttgttttgattttgacagcgtagcatttgattttaaagacattctttttttccttggccataagttgttttctccttttgaagaagaaatctggaggctgtttattgcacttctcatatcaccagaacatccttgacagagcacctctagagaagttttgtcagggacagtaatttttcctccattcttgttagcctctatagtcactattcgattaagaaatttcatcgtaattgttggtgccacagggttgaaactaatatttgaggtagaatgctcttcccgaatttctttggggaacaagaaactttgattatttttaccactgagactgtcacagattataaatataaaaggatatcgaccaatcttcacatacttccttagaacttcatgtaaagtatgagaatccctataaactggttaggtaaatcttcaaccagaattatcttcttatcagttctcagatgatctccaagcatttgtaacttgttatactttgttgctcttagtagaaactctttgcaaactgctatctgagactgatagggaaacatatggaagcttgattcagtatgaaacatttccttgaaatcatctttttggaaatctggtaaaactggattaatccactcttgtacttgaataccattctcctttgatagcgtttttttggtcgttgtctttccacatccaggaggacctgttattaataaaatagatccatcctgttttggttgcctttctaagacttgagctttttaccaggtttcaacttcttcaattatcttttcatgcacagccaagttcatgctaactttctggtttatatttatctacccatggttcattttcagacagatagtcttttgaattttctaaaccatatatctgttctaaggaagacagatttcctatttttctagctggaaatatcttactttctaatgtagaaggctcatttttttctctatgacttgagttattcacacctaatgatgtggcagtaatagtagagatgtctctatactctagaaaatcattgaatgatgggtcaatccagtctgttacctttgtggaagatatctttggtctaagaaaagtttttgacattataaactgtaatagttcccatccatagtataggacctgtagtacattaaactataattcacctcctttaaaaagcaggtaactgtccctgaagatgccaggttcctgaaatgagagaccatgctgttgttttaaaaaatgattttgcacataggtgggtatgtttgtgaatacatttccagaagtagaatttctgagtcagagtgtgtgcatttataattctgatatatactctccatagaagctgtaccaattcatattctctctggtagtgtgagcagtaattgtttttgctattctcactaaagctggttattagtttaaattttttttatccaacaggtgaaaagagggaaacgaatgtggtttgtctttcttataaaaaatagtcaatcttatatgtttgagttacttatttttctgttctgtgaacttccatattctttgctcatttttttctgttgacttgttgacctttttcttgttaatatataggagtacgttgtatattagagaaagtcacccttctaatatgtgctgcagttttccatttaaaagaatatttttcctttgtaagtttttggttatccagaaaattccgtgtaattgaaaatattagtaatttctttttagactttttcttttatcttctccttttctttgtttggctatgctcaagcctagcagacagcactagcatgaggccaggggagcatctacaggactaaaattagaggctttatttttgtaccccaggtatctttcttgcctcactataatcttggctctcccctattccaagcatttaaagaaataaaattttgcagtggtatcttctagcaccttaatgatttaattttcataattatatctttctaatttatttttgcataaatgtgagatatggatacaaatttatttgtttttcccagatgactatcaacttctgacactaattattacataatctgtctcccctattcctgatttaaaataccacttcctgtattaaaaaattcctgtagtatctatctatctatggagtttgtcaactacctatcaataatctatttatttatttgacaagtaaaagttgtatatatttatggtgtacagtatgctgttttgatatatggatatgttgtacagtggctaaatcaagctatttaacatattcatcatctcacatacttattttttgtggtgagaatatttaaaatttactgtcagcaattttcatgtataaaatatattgttattaactattattcccacaatgtacaacagatctcttcaatttatttcacttaactgaaatgtgtgtcctttgagcaagaactccccatcctcacccccagactttagtaaccaccattttcctttgtttctatgagtttgacttttttagattacacatgtgagattacgtgacatttgtctttctgtatctggcttgtttcactcaccataatgttctccaggttcttctatgttgttgcaaatgacagtgaacatgggagtgcagatatctcttagacataccgattttatctttttgatacatgcccagcagggaattgctggatcatatggtagttctatttttaatttttttgagtaatctctatacattatgctttccataatggctgtactaatttacattcccaccaacagtgtaaaagggttctcttttctccacattcttgccaacacttgctattattcatctttttgataatagcctttctaaaaggagtgaggtggtatttcattgtggtattaatttgcatttccctgatgattagtgatgttaagtattgttttcatctacctgttggccctttgtatgtcttttttttttgagatggagtttcgctcttgttgcccaggctggagtgcaatggtgcgatctcggctcaccacaacctccgcctcccaggttcaagtgattgtcctgcctcagactcccgagtagctgggattaaaggcatgcaccactatgcctggctaattttgtatttttagtagagatggggtttctccatgttggtcaggctagtctcgaactcccgacctcaagtgatctgcccaccttggcctcccaaagtgctgggattacaggtatgagccacggcgcccagcctgtatgtcttcttttaagaaatgtctatttaggtcttttgtccatttttaaaacacaaattccatttttgttttgttattgagtttcttgcatatttgcttcttttcagatgtatggctttcatatattgtcttctattctgttggttatttcttcactctgttattgtctcctttgctgtacagaagctttttagtttgatgtaatctcacttgcctatttttgcttttgtttctcatgtttttgaggtcatatgaaaaaaaatcattgcccagactaatgtctgggtatatagaatgatttttaaataccgctttaattttaagtggattgtgagcatcaaaggagataggctctttggatagctattcaggatttccttcatttcaatggctgaatagtattttattgtgtacatataccatattttatcaattcatctgttgatggtcagaaaagatagttgatataatttaagtcttcttaaatttgttagacttgtttcatgtgtcatgtgatctgttctaaaaaataattcctacgctatgagaacgtatcttctcttgctgtttgattaaatgctctgtatatgtttgttaggtccatttggtctaaagtgtagttcaagtccaatgtttccttattgactttttggatgatctattcattgttgaaagtggggtgttgaagtcccttactattattgtgttgtaatctattcctcttttcagatctattaacatctgctttatgtatttaggtactgtgatgttggatgaacatatatttataattgttataccttcttggtaaattaatctctgtgttattatataatgaccttctttgtttctgtttacattttttgatttaaagtctgttttatctaagtatagctactttgttttgttttgttttgtttccatttatatagtatatattttttgatcctttcaattgcagttaataaacatccttcaaggtgaagtgaggcctggcatggtggctcatgcctgtaatcccagcactttgggaggccaaggtaggaggattgcttgagcttaggagtttgagactagtctgggcaacatgatgaaaccctgtctctaccaaaagtacaaaaattggcccatgtggtggcacacatttgtagtcctagccacttgaaaggctgaggcaggaggatcgcttgagcctatagttggggcttgtgagtttgtttttttttttttttttttttgcagggggcagggggaacctgttttttaatccattgagtcactctatgtcttttgattggaggtccaaatccatttacattcaaagttttatttctatacttttattatattttatttatttacaagtaatatactgtttattattgctttgtaaaatgtttaataatgattaaggcctaatccctattgctctcttttcagaatgttcctaactatcctaactactcatgtctattattttttcatttcaactttagaattatctttttaaaaaatcttatcacaatttattgtgatcatcttaaaaagttttttaagtatagagagaattggcatttttatgatgttaagtctttctatccaagaatataatatgcactgccattggtttggaaatttcttttttcttttcagtgtatttaggttcttatagattttgcatatcttctgtcaagtttattctggggtattttcttttttgtcattgtaaatgaggtatttaacaagtttttttggatgtgtttttctatatataaatgcagtcaatttttaaatatcaatttattctcatctaattcaacagaatttttgttattctgaatatttaaatttttttagtttttcacgtatataaattatcatttgcacataaagataattttaacttttcctttctacattttctactttttccttctataattgtgttagtacttcagaaaaatgttagtaattgttgtggttgtagatatacttgtcttatccacactttaatgggacacttctatttgttttcccagtaagcataatgttggttttttgttgttgttgctactgttggaatgctgttgttgggattaatttaaagaaattaatattgtcaaatacaaagtcttaaaaattcaaatatagatgttttattctataatgcattttcagaattggtggagattagacatacttgtatgaattgtctccttataaatattaaattattttaattagtacatttcttaatcctaaaccactctggcattcccaggctaaatctcaatttgtcagggtatatttttaaatgttctgctggtgctccttactaatatgttgtttgtttgttacaccgatatttggaagtgagattcttctgtagacttctttcttttctaatgcttgtccaatattgaaacaatagttaatttggaatcttaatttatctttaaagagtattgcaatagaatgttctttagatatttcattcattcttggggagcttttaataatatgtttctcagcttcattcccaaagacttagtaggtctttaagaataaaaatggtatacttggttattgagcctagaacagtgtctggtacatagcagtggacattcaaggaatacttgactgattaattataaatttggatttttaaaaaagctactcaaattgctctaatattcaaacaggcaggccttagaactgctgccctaaaccagttttctgtctaagcttgtatactgcctaataaataatactgctttgtttatacaacatactcaaaagcttgattgagtaatgaagacattaatacagaggtatttagagcttttgtttataaaatgtattctaatagcaactattagtccctttggcatacaatagcagagcaaatacttgtggcatccttttgaaaactaaaatgcttttttttgattcatcaatgaggtatctatatgatctgttaaaattaacggagagtggaggatacaaaatcaacatgcaaaaccagtagcatttctatacaacaataacaaactagctgaaaaaaagaaacaagaaagcaatgctatttacaataaccacaaaaaggccaggcgtggtggctaacgcctgtaatcccagcactttgggaggttgaggtggacgtatcacctgagatcaagagttcgagaccagcctggccaacatggtgaaaccctgtttctactaataataaaaaattagctgggcatggtggcatgtgcctataatcccagctactcaggaggctgaggcaggtgaatcactggaacctgggaggcagaggttgcagcgagctgagatcgcgccactgtactccagcctggtgacagagcaagactccatctcaaaaaaacaacaagcaaacaaaaaccacacacacacacctaggaatatattaaccaaggaggtgaaagatccctacaagaaaaactataaaacattgatgaaagaaattgaagagaacaccaaaaaatggaaagacatcccatgccatggattggaagaatgaattttgctaaaatgaccataccaccaaaggcaatctacagattcaatgcaatctctatcaaaataccaatgatatttttcacagaaacagaaagaaaaaaatcttcaaatttgtatagaaccacaacagactccaaatagttcaaagcaatactgagtgaaaagaacaaaactgcaggcatcatactacttgacttcaaaatatactgcaaagctatagtaaacaaaacagcatggtatttgtataaaaacagaaacctagaccaatggaatagaatagagaacccagaaataaatccacgtatttaaagtcagctgatttttaacaaaggtggcaagaacatgcattggggaaaggacaccctcttcaataaatggtgctggaaaacctggatatccatatgtagaagaatgaaactagactcctaactcttaccatatgcagaaatcaattcaaaatggactaaagacttgaatgtaagaccccaaactataacactcctagaagaaaatataagggaagcccttcggacattgttccctgcaaaaaaatgtatgggtaagatttcaaaagcacaggcaacaaaaacaaaaatagacaaatgggactatgtcacctgagaagcatctgaacagcaaaggaaacaaaagcataaggggacaaactgtagaataggagaaattatttgcaaactattcattcgacatgggcctatatctagaatatacaaggaactcaaacaactcaacaacaaaaaaccccaaatgatttgattttaaaatgggcaaaagatctgaatagacatttctcaaaagaagacacacaaatggccaaggatatgaagaaattctcaacatctctaatcatcggggaaaggcagatcaaaaccacaatgagatattatcccaccacagttagaactgatattatcaaaaagacaaaaaataacaaatgctggtgaggatgcagagaagagggaattcttatacactgttggtaggaatgtaaattagtacagccattatgcaaacatatagaggattctcagaaaactaaaaatataactaccatatgatccagctttcctactactgagtatttatttaaaaaatcagtatatcaaagagatatttgcatctccatatttatggaatcactattcacaatagccaagatatagaatcaacctaaatgtccatcaatggatggatggataaagagaacatgttatatattcacagtggactactacccagacataaaaataatgaaatgctctcattcacagcagcatgaatgagcctggaggatgtgttaagtgaaataagtcagatatagaaagataaataccacaaattctgactcatatagagtagcttaaaaaaaagttgtactaatagaagtagagagtagaactctggttattagaagctggggagggttcagagctggaaggataaggagaggttgattaatagatgcaaaaatatagctagataggaggaataagtttgagtagtattctacagcactatagggtacatacagttaacaatagtttattgtatatatttaaaaagctagtagagaggattttgagtgttcccaccagaaagaaatgatatgtttcaggtgatgcatatgctaattacactgatttgatcactacacattgtgtacatgtatcagcatatcactctatattccataaatatgtacaattattatgagtctactacaaataaaaggaaaaaaatgagctgagaagcatgttaccttttttgagcataaaagagaccttcttcataagtttgtacccaagtgatgtcatctccccatcctgaaatagaagagagaaatcaatgcagtaacccagaactagagaagagctcggaaatgggtatctaataatcagatatctacctacagatatttaactaagccatcaagctgttggctgacatatggtgcagaggacacacaattttcacaagatatggaggtgatttccctttagattgcagtactgaggttttgctactgcatttcaaacctcgaggcccatggccttgaacccagtaagtactcaatacatgttgttatgattagagctgattgaaaggacatctttggataatgtaaaagctgtggctttaggaacgcttggaaagtaacagttcatctttgcatactttgtaatattattaggaatcctttcggctgtactctacaatgccctcctattttgggtcccaagagatgttgacctcttctaagtcagtatacgttgtgaaataagggaattccaagttttgctttgaattctgacatggaaaaaattcttgtgtgggaatttcatggccaagagacataataaaacgcatgtgttttggaaacacccaaaagaatggagagaaaaaacagaaagcaatgaatatagagagaacccattagccttaaagaaatggtatgaatagttgggaatgtgtataagcaattaaagataaaatcatcaagtagaagaatgtgcagaacctccaaaaacattactgagtattttcaggaagtgtctcagtctacgaatgagagagattgaattaatgtgaaaattagcaatatttggaagtcagtttgggcccaggttttcttgtacatttcaaatgttgtcagaccacagtttctggctttaatatcatggtaaatatgatagtaatttgataaatatgattccatgatttttgcttgtttttcatgtttgttttctggcgacagctttattgaaataaaattcatacgccaatacaactcacctattgaaaacgtatacttttggccaggcatggtggctcatgactgtaatcctagcactttgtgagaccaaggtgggtggatcatttgaggtcaggagttcaagactagcctggtcaatacagtgtaatctgtctctactaaaaatgcaaaaattagctgggtgtggtggcatgtgcctgtagtcccagctactcgggaggctgaggcaggagaatcgcttgaacctgggggtggatgttgcagtgagccaagattgcgccactgctctccagcctgggtaacagagcgagactccatctcaaaaaaaaaaaaaaaaagaaaaaaagaaaatgtgtgcttttttcagtatatccacgaagttgtgcaaccatcatcacatcaattttagaacattttcatctcctcaaaaagaaaccctataccatttagctatcacctgctccccattttcttcaaatgccacagccctaagaaacccctaatctactttctgtctctatagatttgcttatgctggacatttcatataaatggaatcatacaatatgtaggcttttgtgactagattttttcactcagcataacctttttaaggttcatccttatagtgccatgtattattatttaattcattttttatggtcaaatattattccattgtatgaatataccatattttatttatctgttcatcagttaatgatatttgggttgtttccactttttgtcttttatgaataatgatgctatgaacatacatatacaagtttttcagtggtatatattttcatttatcttgggtatatacctaggagtggaactgctgatcaaatggtcactctgtatttagctttttgaggagctgccgggttattttctaaagtagatgcatcattttatatactcaccagcaacatttttgttttttgtttttttttgcctgatttaaaatcttaacattgaaaaacatctcttgttagtttaatgccacatcttaacaggaactcttgctctctgtaataatcctgaaagattctctttccaactttggttgaacacatgcaatatctatacatcacattttgcattaagtaaaagttattctaaaacagcaagtgagacgaggcctctgctgaattttccctcttctgttgcaaatatcattcaatgatggagcattagcagtggggaaaatttctattctctgctcctgctcaatttagttccacaaacagtaaaggaacatctgctgcataacttactccacaaagcagtgggaatacaaacatagagcaatataatccctattctcaacaaattgtccatagctctgtagaaaagccatattgcattataatgattttttatttactctgttataatcacaataggtcaaagctgttacacagtttaaatgcacttcatggcttctgctcattactctaattctagccctatctctatctctggctatattttcttgtcttttgagattttattcatttatctaacatatatttattaaatatttactatccgccaatcactggactaggtactcagcaattctgattcaaaggaaattggattttttttggatcattctatgtgtgtgtatttttttctccctgaaccttcttctacctttttctaattaatcttccttttctccttactgccttctctacttaactagtgctgccctgtgctctaaggggctccatatgccactctttatactgtatccagacttctcccactcacccctacctttaatcttcattcattctgagcctcattctctccattatctcccatgtagcaatagatggtaaaagactttgccaaatataaaccaattctcaataatggtgttctcagctaatatcagtcatcttctgtgttaaattagtttcttatcaattgaaataatagaacctttaagttgtttaaaatagggcatacaaatgtaatatattttttcaaaacattcaacaagagttttaaataaatatttagaagtgagcacacagaatgttgatgccttgacgtatagttatcacagtgctgcttaatgcagacatggaaaatctttaagggcaataactagtttagtctttgtcactttagggctactgagctcattgttttacaacagttatgcttatacagagagatagagttatgtttaggaaaatatttcaactttttcattcctttcttttgcaaaaatatgttgactttctgtatatatagattgtgtgtttgttaaactgaagtagagttaattagcttaggtaaacattgatgagcacttggctggcactcaatacatctgttaagaaatgaatgtacttgggaagcaagtcagtgttttagaatttgaaattatataatatatatttataattatagcatatatttatatataatttattataatataacacaaatgtatactatgatatatattatatataatatatagtatatataatatataatttgtatgttataattatatatattttatatatatatcagaggtaggaacagaattatttgttcccacttggttattcaaaactagcagtattactccaaggcacttgactactatttgcagtggtaatatgaatggagcaaacaaatggtcaagtactttgtggtaatactgctgattttgaatagctatatggggacaaataattctgttcctacttctgttacttagagatatagaaactaactttgagaatattttcttggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcgcctgtagtcccagctacttgggaggctgaggcaggagaatggcgtgaacccgggaggcagagcttgcagtgagccaagatcgtgccactacactccagcctgggtgacagagcaagactccgtctcaaaaaaaaaaaaaaagagagaattttttttaataaaatgtttctttacagatgaatatatatttgtttcttgggccaagtaaaacagtaagtacaaaaagaaatgtttctaaacatgtagccaccggcaatccttgattatgtctaaaaccactgtcttccagagtcaatatagcaaagacttagttaccccgaattctcagagtttggggtatagtataattttctgggaaggcttatataaaattattccaatttttttttttttggaggactgggaaatagaggactgggaatttgagcaaattttgaggaatcttaaattgctattaggacaccaatatgacgcagcaatcaatcattattttctaggactctggttaccaaagttatagacagcgagccaattctccattattttggcaaaagataatgcaaatttatgttattgtttgctagttgatttgattcactgcctaaaataaactgattccttctgttttaaaaaatccattttgaagtcacacacaacaaaaatcattcagttagttgaatttgctttataattagactatgagtgaagacaccagatattttaaaaagcaatccaaatgactgagtttagaaaataaaatgagattacagcacctcttgagagtgtctgaggaggcctcttttccttttttattgcaatggcaaggttggaagaaactgtgacgagtaagaggcagagacccaaagctgagtgtagcatcatgtcttctagagactctctcagaagaagctagatgacagaaaggaattctcagaatccagtgaattacttcaagctattattagaagatatttgctaagagttggaccaatactgtgatgacagactgttcagcttttttggtttgacatggtataaccaaccacatagaactttcattcacattttatttttaaaatacttaatcaactcagtacatgctcagttggtgagaagtcatgttctgagcctcctgggcatggtgctgtataattaaaaaagagctggatcagggcacacgaagcctgcttctgaaccgccctgtagtgttcacaccaacaagacgaaactcaaataagatcatgttgtttgatgtcttgtaaactatgaagtgacttttagcatgcagaaatattctttgccttttgattctccttcatctaataggtcaaaatattttaactctatactaagataagattatacatgaataaatattgcttaaaatagaaatcagaggaaaaatagaatatggaggattcttgtccttcagttcctttatagtttcttacctttctcatccttccaacaattactcagacttttgcccttcagtttatgatacagctctttataaaaatcaagtactatcatattactataaattagacatatgtatagagaagaatagactgtcatgattacattctctcctggttagctagaattcaaactgattcttaactcaatgtgcatcttttatactttgcacgttaagataaaaactgaagtccaaagttgggcctgatctggtcataaaccacttgataaatatattacaggaagtctttaatacttgtgagatgtttagttacagcattagcatataaaactgatttgaaaatggttgactcatgcagttttgaaactttacctcaaaatataaaataaatatacagacatcattcacattgatttgaagttcctttaagacgtctttcctattggcttacattatttagtattgaactcatcaccaaaatagtaaaatttccttagccaaaatggctagtgactgattctttagtgattctgttcaaacaaagatgttgctatattttattgtagtaggcattgtggaaaatgaaaagatatataagacacaatgttttggcattggtaaaacatttggcaattttaatcacctagttattgtaaagtagcaaccgcagtcgtggaggagaacaacaatttggtggtaaagaagtttacagattctagatttctccagacatttcctcattcctcccattatactgttttccccttcccagtggtgtatctattgcagcccctctatggactgaaaatagttaccactccaggttaaccttactttatttccctccctaatccccagttgtccctccctccttcccttccccttccttccttccccttccttctttccccttccttccttccttccttctttccttccttccttccttcctctttctctctctctttctttcttttctttctctctcctttctttcttttttttttttttttgctcttgtcacccaggctggagtgcagtggggccatctccactcactgcaacctccgcctcccaggttcaagcgattctcctgcctcagcttcccaagtacgtgggactacaggtgtccaccatcatgcccggctaatttttgtatttttagtagagatggggtttcaccatgttggccaggctgatctcaaactcctgacctcaaatgatccaactgcttcggcctcccaaagtgctgggattacaagggtgagctacatcgcccggactcctttcctctcccctcctttcccctcctttcccctcctttcccctcctctttcccctcctctcccctcccctcccctcccctcctctcccctcctttcccctcctttcccctcctctcccctcctttcccctcctttcctgtcctttctttccaggcatataaaaaccctgttaaacaattatcacggtgcctgataagaatttcagtttaagttctcataacttattaaaccataaaacatttcagaatgtcatcttgtaccttaaggccttggtcatcttgtactttaaagactgaaacaaatacagggtggattttagtacaggacagggacagttgactctggaacacaaagctcaacccagggaaggcagccttagttagacaggttgggagttgcagtggaggaactaaagcaaccacctaggacaggatcttaacctggatccagcaggcttctagaaggcctgtggctgagctacagaaggctcaaaacccctggaaattgtgtgcaaaattttatctgcctctgttccttttccgtgggaatagggtccaaaacgtcattaaaattcttccagggatcttggatataaagaagagttaagaaaagtcaatctggaaggaatctttagaaagatttttctatgttagctacagagacaagcaggtggaatctgcattttaaaaaagaaaaagcataacctcatcatttttgctattttaaagctgcgaagcttagagttaagcgggaaccattttttctttaaaatttcaagtctttatgtattattgtcaaatactttctaattaaaaaataaaaatcttggttttctggttttacattgataaattataaaatagatattaaatatattctgtgacaaagcagtacaacttgtacactgtagattttgaataaataacgctttccttggtaaaatatagtgtaaactgctgagggtcctttagtatcagttgcaaggttaagctacttgggggaacacagataaatgtggcatggttacaggcctacagcagcttaaaatgcatttgggaggcacataaccatatgtcagcaattagattgtataaacattggtcaattagcattttatgacattagtattttatttttcaaaagtaatttaacgtaagtaactgatattataagttcctatattttaaaataaaacaagacttaaaagaatataaagaagagctatcattacttgtagaatacttttcaaagagtcgtttttgtggttgacgtcaatttattctaataccattaatataaatagagataaaactatgaaaccagcaaaggaaatccagttcagtaaaagaagaaaaataaaaattcatttcactttcctaccctttactgaaagcttcacttttaaatagcaaaaggtgattatttaaatatagcaaagcttgaccactgattaagtaatctggaaaatttgcttgcttacctgacttggccagtgctcttgttggaaatgtattctggatgtttct

SEQ ID NO: 1611 - DNA, 2705 bp, Homo sapiens
ggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcgtttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccggtgagtccccttgttctcgcacaatctctctaacctggtgggagactcctctgcactggaggtctgggaaggtctggccgtggatgaacttcaccttgatggtgtccatggaacatacgaccaccatggcctcggccacgccagcgccctggccgcaccgcagccagcgctgccgtcaggccgtccctgggcatcccgcgtctggctgctgtggaactggaacattcagaacccaacgccgccctggagacaagagccgcagagcagggagccgaggccgcggtgccggcccgggacgccatgaccgcgacagtgcgcacgcgggatccatgcgcggtgcccggctggtgccagcgctcgtccggctgcagctacgacctcccgcgctccgtggggagcggacgcccatttcaatgccgccggccaggccgcctgctggtgtcgccttccccggagcctccgctgggccttcccggacgcggcgcggcgtggccacggcgggcgggaggcgggcgcccgctgtgatctgaagtcccagcctcctaaactccgcactgggaccttaatttggttttaacacaaatgaagatctcactaaagataaaaagggatgtcttggcttctaatttttgttaaaagcaatagcatatgttgtataggatagtgcattggggtaaatcttttttttattatttttattttttcatcagcccactgacattgaaaggggataggttttaggttattgacgagcagttttctctcagataactgccttagtataggggtttgtggtcatgttgatgagagggtaggctggggttaaaagtcgttatggcagtaacaaccttctgaggaccaggaaattcaaatccctctcatgatactttgctaatatctcccgagtttgctgtgccttccctttgtgcctcttcccacacgtggtttcttgcacttggcccagctatattccactgttttgactccatgcttcttagcctggtggcagtggtgagggagtgaggagatctctaatgttctgaggaagcctcagacttagcactgtgaactggggtgtggggttactgaccgttgaagagtttcctgcccatcctgtacatgcaatgccaggacaagagcacattcctgtccctccttgtccatggtaggggaaacgtgctccttctccatgctcttaactcccagttgaagtgggccttgaacagtgccctgtaaattaatggtttcttttctttatgggagatgcatctgtgcagaaatgcgggtgttggccttgttccttcaccctcagttccatgagcttttccccagtgccctttggctcaggtttggatgctctttctctgcagattaggcctcatgttatataggagagatgtgagggctgtgtctccagagttgcagtagtggatgggatagtggtccctccccatcagcactgtggggtaagcatcctcaggattctaaccccatcttccctgacaggccttgtagggttcctagaaaaattatacacaacggtataaaccctacgtctgtagactccagggtttctcattctcctcacccacccacacacagccaccaggaactagttcaaaagttctggcttaattttaccagtttacatggtcttcagggtacacataaaagcctggagcctgtgtgacctgcaggctttctgcatcccctgatgttgggtttgtagtctgccctgtgacctcagttctttaaagggctcaggagaaaccatccattcatttgaagtttctccagcatttttgtttgtttgtttaatgtgtaggagcaactctttgtcaggtctctatatctacaaacttaactcagaaactaatatttttaaatatatttcttttctatcatacttttagtgctcctctacctatgctaattgttcttcagtattttttatatttgtatgtctttatctattttaaaatcaggtttaattccttcttaatcaaattaataacttttcatttatttccctacgtaactttcttttcagacgtttaaagtattgctgtgtgtttcaagtggaggaggtcatattacaactgacatttgtccttgactactggacatatcacaccagccctgattgcagttatacttgaagccagatctacccttaacgtatattcattttactattcaataaatattaacttatcatgaatggta

SEQ ID NO: 1612 - DNA, 49972 bp, Homo sapiens
ggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcgtttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccggtgagtccccttgttctcgcacaatctctctaacctggtgggagactcctctgcactggaggtctgggaaggtctggccgtggatgaacttcaccttgatggtgtccatggaacatacgaccaccatggcctcggccacgccagcgccctggccgcaccgcagccagcgctgccgtcaggccgtccctgggcatcccgcgtctggctgctgtggaactggaacattcagaacccaacgccgccctggagacaagagccgcagagcagggagccgaggccgcggtgccggcccgggacgccatgaccgcgacagtgcgcacgcgggatccatgcgcggtgcccggctggtgccagcgctcgtccggctgcagctacgacctcccgcgctccgtggggagcggacgcccatttcaatgccgccggccaggccgcctgctggtgtcgccttccccggagcctccgctgggccttcccggacgcggcgcggcgtggccacggcgggcgggaggcgggcgcccgctgtgatctgaagtcccagcctcctaaactccgcactgggaccttaatttggttttaacacaaatgaagatctcactaaagataaaaagggatgtcttggcttctaatttttgttaaaagcaatagcatatgttgtataggatagtgcattggggtaaatcttttttttattatttttattttttcatcagcccactgacattgaaaggggataggttttaggttattgacgagcagttttctctcagataactgccttagtataggggtttgtggtcatgttgatgagagggtaggctggggttaaaagtcgttatggcagtaacaaccttctgaggaccaggaaattcaaatccctctcatgatactttgctaatatctcccgagtttgctgtgccttccctttgtgcctcttcccacacgtggtttcttgcacttggcccagctatattccactgttttgactccatgcttcttagcctggtggcagtggtgagggagtgaggagatctctaatgttctgaggaagcctcagacttagcactgtgaactggggtgtggggttactgaccgttgaagagtttcctgcccatcctgtacatgcaatgccaggacaagagcacattcctgtccctccttgtccatggtaggggaaacgtgctccttctccatgctcttaactcccagttgaagtgggccttgaacagtgccctgtaaattaatggtttcttttctttatgggagatgcatctgtgcagaaatgcgggtgttggccttgttccttcaccctcagttccatgagcttttccccagtgccctttggctcaggtttggatgctctttctctgcagattaggcctcatgttatataggagagatgtgagggctgtgtctccagagttgcagtagtggatgggatagtggtccctccccatcagcactgtggggtaagcatcctcaggattctaaccccatcttccctgacaggccttgtagggttcctagaaaaattatacacaacggtataaaccctacgtctgtagactccagggtttctcattctcctcacccacccacacacagccaccaggaactagttcaaaagttctggcttaattttaccagtttacatggtcttcagggtacacataaaagcctggagcctgtgtgacctgcaggctttctgcatcccctgatgttgggtttgtagtctgccctgtgacctcagttctttaaagggctcaggagaaaccatccattcatttgaagtttctccagcatttttgtttgtttgtttaatgtgtaggagcaactctttgtcaggtctctatatctacaaacttaactcagaaactaatatttttaaatatatttcttttctatcatacttttagtgctcctctacctatgctaattgttcttcagtattttttatatttgtatgtctttatctattttaaaatcaggtttaattccttcttaatcaaattaataacttttcatttatttccctacgtaactttcttttcagacgtttaaagtattgctgtgtgtttcaagtggaggaggtcatattacaactgacatttgtccttgactactggacatatcacaccagccctgattgcagttatacttgaagccagatctacccttaacgtatattcattttactattcaataaatattaacttatcatgaatggtatatattgttacagttgtaggtttatggacctgaatagacaataaaataaataaaacccaaattacatggcttcagggggggtataactttttattaagtttttagttaaaacatttttgcctttctgtgatttgcaactttgagtgattgccttgaaaaaggaaccagagttgaaactgaagtagtaggtgttggtgagattttgatggctaagagcatcgggctcattttgtaactgaaggggaaattagaacaggtcaccagttccatctgaccacaatgcagttggaataatcaccatggcaacccatgacttgtattttaggggagaagaattggaaataaaatgaccaagcataaagctgacccagtctacatggatctttgtctttaaaacatatctgcaatactcatgtaggcagtgtataaataacttgtcagaaatatcgtttatgccaaggttcttcttgaattttcaggattttgcttctccagtagtgagtgtgttactgagcaaaaggggctttctatccaaaacactagaacccaaaactgtggcactgggtttttctttttaagaaaaaaaaaaaaaagctgctccttattataatttttgtttatattataattatgtaagtataattttaattttattataaatttgctttattataatttttatttcagtatcacttacagtacaagtggtttttggttacgtggatgaattatatagcagtgaattctgagattttagtgcacctgtcacctgagtagtttatattgtaccaaataggtagttttttcatccctcatccacctcccactctctgcttctgagtctccaaagtccattacatcactctgtatgcctttgcatacgcatagcttaactcccacttataagtgaaaaataatagtattttattttccattcttgagttatttcacttaaaataatggcctcatatcccttgccctgaaattaacagccagcaggggtgtcctcagtatcaaaacaagtcgaccacacaaagccgtcaaagactccaggaacccaggtccatggggtgcagccctgcaaggtggaaaagctgaccaagtcttccttccagccaaatctggaagaaaggccccttgcctggagcagtgttcctggtacccaggcctctgtgggcatccctcagcacaaagaccctctccaaggggcatgggccggcccttccaggaccaccagcccagctccagaagcccatgggtcatccccaccctcacctgactgagctgtccctgaggctaaggcccagcagcatgaagagacttccacagaaaccagggcaataggctgctctctggcggcactgggggctcagggtctggctagcctgtccctggctcaagtcacatgcctggaaattagggttttctcctctgctcttagcatctcctgggtaaaccaataattaccctccttcatgtctcaaaattcacatccatgtaaaaggctctggtgagggtgacatttccaggaagccacagcccatgtcaaccccctgcaaagctgtgaccttgtccgcgggcaggtgaggcggcggagttctcccaaaagccggtgaactggcgctctggctggagagcgcggagggcggcagcacaatggacagcgtctgggacctcaggccagttccacagcagcctaggaaagcaggcggctcctgtgctggaggaggcgtgatgctctggagggaaaccgagctgagcagcgagaggtggggtgaggctgagacccgcccgatttaggcaaagatgaggtgcacttcgcagcgtcacactcttctcactgcccagccccgacttgccccttaagtccctctctggactcactccccttagccagggatggcacagaatcagtggccagcataggtttggaagcagagaggtccacacggcttgcgcctccctccgggactgctcaccaccccgcagcccggcgcttgctgggactgtaggccggtagccctgcgaccaacagccgaaagcggttaagaaactactcccagaatgcctggcgaggcgcgcaccacgcggccccttcctccaggcattcgcaccaccccccactcccgttgcatgctgggattgtagttgatcgcctgcgatcaacggccggaagcggctaaaactactcctgcctgcataccccgcaggagcaaaccgcgccatgtctccctccagggatccgcaccgctcacaatcctgtttagtgctgggattgtagtcctgcgagcctacgactaatagctgggtgcggataagagactacagctccccccattcccagcaaaggtccctcctccaccgagctcctccaggcttccagtgcagttccgccgtgcggagggaagcttggctgttcacaaacctctcctgcccgcgaggagacagcttggccagggcggctgatctcaccttgtcattgtgacacggtgtctccccaacgtgctggcttcatgacttgtgcccagagtttgattttccacagaccaggtagaggccaagagcctctcacagactctgcagcagggttgctatggtaacgcttgcgcccccgccccccccagcagccggctcgacaccgccctttccctctgaagggccactcgttttagccacgtcctcttattgtccctcccctggccacaccccttcagacatgcgtagtgctccccttggtccagcgcgggaagctccctcgtgagtgtccgaaactattagctcactcactgcctcatgtgaaggtacccagtctctggtaacctggcacttcccttttgaaaaccacctttttctctctctctgggctgccacgaatccccctgtactccccagatgcacctgttggaccccgggctggctgcatggcccacacctgggtcaggcctcgcacaggggcgctcctgccactataataacgatgagaaaatgtcccaggggaaaggcctgaccctgctgcatccagtcaggaaactgccacggggaagggaccacctaaactactttgcgagccacatccaccacttctttgtcccccacccaggctggttcccaggccttggggtcctagtgtagacctcccggccataactaacacaggtgcaggaccagagagcgccttggttcctcccaacacatgaggaagtttgtgtggtgaggtttggacagtgtctttgtttttgctctgaatagggtgccctggaaaaatctttacctcttattaaatactccctttggaaccacttttaagactttgccgatggaacttaacagtgatcatttattgaatccatttttctattcgcttttttagattaactcttaagtactccacaactacacgcttttgaaactggcgttggcatagcgttagttctgtgcagggcggacgcagcaggacagaatctccctgggcatcttttcggagcatcaattttactgcaaaattttgaaaaaacaaatttaattgatttccaaggtaagaaattaaaccttgaaaaatagactaaagagtcatctgcacctgacatatcagactttctgcaggaagaaaactctaaggagagcatattgtccattattataaatagtgaaaatgagaaatcatagcaagtcccttgaaaaccctgccctgccagttttctaatagggccttggtatggttttatgtgtattttcttttgaagtgtgctcatcttttgaatatacaaatttgaggttttgaccaaattttgcaagttttcagctatgagttgtttatttgctcttgtatcatatttaatttttctgtctctccctctccttctcggactcagtcattccacaggtctctaaggagcttttcattttcttcaaacttgtttcactcttcagattggatgatgatgatttctattgctgtcttctgtttctactctgtttataaactcaaaggtctttttaatttttcatttcattatctctgtatcccattctttttataattttcatttctctgtaatggagtctcgccgtgtcacccaggctggagtgcagtggctgatctcagctcactgcgccctcctcctcccaggttcaagtgattctcctgcctcagcctcccaagtagctgggactacaggcacacgctgccacactcagctaatttttgtatttctagtagagatggggtttcaccatgttggccaggatggtctcaatctactgacctcatgatccacccacctcggcctcccaaagtgctgggattacaggtatgagccaccgcccccagcgtttctggtgttttatcagaggagcaaaacctgaggtaattcagattctgctctttgttatcttctaggagttttgtgagttttcctcctatataggtctatgatccattcttagtaatttctgtgaaagttgtcaggtctgggtttagggtttttttttttcttcttttctcttgtatgtggatgtccagttgttccagtactgtttgttgaaaaagtattgtttctcaattgaatttcctttgctttttcctcaaagataagctgactatatttcatgggtcaatttatgagctttatcttttgtttgattgatctgtttctctattattttttaccagtaccgtgttttgattactgtagctttatagtagtgcttacagttgggtagtgtcattcctataactgttcttttaaaatattttcttggttattctgagtcttttacctttccatataaactttagaatcagtttgtcaatatccacaaactagctttgtggaattttgattgggattgcactgaatatgtagatctagttgggaagtactgacgttttaacaacgttgaatccctctttacttgaatgtggattatctctccatttatttagatcttctttgatgttttcacagttttgtagttttcttcatatggtttctatatttatatttattttcttatatttgtacctaaagaatttcattgttattggtgctagcataaatgtcactgaatttttaaatttcaaattctaattacattactgatatataggacagtaattgacatttgtatattaatcttatattgtgcaaagttgctataattgctcattaaaattggttattctaagattttgttttgtgatctttttgtatttctccataggcaattatatcatctgtgtaaaaagactgttttatttcttccttcccagtctatgtaccttttctattcttgtcttattgcattacctagggcttatagtataatatcatataggaatggtgagaggagacatctttgccttgctcctgatcttagcaggaaggaatctagtgtttctacattcagtatgaggttagatgcaggtttttttttttttcttgagatgtcgtctcgctctgtcaccaggctagagtgcagtggtgtgacctcagctcgttgcaacctccgcctcccgggttcaagcaattccttgcctcagcctcccaagtagctgggacaacaggcacgcaccagcatgcccggctacttttttgtattttagtagagacggggtttcaccatgttggccaggatggtctcaatctcctgacctcatgatgcacccacctcagcctcccaaagtgctgggattacaggcgtgaggcactgtgcccggccaggtgcaggtttttttaatagacattatttatgaaattgaggaagttttcctctatttctagtctgcggagagtttttctcatgaatgggttttggatattgtcaaatgatttttctgaatgtactgatgaaatcttatctttttaaaacttaatatgatgaactaattttttttaaagacagagtcttgctatgttgcccaggcttagtttgaactcctggcctcaagtgatcctccctccttggcttcctactgcattaggattacaggtataagccaccacacttagcctaatttattttcaaatgttgaaccagcctggcatgcctgtaataaatctcactgggttgcagtatataattattttttacatttttggacttgatttcttaatattttggtgaggatttttgcatctttcttcatgtgagatattgtcctgcatttttttcttgtaacgtctctgtctgaatttgacactatggtaatcctggccccattgaatagtttgaaagtattcactctgcttctgttttctggaggagattgtagagggttggaataatttctcttaaatgtttgcataaatatactagttacctcatctgggtctggtactttctatttggtaaggttacttatcattgacccaatttctttaatagatgtagtactattcaaattgtctgtttcttattgtgtgagtttgggtaggttgtttctttcaaagaatttgtctgttacatttgggttaccaaatttgtgggcaaagagtggtttataatgtttctttattattctttaattcttcatgggatcagtaatgatagatcctctttcatttctgaaattaggactgtgtcttctgtctttttcaaccaaaactaaaaaggaacgttttaaaaagtgaaagctatttttgataaactatctaatttcccatgatctgcaactgtgggtacataggaagtacatggaaacagatgtttggcagagcttgccaacaaattcttttctgcatcaagaaggcatgcctctcagcatgacactcttaagaggcagaaatgtgacaaaagaaggatgcgatctgctcctggtgaagagccacctgactctccctcagctgcacatagtggccttaacgtgcatcttgctagaaggggcatgcaagccaggggctgccagccaagccatacaggccaaggacagtttcaagtctgccttttatttcatcgaactgttgttctagtaagcagctagagttttatgaacactgtaaactctttatcatatttctttgctatttctggaggatttgttctaggagtcctcttggataccaaaatgcatggatgtataagttctttatatataatggcatagtatttacatataacctatgcatattctcctgcatactttaaatcttctctagattacttttaatacctaaattgttgttatgctgtgttgtttagggaatagtgaaaagaaaaataaaattctgtaaatgttcagtacagaaaccttattaaaatatttttgattcacatttgttgaatccaggaatgcagaaataaggagggacagctctacctatgtttggagtccatgaatgtgtcatcttgctgtgtttgtaaatagaaatttatttcacaaaatgactcaactgcttcttcactaacatgttcaaaaacttgcaagaagcagccaggcatggtggctcacacctgtaatcccagcactttgggagacccaggcaggaagatcacctgaggttgggagttcgagactagcctgaccaacatggagaagaatcgtgtctactaaaaatacaaaattagccaggcacggtggcgcatgcctgtagtctcagctacctgggaggctgaggcaggagaattgcttgaacccaagaggtggaggttgtggtgagccgagatcgcaccattgcactccagcctgggcaacaagagcaaaattccgtctcaaaaaaaaaaaaaaaaaaaaaaagagagagagagagaaaagaaaagaaaaacacttgcaagaagcaaaataagaattgagaaaggggaaagatgatgactgagagttggaaggttgcacattttcacagaaaagtagaacggaattgtaacaagcactctgataggaaatcatagtttatgtctcgcaactgtccctgaaaaaatacaatggttggcagaaaagacaagaaatgagatagactataaattaactggagaagagaaaaaataattcccagaagtaaattgtcaacgagtttgaaagcaggtaaaatgtaggtgcattatccctactctttctgaataattttacaaccttgtgcaacaggagcttctgtcactgcagaaccagggtcacctgtggaaaatccttgctgaagccatctccctgtctgcctgtccctcaggcccaggagtcatgagtcctttctccaataagtcattcagttggctggcagcaaaccctggtaagattcttcaaggcagctactttttatcttagattttaacagaaactcatgaagaaaagtcttaagacctaaactcccaagtcccttactgtatcattttgagtattaggaaatcagtcagaggtcttttcagcatctctgaaatcacaatgcaaaaatagccccagcttcataaggccgattcttggtatctctgttctgcaaagtagggtaagcaagatgccacaaaaggcaggttgaatgcagcattatcctcactccaccaacagaactatcatactttaagtaacccagcaggtctttaaaataaagaaattataaaacataaggaaaaactttcttgagaggaaaaaatttacaaatcagaggaaaatcttctagaacttttacatcttataacaaataaatcatatgctttattgttttcctctgagtacatcatcagtacttccataatacttctaatttttggcttgaaaacaccagttgcttaaaaaaacacagggacacaaaacaaaatcccagaaatgtataattattttttttaagctgacaaaggagtaacacaccactgacttctcagggaaaagctttcaagcaaagcagtcatttctggtggggattatagaagagggagttatcatggtgagatggtggaactaatccagaacaagccagatttttagtattgacaaagggatttaatcagttgcccaggaatactcactcacttggaaatcaaacttccatcattattcttggaagaatttctggaacttcccctttggaaacaaatttttatcttcaaaaataccagacaatagaagaaaagaaatgaaaaaggaggcagaggaagatgaatcttgcttaggcagggactgaaagggaattcgtggccataggccacatttttcagcgcccactgtgtgacggctttccccaggaccacacgtgtgccactgaacaagaagagtccacagggaccttcaccttattcctccccaacatcaaaaccaaaatggaacaacctaccatgagaatatgagtatatatcacaacttccattacatttaaagcatgcagagtatctaattgcaaattcaaacagtggaaaaacaaatctacttgcctcctggccacagccttactcttttaagagaatgtggtctatgctttctaatcccatcaccagggataaataaccacaggtttgtgtgacatagaaccacctccatgcagaggtaaatatgcatttattttttataaaataagaattatactctgtacttttataccatacttttagaatataacagttcttatgatcattttataattatttgaaacaacctccgtagctatataacattaaatcaaaagaacatttcataattttaccattttcctattggacattgagtttgctctcatgaagtttatatttgtgtgatgatttgggggaagtttctcggcctcactagattgaacaccttgtgatggtggtcactgttatattcttttttatttttattttttgagacagagtctttctctgttgcccaggccggagtgcagtggcatgatctcggctcactgcaacctccacctcccaggttcaagcgattctcctgtctcagcttcctgagaagctgggattacaggtgcacgccactatgcccagctaatttttgtatttttagtagagacgaggttttgccatgttgaccaggctggtcttgaactcctgacctcaggtgatccccccgcctcggcctcccaaagttctgggattacaggcgtgagccaccatgcccagccctattcttatttcattaaaatacctgaaacatatcaggtatattgcagcatctgttgaatgaatgaatgaatctctccttcaaatcttggctaaagtctgcctcatccacaaaagttcctgaccctcacttcaatcataaacctctttctcttctataatttcccatgtagctgtttgtttgtttttttttaactccctggcaggaaaaagaggaaacatgctatttattgagcactattctgagtcagggactgtggtaaatacattcaagaagaaagcatcaaaagggctatacgtcagcctagacagtgtgccccagagggtccttgactgaacatttggtgacgagcatgttgggcatgtgctctaggctgaggtgcagctcttatgccacagactgaccctggatcaattatggctcaagtcccaccctgaaatctctctttcccatttctaggtttgtcaaggaggacagaaactcagagcaccctgcacttggggatcggcactaggagctgctctctggatggggagatgggagctagcagctcacaatggggtcacaaggtaagttccaaacagctctgtcacagagagcgtcagcagatcgcaaagaaagggagcatgtgaaggagaaagccctgagtgatgtcacagctcatttctgggcaaagggagaagaaattagcaccctgaggcccttccgccttattaacccattgcacttattctcagaggctcctgccaaaaatagagacattattccacctccacctcctcaaattctaagccagaaatatgtgtgtgttatcattcaacttatatcattttttcctccttaaatgatattttcaccactaataaatttatcaaaattgtacttcacatgtgtaatacagaagaaacaaggcttccttcaacactgaattaatgaaaaacaactcaggatatttacttttcttcacaccataaattttgaagagctttttcgttatgcactgtgtgttacaacatatgtgcttaagcagtcaagcaagtatctcatatctgaattggaaagctttagagtattgacaaagaagatgtatgtatgtatgtgatgttgctggcctaagacaggccactgctactgcacacagagcaactgtatgttaacaactgctgtgctaggggcgtgtcccctgaagttagtgttgctagcatggaattgaaaatatttatgagtctcagacatggcatcacggtgtttgactattattacattagttacttttagtcactgttttattacaacattttaatgtacatttgttcacagtgtaaagaaactgaagtttttgtttgtttgttttttctttgtttctgtttttgtttttaacttttatggttgtgtgcccatgggcccccacaagaggtctctgtttgatctcatttctgtgctagtgatatttctaggagtccaataatatggggcatgttataatataccttttagaatgaagaaaaagtggttacgtatacattctcctacatcaaaaaaaggcgcaagagctggcaggtttctttgggttatgagaaacccattcctagtttgagtatgataccgtggcccattcaatgaatgtaatggaaaactgctacttttaaattgggcacagaataatagaaggcctgcaaaaagtccagagtgcaatgcaagctactttgccacttgtgccatatgactgcagatgcaatggtttttgaggtgtgactgggagataggaatgctgttgtatctttgataggttgctatacataaagcctggtgtaggtccttataattttggagcagagccttaaaaccttctgcagataattctttctttctttctttctttcttttttttctttcttttgaggcagtgtctgcctctgtcaacttggctagagttcagtggcataatcatggttcactgcagcctcaacttcctaagtgcaagcaattctccagtctcagcctcctgagactacaggtgcatgccaccacattccatggattttaaatatttttgtacatatgggggcttgctgtgtgtgcccaagctggtctcgaaatccttgcctcaagcagtcctcctgccatagcctcccaaagtggtgggattacagttgtgagccaccacaatcagccttaccttttgaaactattgtaaatggaattgtttcttcatgtcatgttgagattgttcattgctagtgtatagaatttttattaatatttttatattattttaaatcatgcaatcttaactcatttattatagtgggtatttgtgaattttcttttttcttttcctttcttttcttttttttttttttttttgagacggagtttcactcttgttgcccaagctggagtgcaatggcgtgatcttggctcactgcaacctccgcctcctgggttcaagcaattctcctgcctcagcctcccgaatagctgggattacaggcgcgcaccaccacgcctggctaattttttgtatttttagcagaaacggggtttcaccatgttagccaggctggtctcgaactcctgacttcaggtgatccccccgcctcggcctcccaaagtgctgggattataggcgtgagccaccacgcctggccgaattttctagaaagttttatatacaggatgtcatctgaataggcttccgatctttatctgaaggtcatgaatttatttttgttccatgatatttctggccaaaatctccagtatactgttaaaatagaagtggtaaaaatatattcttgtcttgtttccaaactaacgttctcaaacccaagatttcaacattatgcatgatattagctgtaggtttttaatagatgtcttatagcaggtgtaaaaattttgcttgtgtttctagtctagttagggttttttcataaacgggtctagatttgtcaaatgttctgtgtttttcagaatgatcattttgatattttattgttttattaagctgtattatattgactgatttttgaatgttaaatttgtattgtgagatacccctcttggtaatggtgtccaataattttcatttgtggctacatttattttgttattatttttgtggatttctgtgtcaatatggataagggataatagtctatagtctcgtagtgatttttcctgacttttgtctgggcaatactggcctcatggaatgaattggtaagtttcttctgttattcagttttgttttgttttgtttttttgtggggcagtcaactaaaagacctggttttaactcattattaaatatttggtcaaatttacaagtgaaactatctactgagcttttcttcatagaaaaagtttaatctctaattgttttggttctattcatatattctacttattcttgaacttactgtaataacgtatgcatattatccactaatcaatttctaatttgtagcatactatctttttatattttcattgcaataaaaagtaaagggaagaataatgtggaaagacaaagattttggcaatccatgtttccctagtgtctcagggtcctctgttgtagggaggagattattgtacttgttgtacttaatactcacatatgttcatgaagtagatgggacccatcatctaaagtaaattagagaactttgcaaaatgtaaccaaaataaaagtttgtgcctacctctcttttaatcaatatttagacgggacaggaatataaatttcaagaaaaacaaatacatatttcttggaggctttgttgatttctttttactgtttttttctctaaacttctcttcttgcttcatttcattcattttatcttcaatcactgataccctttcttccagttgatcgaattggctactgaagcttgtgcattcgtcacatagttctcgtgccatgggtttcagctccatcaggttatttaaggacttctgttaaccggttattctagttagccattcgtctaatcttttttcaaggttttcagcttctttgcaatgggttcgaacttccttctttagctcagagaagtttgatggtctgaaaacttcttctctcaacttgtcaaagtcattctccttccagctttgttctgttgctggcaaggagctgtgttcctttggagggggagaggcactctgatttttagaattttcagcttttctgctctgttttttccccatctttgtggttttatctacctttggtctttgatgatggtaatgtacagatgggattttggtgtggatgtcctttctgtttgttagttttccttctaacaatcaggaccctcagctgcaggtctgttgaagtttgctggaggtccactccagaccctgtttgcctgggtatcagcagcagaggcttcagaacagcgaatattgctgaacagcaaatgttgctgcctgattgttcctctggaagcttcatctcagaggggtacccggccatgtgaggtttcagtctgcccctactggggggtgcctcccagttaggctactcgggaggcaccctgtccgttcttgaggaggcagtctgtccgttctcagatctcaaactctgtgctgggggaaccagcactctcttcaaagctgtcagacagggacatttaagtctgcagaggtttctgctgccttttgttccataactatagttattaataatgtattgtacacttgaactttgataagaaaataaaactcaaatagtctcaccacactaggaaaaggcaactaggtgaggtgtgagggacatgttaattcgcttgattatattaataatttcacaatatataactttattagaacatatatgtaaggtgatacaacttatacaatttttatttgtcaatcatatcccaattaaaatggaaaaattaagtgtaaccaaactaatgtctagccacatgcaaattttatttagacccatttaaataaattctagattttcaatataaaatccaaactgacataatttttacagaatcaggaaaattctaatgaggaagcatgatattaaagatataattgaatagtcataatacctaatacccctacataataccataatatccctacttattaaagtaggggtaaattaaaatattttcaaaagctaaaattttgagagatttgattaccaacaggagcttaagagtaccttttaagaaaaaagaaacatttactaatatgaagttaaaatgaaaattaaagagaaaaagatttgatatgagaatatcaatttatggtagatattgaacttagcaagctataaagtccttagtaatatcagcttcaaaagtattcatatataattttaaaaggtgatcttatacacattggttaaatcagataaaaaatgagctacttgagcagtttaaataatagcagatgactatttttcagaaaacgtttttcatcaatagcttgttaaaattggtggcacatcaattacaattctgcagaatacttttttttttaatcagaactaatttgtcccagtggaataacagtggcatatgcattgagcacaagcctccggaaattcaggacaactgggtcatacacccataacaggattgaggatgttgaaataagaaggttcataggatacatgaccacaaagcaactcataacagcaggatggtctgggtggcccttttctctgaggagattcttggagagatgctggtgctgtggagctgggattgcttctgatttctgaaaaagaggatccacatgaatgcacttgagagcagcataactctgacaaggaaggcatccctggataatttcactccctgatgatgaggttcatggggaaaagtgagcagtgtttactgacattcaatagatcagtctgagtcacatttgaaaaatacacagtgaagaagattaggctgctactaaaagacaaattgaagaaccaaaaaagaagaaaaacattggtaatgtaatttgtaaatttatgtttaaaccttgccaaccatgagtttctgggactgacggtgatggcctggagcacactcaagagccaggggggacagagggagatgcctcttatcaccctttttgtgtaaaataatagcttacatttaaagccattcccaaattcagtgattcaaacacaacttgaggaaaaaaatccactgcagtaaggagcattagaatatgactgaggaccaagtggcagatgatcaagtcatggaactttggcctgggatccagaagaaatgtaaagatttgaaagaaaaaaaaaatggtattgatgaataatccaatgccaactcgaaaaataaaggcacttgttaatgataacataagtaaaaattgttttcatcttaatgacatagaagaaacatttttgtatgtctggaagaaacaatatacctcacatcatcaatgttcattctaaagtgacattatcccaatcatcattatttttattttgctcatttattcatcattaagcttatctcatatgaattcttgacaatcttcattattcatcattaaccttatctcatatgaattcttaacaatctaccttctgtgttattttgtacagtaaataatatatacattacatgttgttttggttactataactctgtagtataatttgaagtcaggtaatgtgattcccttagttttattctttttgttttatttagtttttttctaggtcttttaaggtttcatatgaattttagaatttttttcttatttctgtgaagaatgtcattggtattttgataggaattgcattgaaactgagattgctttggctagtatagacattttaacaatattgattcttctaatctataaaaagcaaattaaaaaaaaattttgtgtcctcttcaattttttaaaaatcagtgttttatagttttcattatacagatattttacttctttgattaagtacattgctaggtatttcattttatttgtggctattttttcttcagtttctaatgttactcatttctgtctcatacctcattagattggcctttaatgtccatatttttaccaacattgtcttcaaaattatttacatattttctaagaagatgaaaacttcctctgcagttgtattttcttcctgagccctcatcagaattcagcttgattacatatttttaatatgcacttccaaactctttgatgcctttatacatcattcagttccaaagctgcttacacatttaggtgtttattatatcaggaccccacttctccatatcaaaatctgtattagcatcctttagatgctatagtagaataccatagacttagtagcttaaacaataggtatttctttcttgtagctctggagactgaaaagtccaagatcaaggtgccagctgattcaattcctcagcgaactatctcttccttgcttgaagatagccaccttccctctgagttcttgcatgatagataaaaagcatgctctggctgggcatggtggctcacacctgtaatcccagcactttgggagggcgaggtgggtggatcacctgaggtcaggagtttgggactagcctggctaacatggtgaaaccctgtctctactaaaagtacaaaaatcagctgagcgtggtggtgtacacctgtaatcccagctacttgggaggctgagacaggagaatcgccaccatgtgccaccatgcctggctaacttttgtatttttagtagagatgggttttcaccatgttaggtaggctggtctcaaattcctgacctcaggtggtcctcctgcctcggcctccccaagtgctgggattacaggcaagaggcaccatgccagccagagttggttcttgattttaacatcccagttggcaaactctgcatgttgattgttgaatacttttatatttaatgtttctaaattttgttttctacatgtctcatttttttctttccttaactgctttcttttgcattaagtaaatacattttatcttacattttaatatctatatggcttttttctttgagttatttaattactgttcagactaggatttaatacatacattttaactcatcagaatctgcttcagatttctttttttactagaagcatctatttattgcacagttccaggttctttccaaataagccacagcccagtgctttattcagacatacgtactgtccagccagtttggaagaaggaaagaaaagtcaggcacaaataaagacacagaagtgttggggaagtgcactagaaaccatttatttcatttgaaatgacagaagtttgagaggagggggcaaacaaataagatctaataagttagctggatttgtcaatgataacatagtgatagtagctgattatagagtgtaccgggttggagaaagcaggaagacatataattgcaaacatttgaagtctgcagggcaggtgttgagtgtgggaactgtttgcttgagcattagagatgaaatgtgagagagatacttcaaaatgaagctaaacagtttgatctagtacccaggtaaaaaatgtattggtttgttaaaagaaatcttcactttaacacaagatagtgtttggttaagaaagtgggccacaaatatgatagtcataacaattaaggttaaagttagagctaattacacaaagatgtggctagttgttgtcacaaaatcaaaactgaatagtgtttaaaatgtggatgttctcctgctggatatgtgagatccagtgtctcttgagtagaaggaaccgaggagactgaaggttggggttgacagaacacatcaccatgggaggcatggccatttagaactccatgtctaaataagctatattgcaaagaacagtgccgatcctaaccctcggtgttgcttaaatagatggaacccttctgccctccgtaaagaaaattgatgaaataggtgggggaaataagtgttaaaatgcagcctgcattcgaattccaatgccaggtaccctggagcaaggctgtgtcacctggagaacagagcattatttctgggaatgtcagtcagaggagacttttttttctttctcaaaaaggtagttatagtccagctgggaccctaaggtcattggattacaataattgttttatttgaatggctatgggtgacacaggaggacattatgctcagtgaaaataaaccaggcacagaaaggcaaataatgtatgatctcacatatatgaaagctaaaatgttgatctcatagaaacagagaagaaaggtgatcaccagaggctatggtcggggtggaatgggtatagcaaagatgttgatcaaagggtacaggtttcagttaggctggggaaagaagttttagtgatctattgtactgaatgatgaccagagttcttaataataaattgtatatttcagaattgctaaaagaatagattgttagcaatttggttaggcgatatattaattagcttgactggatcttcctataaatcaaaatattacattgtaccacataaatatacacaattacctttgccaattaaaaaaagaaaattatcaggtgcaaggcttcctactgctataagaaacttcagtatttactatgaaaacattcttaagtcaccagagtcacactgggaagactgacatgacattctcattacttagacaggagtgttattgggagaatcctgttttgttgacaaatactgagatcatccaactcaccaggcaaagttgacttgtgtaagtgatcttcagatatgaaaagtgtggaacccagctgctcctcctcagataggtaagttcacttttccctttggtggctcctttttccaccaatctcaacatctgctcttatcctttttctacaggcgacatgacaattgtaggcctggagggagatgagttgacaacatcccttccctataaccacttgttggatctgatctcacatacacagactcactccaaagactgacctgggtgtctgcttctcagcttcattaacagtgggtgctcacaagtctaggtgagtggtgaatcgagatagaattttattagctagttgttagaattagctcctaataatttcagtctgtggttcattgaattctaactatcataagaaggtgtttccagatacaaaataattaatcttatgaagtaacaaatttatagatttgtagaaaaacatttagatttttggagatgttctacttgaatttgtatacatttgacttttctcaatataatagctgaactctcaatataattagctgaactacaactttctgcatttatgtgaagttttaatttgtaaacacagaaatctgaactaataaaattatttagtcatacttcttgcttctttaaactttgaagattgctttatataattctgatattttagaactgtttcaaattaggatgttaaaaacacaagatatgtctaacattttacagtaataagattttagcagatacccagattcttttgtttcatttcattatagtaattgccaatagagatttttttcttgtgatattaaaactatctgaaaatataatgttctgctgtttatataaatttctgttgagctaactactaccttgtataaatggggaggaggtgatactcagtgtgctttgaaatcttttcctaaagtaaattgttttagtatggtattgtttctaagtaaaccaaaactttaaaatactctgtgtattagtttgggtgaggttatttcatgatgagaacaatggtattaaaacaatggtattttcttattataaaacatcctcttggtttagtatttctgcttatacctctgaagactaccaactgcaatgtgttcaataaaacacagtccaaaatgtgacaagtaaatttggtttttaaaaacacaaataatcattgtctgtattcagcaggcatatcgtcatcaagcatgtgtgtttctttaaagtagaaaacagagaggatgaaatcaggataagtaaaacacagaaaggaacaaatgatgataaaataaatttgtggtccatgtgggcatcaaaatattaaggaacatactcagtggacaattgctatatttctgaatatgaatgaatttgtcttaaaataatttgtgttgaaagcccctgtcttccatgcatagtggagagaatgtctgagaagaggaggaccttgactgctcctgaaccggagacctcaggtacacaaggcatgccctccattttcctccaaattctccagttgaatgcaattggtatgactatgatcttctcattactgtgatgcacagatatctgatactaaaacaccacataagcattttcacataagaattgtatatttcgctggtatcttctaggttgtgttgattacaaaaacacatttccaaacaggtttatagggtttcccaaaatttataacacaagatttgtggtcaaacattttgtgtgtttttctgtctcctacttttgcttttttattctgttttctcctttccttgggaaagctgagaattaaatgtctttaagttataatttccttgtcagcagcattgtgttcctagctgttcctacactaatttcaaattccaagaaaaaatagtagctgttttatcagttactcactactgtctcatgtttattatatttattcttcaccatttatgcatttcataaaggtaatttcatggaattaatctagatggaaaggtgttttccttcctgccactgtcagctatgtttctcaggttgccaaatattgccattgggttaacaaactcaccctggccttgtcacctgaaaacttcattatgacttatgctgtccaagaacagcaataggttgtgcaatgctgttcatagaatgtgggaaaaatttacaagcaaaataatgccattaattaatacaataataaagcaaaacacatacataaaggcagagtacaaagaactgtactaaataatatgatttataagatgataaaactctaaaattatattactataaatatgagacaatatattactataaatatgagaaaatagattttatcaaattttattttctccaaaatattttttatgcataatagcacttaggatattataagtagcttcttacttttaacatgttttcctattactttggatgtctacattaaaaaacttttgtacctagtctatttgatggtgctattttctccacctttatctgtgcttatgttcctgcttttgaatttacaatattaagatagcctacagtgaagccataatactaagaacgaactttaactgcattatctgagtgctcaggagcttcacgcttaggccaacaatctggttgtcactgctaatagtaaatgctgagatgtacattcagatttatgtattttaaggcagctgttagaggcaaattctcctttatactctgaccgatatgactttcatgtttttttctattttgtttttatgatactaaccatgttatctaaatttcataattctttcatggtggggtttccagattcaccaaataacaattcaagttgtagttaagtttgaaattcagaaagatgaccgtaactttttagcataactatgaaatattttgcatacttgaatgtaatagttgtatgtgatactttggagatacatacaccgaagtagttattcattttttacctgaagtttaaatactatgtgttgtgctttattctctgaactctaattcacagaaccatggtgctctcctgtccaggctgaacactaatgctcttgagagtcacattgaagaaagccaacatttttaaatctaatggatacattcattttgtggtatgtgatgtttagaaagagggagctaaagttagtggtcatgagctaaataccctgtgaggtaagaaatgaaaatattaacattattatctatgttcttttatgtgataaattttactattttggggatatgacttgtgatagatgcagtatattagtaaaataattcatatatagttactaaatgattacacatatattagtggttcgtgcccaaatattattttactggtactggactgtgattcttaaaatgtggaaattattgtgccttaatactaatcttacacttgttcccacatagcagtagaagtcaactgtgcttagcatggttccatacgttggtagtaattatcagttatttggtttttgtattaaagataaatggattccttcagtagattaagatgtaggaaaagtgttataacaatttaacaaaatatacaatattttctttatatgttcatacatattagtcagttttagagcaatattctccaccatatatgaccttctgacttgaagccaagaacactagcagaatgtctgcattgaaaacataagtaaacattctttcatctcagggaaagtatctgaatgcctatgcacttttccattatttatttattggtgtcatcagctaaactgttctcagcattaaattgatttatatggttgaaatagtaatgcctgcatctagaaaaataacatgataatatcattgcaaacttattcagtgaaattttacaaagggttctaatgtgaaaacatcttgattaaacttcaaaaaagaatcttttccatagaagatctaaatatttttaaaggcacaggaggctatccctccattaaaatctcaagaatagcatcaccatgtaaatatttcaatacaacctcacagatgtcaaaatgtaaagaaatatggtgactgtctttccaaaaattgaaagctagattttaacaattttcttgtgagatgaaaatagtttatataatggatctctcaaatttaaagtaaattagaagatggccagaataatatttaataaaaatagtgaataagatcggtgataaacagactaatgcttttccaacggtgtccacatcctaatccccagactgcagatatattaggtcatgcagcaatgggaaataacattgcagatagaataaaggttatagtcacttaactttaaagcagggaggttatcctggattactagggtgagcttaatataatcacaagggtcctgaaatgcgaaagagaaatagagaagagaaagtgtcagagtgatgctgtcttattagtccattcaagatactataacaaaatatcatagactgagtaggttataaacaacagaaatttattattcacagtgctggaggctgagaacttcaagatcaaagtactggaagatttactgtctggtgagggcctgtatcctagttcagagatggcaccttctacatgtgtcctcacacaactggaagggcaagccagctccctagaacctcttatagaagggcgcagatcccatttatgagggcttttgttgaaaatgtcctaactacttcccaaaggtcctaccttctaataccattacactggtggtttggttttaacatacaaatttggagaaaacagaaacatgcaggctgaaattaatgtcatgttacaaagactcacttggacattctttgttttcagttgcatgttttgggggttcttttaccattagcataaaatttgcttcagctcagccatacaaacacttctgcatcatatacatgcctgtcaccattgtgtgtgctgaatattaaacagtgaaatacagaacagtaaagcaaagttttctaaagagtaaggccaagaaccgtaggagcatagaaaatgagtacattacgtagacatgatagtggatatgctggtgttttacatacactacatcatcacttaatatcatgataggttttagaaatgtgcaattttaagtgtaaaagtttgttttattccatagaaacttagtacctgttgatatctattagcctatggttaaattggtttcatgatacagtatatcattttgattaaagtcaatttttatgaacctagtgattacattaagtgatcacttatgtatatgtatacatatgttagatatgtatgtatatatgtgtgtgtgtacataggctgggcatggtggctactttctgtaattctagcactttgggaggccaaggcagaaggattacttgagcccatggacttgagaccagcctgggcaacagagtaagatcctgtccctacaaaacaaaacaaaacgattatgcacaaacacattatatatatgttacttggcataaaattaatgctgactatatatatgtgtaatgctgacatatacatttacatatagtgtctctcacacacactgaagcattgtgcaaataaatacatgtaatgccgaaggagtattttctaataatttatattacattgtaagtcttaataattgggagaaataaacataatcatagttgtgataattttaactatagaacagcactgaagatgtctaaacttgttttttcagatatacaaatatgtttcctctttgccactacaatgtacatatatatcatgtatgttattaaaaagctgctttgttttacaagttgctgttggaatctcagtcaatacttttctgttcctcttcagcatcttcactctccttctgtatcacagactaaaacccactgacttgatcatctgtcccttgcccctcgtccacatagtgaacttcttcattgcactgttattgcagtctccaaatctgtttgcatcattgaacttcagaatgacttcaagtgtaaggcacttttccacctgagcagggtgttgtggggcctctctatctgcaccacctgccccctgagtgtgttccaggccaccaccatcagccccagcacctcctgattggcaaggtttaaacataaatcttcaaattacattatccatgttttcttcttcttatggttcctcaacttgtctttcagtagtaacaggatcttctacactgtagctgcttccagtgtgagccagacaaatgtactgaatataggtaagtactgctcagttttctccatgagcttcatcctcagggccacgtttcttattctgacaacacttagggatgctttcctggtaggaatactgctgttcttaattgcatacatggtgactctcttattcaggcctcagaggtgatcccaccaccttcacagcaatggtccttccccaggagcttcccctgagaaacgggccatccagaccatactgctgctggtaagtttctctgtggtcctctgttgggtggatttcatcatctccttctcctcagcaatgttgtgggcatatggcccaatcaaccagcaagttcagagtcttgtagtcaatgtctatgccgtgatcagtcctctggtgctcctcacttcagataaaagaagaaccaatattctgaaaaatacacaacagaagtgtcatagatttaatatcaattaataataaaaataattcttggaaaaatgagttcttctgccatcagttaaatcattccagtagcagataacttactttaattaattaaaatatgtaaaagtatacttttattatatctaaataattttgaaactgatgctgccaagaacttgggtgattttttaagtttgatgtgtatgttgactgaagtcccatatgtcttagaagtttcttacatttcattttgattttgtaaagtttatacaaggaaacttttctgtcttcttgagttacatcgttaagaagctcactgttggccaggcgtggtggctcacacctgtaatcccagcactttgggaggcagaggctggtggatcacctgaggtcaggagttcaagattagcctgaccaacacagtgaagccccgtttctactaaaaatacaaaagttagccggacgtggtagcaggcacctgtaatcccagctacttgggaggcggaggcaggagaattgcttgaacccgggaggcagaggttgcagtgaggcaagattgtgccagtgcactccagcctgggtcacaaaagcaaaactccatctcaaaaaaaaaaaaaaaaaagaagaagttcttattgtttataaaagtgttttactttataaatttgtttaggctaccctcattcataaaagatattttagccaggtatccagtataagaacaataataatttttctcggcactacttctctgctctctgactctacacaggctttggacattttgctcttatatttataggtggtttcacttttctttctcacacttcttttagttttctgcttatctttagtattttatagtttgttacattgagttgtatttttatatctttttggtatagtacaattacacatttaaatatttgtatatctgatttacaactttagaaattagtaaattgttttactactgtgattcattattttatgtattctagtgaattgtttttattctatttcaatacacataattatactcatatttttatttatttttatttttatttttgagatttactgacttttttttattattatactttaagttttagggtacatgtgcacagtgtgcaggttagttacatatgtatacatgtgccatgctggtgtgctgcacccattaactcgtcattcagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgaggatgatgatttccaatttcatccatgtccctacaaaggacatgaactcatcattttttatggctgcatagtattccatggtgtatatgtgccacattttcttaatccagtctatcattgttggacatttggattggttccaagtctttgctattgtgaatagtgccgcaataaacatatgtgtgcatgtgtctttgtagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgaattatactcatatttttattaccttttgtttatctggtgatatttattcttctaaatattataattcactattatttttgtcagttcagcctaatgccaaacactgtgcattgaatttatttatttttcaattgttcaacttctttgtggttcttttccaaatatgcttgttaagtttatagtttcttgctttgccaaaatattttcattttctattttttaccatttacttcacttaagcattttaaacacattttcaatatctgaattttatgtgatgtctagtttcttctaattcttcatcttggtagcttcttttgtacttcatagtatgtgagaaattataatttaaaaataattttggttttgtatttgagagattttgtacaaaataactttagtcagtactttttttgttgtttattccaagaaggtagttgaataatccccaaagcctgaggtccctgtgatcatccagtacctggaggcggcactggcttctcactttgattactcctctgggttgttcttttaatttacttcttgtcctggaaggttccatgttttctattagctttggtgggtattttatgaattcttgtaacttctgagtattttcagatgtctgcatcaaatgagatttgtaaatacatttttgttctaaaacatcaaatattcaccatgcatctgtaagtaaaatatttcacattgatatttgttgcagaataatgtctcattggaaatctcaacattcttcatttagaacaccaccgccaatatctaccatatgccgggattattgtgcagggtaatttttattattacttgaatgtatatttatatactgcaggaactatacatgtttatggctagaattactgtttttccttaatattaagatagtattggtagatttaattatctgaatttagtcatttggctccagtcaaaatggtttctccttagcagtactctgactttgtaaaagtaatcacatttggattctgtttcctccagtagtttttaaaatgatttttttgattattcatataacttttttttaatgatcttttaaaaactagtatgtggttatatattacttgttacactttttgttttctttattttttggttggttacaccttaaatgattatttctattgccttttaatgttacttagaaaatatcacatgtaagacttttgcttttataaagttagtaatacattttcaagcctaaactcttgaaattttaataatttctatgatatttgaaaattatttttatcttcttttgagtgctaaaagataatatttgtctacctgattaactagcacaacttttaaaaagttatttagcactctttatattcattcatttgttttctacgagaaaacttctttctctgatatttgtgtgtttgttttagagatgggatctcaccctgtcacccaggctggagtgcaatggtatggtcatggctcactataacctcaaacacctgggtttaagcagtcctcccatctcaaactcccaagtagcaaggacgacaggtgcatgccaccatgtctggctaatttttaatttgtagacattgcccagcctggtttcaaactccaggcctcaagttatcctcccaccttggtttcccaaactgttggattataagtatgagccactgtgcctggcctctagaatgattttaatgtcacctaatatttttataaaggtataaattcctcacttacatgaaaatttgggttacacattaaactctttgttattaaatatatacatacaaatggcttggaattgtgcctaaaacatcatatatcctaagtattaacaactctggagctcagtacaatggctcacacctgtaattccaaacactttgagatgctgctgtgggactgcccacaggagttcaagacaaggctggaaaacatagtgagaccccatctctagaaaaaaatttaaaaattagcctggcatggtgacaagtgcctgtagccccaagctactcaggagggtgaggtgggaagatcacctgagctcagaagtttgaggttgcagtgagctataattgtgccactgcactccagtctgagcaacagagaccctgtctctaaaaaattttaaaacaactctaggccgtgtgtgttggctcatgcctgtaatcccagcactttgggaggctgaggtgggcggatcacaaggtcaacagttcaagaccagcctggcctacatagtgaaaccctgtctctactaaaaatacaaaaaattggccaggcaaggtggtgggcacctgtaatcctagctactcagcaggctgaggcaggagaatcgcttgaacccgggaggtggatgttgcagtgagccaagatcacgccactgtactaaacaactctgatatattaggtttttatcttttcatgccattcttaatttaccatgtcattttgtatatgtttttcttgaaatttatattcctgtcccgtctaaatattgattaaaagagaggtaggcacaaacttttattttggttacattttgcaaagttctctaatttactttagatgatgggtcccatctacttcatgaacatatgtgagtattaagtacaacaagtacaataatctcctccctacaacagaggaccctgagacactagggaaacatggattgccaaaatctttgtctttccacattattcttccctttactttttattgcaatgaaaatataaaaagatagtatgctacaaattagaaattgattagtggataatatgcatacgttattacagtaagttcaagaataagtagaatatatgaatagaaccaaaacaattagagattaaactttttctatgaagaaaagctcagtagatagtttcacttgtaaatttgaccaaatatttaataatgagttaaaaccaggtcttttagttgactgccccacaaaaaaacaaaacaaaacaaaactgaataacagaagaaacttaccaattcattccatgaggccagtattgcccagacaaaagtcaggaaaaatcactacgagactatagactattatcccttatccatattgacacagaaatccacaaaaataataacaaaataaatgtagccacaaatgaaaattattggacaccattaccaagaggggtatctcacaatacaaatttaacattcaaaaatcagtcaatataatacagcttaataaaacaataaaatatcaaaatgatcattctgaaaaacacagaacatttgacaaatctagacccgtttatgaaaaaaccctaactagactagaaacacaagcaaaatttttacacctgctataagacatctattaaaaacctacagctaatatcatgcataatgttgaaatcttgggtttgagaacgttagtttggaaacaagacaagaatatatttttaccacttctattttaacagtatactggagattttggccagaaatatcatggaacaaaaataaattcatgaccttcagataaagatcggaagcctattcagatgacatcctgtatataaaactttctagaaaattcggccaggcgtggtggctcacgcctataatcccagcactttgggaggccgaggcggggggatcacctgaagtcaggagttcgagaccagcctggctaacatggtgaaaccccgtttctgctaaaaatacaaaaaattagccaggcgtggtggtgcgcgcctgtaatcccagctattcgggaggctgaggcaggagaattgcttgaacccaggaggcggaggttgcagtgagccaagatcacgccattgcactccagcttgggcaacaagagtgaaactccgtctcaaaaaaaaaaaaaaaaaagaaaagaaaggaaaagaaaaaagaaaattcacaaatacccactataataaatgagttaagattgcatgatttaaaataatataaaaatattaataaaaattctatacactagcaatgaacaatctcaacatgacatgaagaaacaattccatttacaatagtttcaaaaggtaaggctgattgtggtggctcacaactgtaatcccaccactttgggaggctatggcaggaggactgcttgaggcaaggatttcgagaccagcttgggcacacacagcaagcccccatatgtacaaaaatatttaaaatccatggaatgtggtggcatgcacctgtagtctcaggaggctgagactggagaattgcttgcacttaggaagttgaggctgcagtgaaccatgattatgccactgaactctagccaagttgacagaggcagacactgcctcaaaagaaagaaaaaaaagaaagaaaaaagaaagaaagaaagaaagaattatctgcagaaggttttaaggctctgctccaaaattataaggacctacaccaggctttatgtatagcaacctatcaaagatacaacagcattcctatctcccagtcacacctcaaaaaccattgcatctgcagtcatatggcacaagtggcaaagtagcttgcattgcactctggactttttgcaggccttctattattctgtgcccaatttaaaagtagcagttttccattacattcattgaatgggccacggtatcatactcaaactaggaatgggtttctcataacccaaagaaacctgccagctcttgcgcctttttttgatgtaggagaatgtatacgtaaccactttttcttcattctaaaaggtatattataacatgccccatattattggactcctagaaatatcactagcacagaaatgagatcaaacagagacctcttgtgggggcccatgggcacacaaccataaaagttaaaaacaaaaacagaaacaaagaaaaaacaaacaaacaaaaacttcagtttctttacactgtgaacaaatgtacattaaaatgttgtaataaaacagtgactaaaagtaactaatgtaataatagtcaaacaccgtgatgccatgtctgagactcataaatattttcaattccatgctagcaacactaacttcaggggacacgcccctagcacagcagttgttaacatacagttgctctgtgtgcagtagcagtggcctgtcttaggccagcaacatcacatacatacatacatcttctttgtcaatactctaaagctttccaattcagatatgagatacttgcttgactgcttaagcacatatgttgtaacacacagtgcataacgaaaaagctcttcaaaatttatggtgtgaagaaaagtaaatatcctgagttgtttttcattaattcagtgttgaaggaagccttgtttcttctgtattacacatgtgaagtacaattttgataaatttattagtggtgaaaatatcatttaaggaggaaaaaatgatataagttgaatgataacacacacatatttctggcttagaatttgaggaggtggaggtggaataatgtctctatttttggcaggagcctctgagaataagtgcaatgggttaataaggcggaagggcctcagggtgctaatttcttctccctttgcccagaaatgagctgtgacatcactcagggctttctccttcacatgctccctttctttgcgatctgctgacgctctctgtgacagagctgtttggaacttaccttgtgaccccattgtgagctgctagctcccatctccccatccagagagcagctcctagtgccgatccccaagtgcagggtgctctgagtttctgtcctccttgacaaacctagaaatgggaaagagagatttcagggtgggacttgagccataattgatccagggtcagtctgtggcataagagctgcacctcagcctagagcacatgcccaacatgctcgtcaccaaatgttcagtcaaggaccctctggggcacactgtctaggctgacgtatagcccttttgatgctttcttcttgaatgtatttaccacagtccctgactcagaatagtgctcaataaatagcatgtttcctctttttcctgccagggagttaaaaaaaaacaaacaaacagctacatgggaaattatagaagagaaagaggtttatgattgaagtgagggtcaggaacttttgtggatgaggcagactttagccaagatttgaaggagagattcattcattcattcaacagatgctgcaatatacctgatatgtttcaggtattttaatgaaataagaatagggctgggcatggtggctcacgcctgtaatcccagaactttgggaggccgaggcggggggatcacctgaggtcaggagttcaagaccagcctggtcaacatggcaaaacctcgtctctactaaaaatacaaaaattagctgggcatagtggcgtgcacctgtaatcccagcttctcaggaagctgagacaggagaatcgcttgaacctgggaggtggaggttgcagtgagccgagatcatgccactgcactccggcctgggcaacagagaaagactctgtctcaaaaaataaaaataaaaaagaatataacagtgaccaccatcacaaggtgttcaatctagtgaggccgagaaacttcccccaaatcatcacacaaatataaacttcatgagagcaaactcaatgtccaataggaaaatggtaaaattatgaaatgttcttttgatttaatgttatatagctacggaggttgtttcaaataattataaaatgatcataagaactgttatattctaaaagtatggtataaaagtacagagtataattcttattttataaaaaataaatgcatatttacctctgcatggaggtggttctatgtcacacaaacctgtggttatttatccctggtgatgggattagaaagcatagaccacattctcttaaaagagtaaggctgtggccaggaggcaagtagatttgtttttccactgtttgaatttgcaattagatactctgcatgctttaaatgtaatggaagttgtgatatatactcatattctcatggtaggttgttccattttggttttgatgttggggaggaataaggtgaaggtccctgtggactcttcttgttcagtggcacacgtgtggtcctggggaaagccgtcacacagtgggcgctgaaaaatgtggcctatggccacgaattccctttcagtccctgcctaagcaagattcatcttcctctgcctcctttttcatttcttttcttctattgtctggtatttttgaagataaaaatttgtttccaaaggggaagttccagaaattcttccaagaataatgatggaagtttgatttccaagtgagtgagtattcctgggcaactgattaaatccctttgtcaatactaaaaatctggcttgttctggattagttccaccatctcaccatgataactccctcttctataatccccaccagaaatgactgctttgcttgaaagcttttccctgagaagtcagtggtgtgttactcctttgtcagcttaaaaaaaataattatacatttctgggattttgttttgtgtccctgtgtttttttaagcaactggtgttttcaagccaaaaattagaagtattatggaagtactgatgatgtactcagaggaaaacaataaagcatatgatttatttgttataagatgtaaaagttctagaagattttcctctgatttgtaaattttttcctctcaagaaagtttttccttatgttttataatttctttattttaaagacctgctgggttacttaaagtatgatagttctgttggtggagtgaggataatgctgcattcaacctgccttttgtggcatcttgcttaccctactttgcagaacagagataccaagaatcggccttatgaagctggggctatttttgcattgtgatttcagagatgctgaaaagacctctgactgatttcctaatactcaaaatgatacagtaagggacttgggagtttaggtcttaagacttttcttcatgagtttctgttaaaatctaagataaaaagtagctgccttgaagaatcttaccagggtttgctgccagccaactgaatgacttattggagaaaggactcatgactcctgggcctgagggacaggcagacagggagatggcttcagcaaggattttccacaggtgaccctggttctgcagtgacagaagctcctgttgcacaaggttgtaaaattattcagaaagagtagggataatgcacctacattttacctgctttcaaactcgttgacaatttacttctgggaattattttttctcttctccagttaatttatagtctatctcatttcttgtcttttctgccaaccattgtattttttcagggacagttgcgagacataaactatgatttcctatcagagtgcttgttacaattccgttctacttttctgtgaaaatgtgcaaccttccaactctcagtcatcatctttcccctttctcaattcttattttgcttcttgcaagtgtttttcttttcttttctctctctctctcttttttttttttttttttttttgagacggaattttgctcttgttgcccaggctggagtgcaatggtgcgatctcggctcaccacaacctccacctcttgggttcaagcaattctcctgcctcagcctcccaggtagctgagactacaggcatgcgccaccgtgcctggctaattttgtatttttagtagacacgattcttctccatgttggtcaggctagtctcgaactcccaacctcaggtgatcttcctgcctgggtctcccaaagtgctgggattacaggtgtgagccaccatgcctggctgcttcttgcaagtttttgaacatgttagtgaagaagcagttgagtcattttgtgaaataaatttctatttacaaacacagcaagatgacacattcatggactccaaacataggtagagctgtccctccttatttctgcattcctggattcaacaaatgtgaatcaaaaatattttaataaggtttctgtactgaacatttacagaattttatttttcttttcactattccctaaacaacacagcataacaacaatttaggtattaaaagtaatctagagaagatttaaagtatgcaggagaatatgcataggttatatgtaaatactatgccattatatataaagaacttatacatccatgcattttggtatccaagaggactcctagaacaaatcctccagaaatagcaaagaaatatgataaagagtttacagtgttcataaaactctagctgcttactagaacaacagttcgatgaaataaaaggcagacttgaaactgtccttggcctgtatggcttggctggcagcccctggcttgcatgccccttctagcaagatgcacgttaaggccactatgtgcagctgagggagagtcaggtggctcttcaccaggagcagatcgcatccttcttttgtcacatttctgcctcttaagagtgtcatgctgagaggcatgccttcttgatgcagaaaagaatttgttggcaagctctgccaaacatctgtttccatgtacttcctatgtacccacagttgcagatcatgggaaattagatagtttatcaaaaatagctttcactttttaaaacgttcctttttagttttggttgaaaaagacagaagacacagtcctaatttcagaaatgaaagaggatctatcattactgatcccatgaagaattaaagaataataaagaaacattataaaccactctttgcccacaaatttggtaacccaaatgtaacagacaaattctttgaaagaaacaacctacccaaactcacacaataagaaacagacaatttgaatagtactacatctattaaagaaattgggtcaatgataagtaaccttaccaaatagaaagtaccagacccagatgaggtaactagtatatttatgcaaacatttaagagaaattattccaaccctctacaatctcctccagaaaacagaagcagagtgaatactttcaaactattcaatggggccaggattaccatagtgtcaaattcagacagagacgttacaagaaaaaaatgcaggacaatatctcacatgaagaaagatgcaaaaatcctcaccaaaatattaagaaatcaagtccaaaaatgtaaaaaataattatatactgcaacccagtgagatttattacaggcatgccaggctggttcaacatttgaaaataaattaggctaagtgtggtggcttatacctgtaatcctaatgcagtaggaagccaaggagggaggatcacttgaggccaggagttcaaactaagcctgggcaacatagcaagactctgtctttaaaaaaaattagttcatcatattaagttttaaaaagataagatttcatcagtacattcagaaaaatcatttgacaatatccaaaacccattcatgagaaaaactctccgcagactagaaatagaggaaaacttcctcaatttcataaataatgtctattaaaaaaacctgcacctggccgggcacagtgcctcacgcctgtaatcccagcactttgggaggctgaggtgggtgcatcatgaggtcaggagattgagaccatcctggccaacatggtgaaaccccgtctctactaaaatacaaaaaagtagccgggcatgctggtgcgtgcctgttgtcccagctacttgggaggctgaggcaaggaattgcttgaacccgggaggcggaggttgcaacgagctgaggtcacaccactgcactctagcctggtgacagagcgagacgacatctcaagaaaaaaaaaaaaacctgcatctaacctcatactgaatgtagaaacactagattccttcctgctaagatcaggagcaaggcaaagatgtctcctctcaccattcctatatgatattatactataagccctaggtaatgcaataagacaagaatagaaaaggtacatagactgggaaggaagaaataaaacagtctttttacacagatgatataattgcctatggagaaatacaaaaagatcacaaaacaaaatcttagaataaccaattttaatgagcaattatagcaactttgcacaatataagattaatatacaaatgtcaattactgtcctatatatcagtaatgtaattagaatttgaaatttaaaaattcagtgacatttatgctagcaccaataacaatgaaattctttaggtacaaatataagaaaataaatataaatatagaaaccatatgaagaaaactacaaaactgtgaaaacatcaaagaagatctaaataaatggagagataatccacattcaagtaaagagggattcaacgttgttaaaacgtcagtacttcccaactagatctacatattcagtgcaatcccaatcaaaattccacaaagctagtttgtggatattgacaaactgattctaaagtttatatggaaaggtaaaagactcagaataaccaagaaaatattttaaaagaacagttataggaatgacactacccaactgtaagcactactataaagctacagtaatcaaaacacggtactggtaaaaaataatagagaaacagatcaatcaaacaaaagataaagctcataaattgacccatgaaatatagtcagcttatctttgaggaaaaagcaaaggaaattcaattgagaaacaatactttttcaacaaacagtactggaacaactggacatccacatacaagagaaaagaagaaaaaaaaaaaccctaaacccagacctgacaactttcacagaaattactaagaatggatcatagacctatataggaggaaaactcacaaaactcctagaagataacaaagagcagaatctgaattacctcaggttttgctcctctgataaaacaccagaaacgctgggggcggtggctcatacctgtaatcccagcactttgggaggccgaggtgggtggatcatgaggtcagtagattgagaccatcctggccaacatggtgaaaccccatctctactagaaatacaaaaattagctgagtgtggcagcgtgtgcctgtagtcccagctacttgggaggctgaggcaggagaatcacttgaacctgggaggaggagggcgcagtgagctgagatcagccactgcactccagcctgggtgacacggcgagactccattacagagaaatgaaaattataaaaagaatgggatacagagataatgaaatgaaaaattaaaaagacctttgagtttataaacagagtagaaacagaagacagcaatagaaatcatcatcatccaatctgaagagtgaaacaagtttgaagaaaatgaaaagctccttagagacctgtggaatgactgagtccgagaaggagagggagagacagaaaaattaaatatgatacaagagcaaataaacaactcatagctgaaaacttgcaaaatttggtcaaaacctcaaatttgtatattcaaaagatgagcacacttcaaaagaaaatacacataaaaccataccaaggccctattagaaaactggcagggcagggttttcaagggacttgctatgatttctcattttcactatttataataatggacaatatgctctccttagagttttcttcctgcagaaagtctgatatgtcaggtgcagatgactctttagtctatttttcaaggtttaatttcttaccttggaaatcaattaaatttgttttttcaaaattttgcagtaaaattgatgctccgaaaagatgcccagggagattctgtcctgctgcgtccgccctgcacagaactaacgctatgccaacgccagtttcaaaagcgtgtagttgtggagtacttaagagttaatctaaaaaagcgaatagaaaaatggattcaataaatgatcactgttaagttccatcggcaaagtcttaaaagtggttccaaagggagtatttaataagaggtaaagatttttccagggcaccctattcagagcaaaaacaaagacactgtccaaacctcaccacacaaacttcctcatgtgttgggaggaaccaaggcgctctctggtcctgcacctgtgttagttatggccgggaggtctacactaggaccccaaggcctgggaaccagcctgggtgggggacaaagaagtggtggatgtggctcgcaaagtagtttaggtggtcccttccccgtggcagtttcctgactggatgcagcagggtcaggcctttcccctgggacattttctcatcgttattatagtggcaggagcgcccctgtgcgaggcctgacccaggtgtgggccatgcagccagcccggggtccaacaggtgcatctggggagtacagggggattcgtggcagcccagagagagagaaaaaggtggttttcaaaagggaagtgccaggttaccagagactgggtaccttcacatgaggcagtgagtgagctaatagtttcggacactcacgagggagcttcccgcgctggaccaaggggagcactacgcatgtctgaaggggtgtggccaggggagggacaataagaggacgtggctaaaacgagtggcccttcagagggaaagggcggtgtcgagccggctgctggggggggcgggggcgcaagcgttaccatagcaaccctgctgcagagtctgtgagaggctcttggcctctacctggtctgtggaaaatcaaactctgggcacaagtcatgaagccagcacgttggggagacaccgtgtcacaatgacaaggtgagatcagccgccctggccaagctgtctcctcgcgggcaggagaggtttgtgaacagccaagcttccctccgcacggcggaactgcactggaagcctggaggagctcggtggaggagggacctttgctgggaatggggggagctgtagtctcttatccgcacccagctattagtcgtaggctcgcaggactacaatcccagcactaaacaggattgtgagcggtgcggatccctggagggagacatggcgcggtttgctcctgcggggtatgcaggcaggagtagttttagccgcttccggccgttgatcgcaggcgatcaactacaatcccagcatgcaacgggagtggggggtggtgcgaatgcctggaggaaggggccgcgtggtgcgcgcctcgccaggcattctgggagtagtttcttaaccgctttcggctgttggtcgcagggctaccggcctacagtcccagcaagcgccgggctgcggggtggtgagcagtcccggagggaggcgcaagccgtgtggacctctctgcttccaaacctatgctggccactgattctgtgccatccctggctaaggggagtgagtccagagagggacttaaggggcaagtcggggctgggcagtgagaagagtgtgacgctgcgaagtgcacctcatctttgcctaaatcgggcgggtctcagcctcaccccacctctcgctgctcagctcggtttccctccagagcatcacgcctcctccagcacaggagccgcctgctttcctaggctgctgtggaactggcctgaggtcccagacgctgtccattgtgctgccgccctccgcgctctccagccagagcgccagttcaccggcttttgggagaactccgccgcctcacctgcccgcggacaaggtcacagctttgcagggggttgacatgggctgtggcttcctggaaatgtcaccctcaccagagccttttacatggatgtgaattttgagacatgaaggagggtaattattggtttacccaggagatgctaagagcagaggagaaaaccctaatttccaggcatgtgacttgagccagggacaggctagccagaccctgagcccccagtgccgccagagagcagcctattgccctggtttctgtggaagtctcttcatgctgctgggccttagcctcagggacagctcagtcaggtgagggtggggatgacccatgggcttctggagctgggctggtggtcctggaagggccggcccatgccccttggagagggtctttgtgctgagggatgcccacagaggcctgggtaccaggaacactgctccaggcaaggggcctttcttccagatttggctggaaggaagacttggtcagcttttccaccttgcagggctgcaccccatggacctgggttcctggagtctttgacggctttgtgtggtcgacttgttttgatactgaggacacccctgctggctgttaatttcagggcaagggatatgaggccattattttaagtgaaataactcaagaatggaaaataaaatactattatttttcacttataagtgggagttaagctatgcgtatgcaaaggcatacagagtgatgtaatggactttggagactcagaagcagagagtgggaggtggatgagggatgaaaaaactacctatttggtacaatataaactactcaggtgacaggtgcactaaaatctcagaattcactgctatataattcatccacgtaaccaaaaaccacttgtactgtaagtgatactgaaataaaaattataataaagcaaatttataataaaattaaaattatacttacataattataatataaacaaaaattataataaggagcagcttttttttttttttcttaaaaagaaaaacccagtgccacagttttgggttctagtgttttggatagaaagccccttttgctcagtaacacactcactactggagaagcaaaatcctgaaaattcaagaagaaccttggcataaacgatatttctgacaagttatttatacactgcctacatgagtattgcagatatgttttaaagacaaagatccatgtagactgggtcagctttatgcttggtcattttatttccaattcttctcccctaaaatacaagtcatgggttgccatggtgattattccaactgcattgtggtcagatggaactggtgacctgttctaatttccccttcagttacaaaatgagcccgatgctcttagccatcaaaatctcaccaacacctactacttcagtttcaactctggttcctttttcaaggcaatcactcaaagttgcaaatcacagaaaggcaaaaatgttttaactaaaaacttaataaaaagttataccccccctgaagccatgtaatttgggttttatttattttattgtctattcaggtccataaacctacaactgtaacaatatataccattcatgataagttaatatttattgaatagtaaaatgaatatacgttaagggtagatctggcttcaagtataactgcaatcagggctggtgtgatatgtccagtagtcaaggacaaatgtcagttgtaatatgacctcctccacttgaaacacacagcaatactttaaacgtctgaaaagaaagttacgtagggaaataaatgaaaagttattaatttgattaagaaggaattaaacctgattttaaaatagataaagacatacaaatataaaaaatactgaagaacaattagcataggtagaggagcactaaaagtatgatagaaaagaaatatatttaaaaatattagtttctgagttaagtttgtagatatagagacctgacaaagagttgctcctacacattaaacaaacaaacaaaaatgctggagaaacttcaaatgaatggatggtttctcctgagccctttaaagaactgaggtcacagggcagactacaaacccaacatcaggggatgcagaaagcctgcaggtcacacaggctccaggcttttatgtgtaccctgaagaccatgtaaactggtaaaattaagccagaacttttgaactagttcctggtggctgtgtgtgggtgggtgaggagaatgagaaaccctggagtctacagacgtagggtttataccgttgtgtataatttttctaggaaccctacaaggcctgtcagggaagatggggttagaatcctgaggatgcttaccccacagtgctgatggggagggaccactatcccatccactactgcaactctggagacacagccctcacatctctcctatataacatgaggcctaatctgcagagaaagagcatccaaacctgagccaaagggcactggggaaaagctcatggaactgagggtgaaggaacaaggccaacacccgcatttctgcacagatgcatctcccataaagaaaagaaaccattaatttacagggcactgttcaaggcccacttcaactgggagttaagagcatggagaaggagcacgtttcccctaccatggacaaggagggacaggaatgtgctcttgtcctggcattgcatgtacaggatgggcaggaaactcttcaacggtcagtaaccccacaccccagttcacagtgctaagtctgaggcttcctcagaacattagagatctcctcactccctcaccactgccaccaggctaagaagcatggagtcaaaacagtggaatatagctgggccaagtgcaagaaaccacgtgtgggaagaggcacaaagggaaggcacagcaaactcgggagatattagcaaagtatcatgagagggatttgaatttcctggtcctcagaaggttgttactgccataacgacttttaaccccagcctaccctctcatcaacatgaccacaaacccctatactaaggcagttatctgagagaaaactgctcgtcaataacctaaaacctatcccctttcaatgtcagtgggctgatgaaaaaataaaaataataaaaaaaagatttaccccaatgcactatcctatacaacatatgctattgcttttaacaaaaattagaagccaagacatccctttttatctttagtgagatcttcatttgtgttaaaaccaaattaaggtcccagtgcggagtttaggaggctgggacttcagatcacagcgggcgcccgcctcccgcccgccgtggccacgccgcgccgcgtccgggaaggcccagcggaggctccggggaaggcgacaccagcaggcggcctggccggcggcattgaaatgggcgtccgctccccacggagcgcgggaggtcgtagctgcagccggacgagcgctggcaccagccgggcaccgcgcatggatcccgcgtgcgcactgtcgcggtcatggcgtcccgggccggcaccgcggcctcggctccctgctctgcggctcttgtctccagggcggcgttgggttctgaatgttccagttccacagcagccagacgcgggatgcccagggacggcctgacggcagcgctggctgcggtgcggccagggcgctggcgtggccgaggccatggtggtcgtatgttccatggacaccatcaaggtgaagttcatccacggccagaccttcccagacctccagtgcagaggagtctcccaccaggttagagagattgtgcgagaacaaggggactcaccggggcctcatggcacccacgctaaagcagggctggaaccaggccgtctgcttctcctcctgacctccctgcacagctggtaccgaggggacaaccccagcaagcccatggacccgctggtcgctggggtcttcggagccattgtgggcgcagccagtgtcttgggaaacgctcctctggatgggatcgagaccggatgcggggcctggagcagcacaaacgcggaacacaccggcctatggctgcagatcctgaggaaggaggggctcaaggacctctagaacggcactgtccccgcctggccgctggacgcgtctccctggatgtgaccagggataagggtaacagtatttatcctctaccaggaggtggagaagctgcacaacagtgtggaggatggactaagcccagaggggtaatgagggaaccccccaggcacctccagagcggccaccacccttgtctcacatgattcc

SEQ ID NO: 1613 - DNA, 12765 bp, Homo sapiens
ttaaaataaattctcttaggtttattaaggtttgagggttggttaaaggctttgttacatttttttacatttataaaatttctgtccaatatgaattctcttacgttcaattaaggtttggaactggttaaaggcttggccacattctctacatttgtagtgtttttttccagtgtaaattattttatgtattataaggcctgagggtggactttgccacattattcacatttgtagggtttctctccagtgtgaattatcttatgtttagcaagacttgaatgccacttaaaagcttggtcacattcttcacatttgtagggtttctctccagtatgaattctcttatgttgcataagggttgaggagcaattaaaggctttgccacattcttcacatgtgtagggtctctctccagtgtgaattctcttgtggtcagtgagggttgaggataagctaaaggctttgccacattcttcacatttgtagggtctctctccagtatgaattctcttgtggtcagtgagggttgaggataagctaaagactttgccacactcttcacatttgtagggtctctctccagtatgaattctcttgtggatagtaagtgctgaggagcgcctaaagtcttggccacattcttcatatgtgtagggtttctctccagtatgaattctcttatgtctagtaaggttcgaggataagctaaaggcttggccacattcttcacaggcatagggttttctctagtatgaattctcttatgtctagtaaggtttgaggaccagctaaaggctttgccacattcctcacacctgcagggtttctctccagtatgaattctcttgtggtcagtgagggttgaggatacgctaaaggctttgccacattcttcacatttgtagggtctccctccagtatgaattctcttgtggttagtaagtgctgaggagcgcctaaaggcttggccacattcttcacatgtgtagggtttctctccagtatgaattctcttatgtctagtaaggtttgcggaccagctaaaggctttgccacattcctcacatctatatggtttctctccagtatgaattattttatgtgtagtatggtttgaggagcagttaaaggatttgccacattctttgcatttgtaggacttctccctagtatgaattacctgatgttgatttaggtgtgaaagcatgcaaaatgatttgccatatttgttacatttgaaatgtttctttccagtatatcttgttttatctctattggaatttgaaaatttaccaaagactttgacatatttatgagtctgaaatattttgttttgggtagttgacaaacattggttaacttcactataacctctttgggcacctcacattcacccacacttttacagcattttttaaattgtaatttctcatgtccacattttccatatgttcttggtattactttttggagtgaatctttgatgccctgctctggctgaaggtcttgggtgaaatgggaatgcgtaactgaaagacacaaaaagcacaagttactccactttctggactcatataaatgtattctacacatgaaatatataaaattacacaaggtacattagcaaaatgccatatcaaaataccacaggccataattccttcatagatgtataaatgtaacaaaatcatagtgatcaaaatacctttgttggaaatttataaataaagtaagtgtgtgcaccatgtgagcacgatgtccagagccatatagagagaaaagaaaggtctgctacatttacccaacacagcccttcctcatgcccagtagaagaacatagtgcctttaataacagctttaagtcttctgagctcaaaagtgaatgttacaaccgcagaaagactgcagtatgatgggtagaagataggtgtagaacgtagttactgaccactaagaagaaatatgaagaagtcttttaattgaaaaataaatacaaattgcagacaaaacacatcctgagaacatgtttgtgagaatcccagaatctctaccaaagacaattggtgtcatgctatgagaggaaggagctgcattataaagatcatgaaaggtagttttatgttagtgtctaaatctccaacaaagattacaatgtatataaaacatgaggacaacatggtccaatcaaaaaaatcaaaaattttgaaaaagcaactataaaaataaagatgtacatcttgatttttaaaatttaagataatccatattatgctcaatgagaaaaatggaaaaccagacacctaaataaaataagaaaaataagaataccaacaaaacttgcaataataaaaataaacaaggtggaggtaaaaaagaataactgaaaaaatttaaaagtaagaaaaaagtacgtaaaaaatgaagaagctaaacaaacaaactaggatatacacaaaaagatccgcaacacaaatttaagcaaagtttcaaaagtcacaaaccagaagataatcttgggagctgcaagataaaagtgaagtattatttataagcatagtcctctgagacaaccagtgaatttgtaaacagaaaccttgcaggtcagaaaagaactgtgtaaaatggtcaaaggctgaaaaaaattttcatggtgagaataataaaaccagaaaaatgtactacaacataaagaaaaataaaactcttccagaatgaataaatgctggaaaagcacataatcattgtatgtgccctacataaaatgctgaaaagaggtctttccacttaaaacaacatgatgaaaaatatatgtaatcatatgaaaatacataactttctgaaaaacatatgcatatacaaaaagtaaaattctgtggcattattgtgatggtgcagaaaatacttttagttattctttaaaatttgaaaaatataagcataaaaaacataaaacataaaaagatataattagcaacatcaataagaagtatagggtagatataatgaggacaaatttttctatgcaactgaagtcatttttttttaccagtttaaaatatactgttgtaacatttaagatgttttacagaatctccaatgtagcacaaagaaaaaatctttatagacacacgaaagcaaatgagtcaattactagcatgagacaaagattgatattatataatggtaaaatgagtccatttactaggaatctataattattatgtctatctacatgtatatgcatatataacatcagggcttcaaaacatataaagcaaatattgacagaaatgaagcaagaaataaaatagcaacacaaaattataaacattaagacctccttttcaataataaataaaaaatttaaataaaagatcaattaaaaaaactgaaaacctgaagaatattatattgtgtatgaatttattttgcattgctatagaaaataacctcagactgggtaattcataaagaaaaagattttttgattcacagttcagtagactgcacaagaagtatatgccagcatctgcttctggtgaggatatgaggaagcttacaattatagtggaaggcaaagaagaaccaaacatgtcacatggtgaaagacgatgtgagtgtgaggtggaggagccaggttcctttaagcaaccagctctcatgtgaattaatagcgtgagaactctatgattgtgccaagtcattcatgagggacttgtctccatgatgcaaacagctctcattaggccccacatccaacagtggagattacatttcaacatgccatttggagggcatctacaccatatcacaaaccaaataggctaaacagacatgtacagaactctccagtcaaaagcaagtagatacacaatattcttatttgcacctggtgcattctgttagaacacataagtcttggtaaatttcaaaagatcagccaggtgcagtggctcacaggtgtaatcccagcagtttgggaggccaaggtggaagaatcacttggggcaagaagtttgatactagccttgggaacacagtgagaccctgtctctacaaataattcaaaattagctgagcattgtggggtatgcctccaatgccagctgctcagtaggccaaggtgaaaggattacttgagttcaagaggttgaggctgcagtgagccaagattgtgctactgcactacagtctgggaaacagagtgagaaactctgagtcaaaaaaaaaataagaagagcaaaatcatacagtatatgttttctaacccaaactgaataaaactaaaaagaaaaaaagtaatactggcaaatcaaaaatacatggaaataaacacactcttcactgtattcttgcacagggtcaaataatttaaattaatttaatattttttctcaagggccaacatatttaagtgatgacttaatttgttaagacccacagtggtgaacaaatttaatataatctgtatcaaaattccaaaagtatatttattcctgaaatattgtttaaaatttttaaattttattatgaaccaaatctagagaaacacacatgaaaaacacagaggcactatacttcataatttcaaaacataataaaaagctgcaataacaataactatgtggtattcacaaaaagacagataaagacatgatagaacaaaatagaaagcccagcaatgaactcttctgtgtatgaccaaataatctgcctcaaggttgccatgagcagacaatggagaaaatataatcccttcaacagatgatgttgaaaactggacatctacattgaaaaaaatgaagttgaatggtttaattgcatcacatacaaaaaatattttaaacaaagtacttagactaagaaaaacctaatgaaactcttagaaaaaaagtatagtgcaaagacatgacattggtcttggcacattttcttagatatgccatcaaatgcatgcgcaacaaagaggagaacagaaaaatttaattgggctaaacttcaaaatttctgcaatcaaataaaacatttaatagagtgacagtgtctcccaagaaatcggtgacaatatttgaaaatcacatgtgataagacttaatattgagaatacataaactactcctagaactagacaacaataattgaattacttgatttagaaatggacaaatgagccaggtgcggtggctcacacgtgtgatcccagaactttgggaggctgaggtgggcagatcacctgaggtcaggaattcgagaccagcctgaccaacatggcgaaacccatccctactataaatacaaaattagctgggtgtggtggcacatccctgatcccagctactcagggggctgaggcaggagaaacatttgaatccaggaggcagaggttgctgtgagctgaaatcgtgccattgctcttgttgcctaggaaacaagagtgaaactccgtctcaaaaaagaaagaaatggaaaaatgattaaactaaattttaataaaaaagatatacaaaggggaagaagcatttgaaaggttgcacaaaattaataatttatagaaaaatgcaaaacataatcacaaaacaaaatcaccttacatcaattaggatggccactataaatttttttaaaacaccaactgttgacgatgtaaagaaattgaaacctatgtaagttgttttttatgagaaaaaagatacagccatcataaaaacatcataagcattctttaaataatctaaaatgaaattattatataatacagcaataccatttatgagtctatatctaaaatatgcaacacagtaaaatgaaggcataaaaggtaccctgcttgcatatccccccacagcaagtgcaagtggggggataaccaagcctctaaataaataaatacatataaaaaattaaacaatttgtaaaaaatttgtaaaaactttaaaatatatttcaaggctatagtaataaaaacagaatggcatgtgcagaaaaatggatgaccaccaatgaaagagaaactactattctcacacatcttagacatgatgcaaaaaaaaaattttaatggtttagagttttccaaaaatatgcagatattagtgtgtccccaaaagcaatggcaaagcagtcagtttgcgcagtccctgataacctttaaagaaaactttggctcacactgtgaacctgaagaaagattattgaagcagaagtggaatccttagagactttaacagcatgaggcaggaggtgtccctatgtgagagcaaaaggaaaaaatgacttgagcttctcagaaactcttttcatcaaaggacagctccccagaccacattttaaggactggctgcctcctttatttgtgtacctctcatctgtctcatctgcttcatttgctctcacctacctgggcgtttggctaccatctcatttctctttatattctgggactctttattttgctccagacaggtgatcaagtctggcttagagacagcaatacctgttttattaagaaaaaaaagtaacatagatcatgctgaattctttaattaccaaattagtattatgcttagaggatataatagaaaattctagaaaattaatattgattcataatagaactttctaaatattcagaaaatattttaaatttgtaggtccttaatttcactactcagtactactgaatcaaaaattggtggcagcaactgaattctaatgtgtgggcaacgatcttttatgccatggcatttttggaattcccactaacctagagcaaaagatacataagctcaggaaaggcaaaagttctggtcaagataaaacatcttgaagaatttgttctacagcaatgaatccccaagattttcttaaaattggagatctaaaattcattcatgcaaagcagaaattaccaaaaacatcttagaaaagagaaaagcaatatattaggaattatgtattgaagttatcctcacccagggagaccaagtttctgtagttctctaacatcacatgtctatataaattccgctgagcacaatccaggcattgccattcctccagagagaattctatagctatgtctctgaatgtcaacagtccctggaaaacaaacaaacaagcaaaaccactcatgaacacacaagcacttaccacatggccataggcagagatttttatttgactcaagttaaaaaagagagtaaaaagaagtggttctcacttacaagagtgactaaaattattcaataagataatttttaacactgaagtattctctaactctgagaaaagaggatagcataagatccacaataccactgtagatttgatacttttctggatgatacattataaaattaagggcatcaacatggacatgtctttttcttttcttctttttttttgagaccgagtctcactctgttgcccaagctggagtgcagtggtatgatcttggctcagtgcaacctccacctcccgggttcaatcgattctcctgcctcagccccctgagtagctgggactacaggcatgagccaccatgactggctaatttttgtatttttagtagagacggggtttctccatgtggacctggcaggtcttgcactcctcacctcaggtgatccacccacctcaacctcccaaagtgctggaatggtaggcatgagccactgcacctggccggacatgtccatttttgagtgctatatttacatcatatagaataagttgtgtatatttctcagatagaagagtcatgatgaattggaagatacctctcaagtcttagtatgtgcaataactaaagatcttgtgagattttgtttcaggagatttcggaggaagtctgaatttctgaatttttagcaagctcaccaatgtttctagcctagtaagaatattttgtcaaatatccagtaaatggcagagtttgggtttttcccagtttctctcacctgtaaataaagataagagccttcatttttaaaagacaaatataagcaaaagtcatctaaaaggaaaggacagcttccagattaaatgcaacggtttatgcacttcagctagtaaatctcctaagtgtccttaataattaagagaataagaattaactctagagtggaaaaaaatgtcatagagatcttgaaccaagtgaataaaattgttatcaactttattaggacacatttttattatgtgctgatgcacacacaacacagcatcactgctgtggcatttctctcctctcagaaaagtaaattataatctacatttaattttattatatatatatatatatatatattttttttttttttttttttttttttgagacagagtctcgctgtgtcacccaggctggagtgcagtggtgccatctcatctcactgcaacctcaacttcctgagttcaagcaattctcctgcctcaacctcccaagtagctgggattacaggtgcatgcaccatgcctggctaattttttttttttttagtagagatggtgttccaccatgttggtcaggctggccttgaactcctgacctcacgtgatccgcctgcctcggcctcccaatgtgctggcattacaagccaaagccattgcgcctggcctaaatttaatcataaagaaacatcagttttatgcaaagttgaaggtgcagataacttccctgttctgcaatttttattagtaattttaaggagtctttccttagcaccctggaaagcaagtatctcctaacagttttttcagaactttctgtataataaatgccaccctgtttaaatgagcattttctaaacgctgttctgcatggaactaatagagcacacagatgaaacctcaatataacatgtttcacttttcactaatctccaaagacaacggtgtttccccaatagaaatcttgagtatccacaccttctaatgttcaacagctacaatgggaacattttatatatcgtaggtcataaatttgtggtaagaattctgcatgatatacaagaatccaagatgaagagaaatgtatagaatgctatggcatagagaaaacaaatatttttttcagaaccccttgactatcataaaaatcacaaaaaatagttgaaacaaactcattagggatcaacagcacgagtagagaagtaaaactttgcaagttctgaacacaaggcattccaaaaggcagagtggacactgcgcttgatctgagacatgctcacctgagaaaaagtgatttgtttcttttcctcctctttctctgaaatgtattttcagataagatgctctggacatatcaaacctgcatcttgagaatatgactttaaagtgcaacctattcacctgctaccaccacacacacccacgggcggaagaccgagacttgcagaaaacattcacccatttttgttgtttataactgaaaagatttaagagcaatgagagaacaatgagcttctccacagctattaaaatataagtttctttgtctctgccctcccctatcagaaaccagcaattttctttagagtaatgggaacatgaaccgcactgacctcttcctaccaaactgaaacagggcaggcagtgcagccttcctttgaggcaaaggttgaactaaactctcctgaatgtatcttgaacccctcaagtttataaatcacttggtaatcttggccccgctctatgcaacgtgattctgcaggatccaaaagggtccaggaatgggcttttacagcaagtcccctgtaaatgctgattgtgctttcccagacacattattagcattagcaagagaaagcaggcacagcagagtcccttacacacaccacatttgtcacaatactaatacttctgctacaaataaaaacaaccaatttccaccctgaaatgctatatttttgttggcttttttaagtttacagggacaacagaagacagcaacgtctgagtgaatctgcacctgggaaacctgtacacatgtactaataaaacgtttactaagcaggtactgtgtgctcaggagcatgtcacagaacactgcgctgggaataacacattttgtgatttaattttcatagcaccctgggagttggtactaagtgctgaataatttttagcatttagattaagagcacagcatttttatttcttcttatctttctcattaattttaaaaagaaaatgtatagaataattcaatacaaaaaaaacatgtgaaaggatgcatttacataaaaatggaataatcagcttccaaatggctattttggaaataatgaaattaaggcagaaataaaatttttgaaactaattacaaccgaaatacaacataccagaatctcagggttagagctaaggcagtgttaagaataaaatgcatatcactaaacatccatatcaaaaagttagaaagatctcaatttaaaaatctaatgttacaattaaaagaatttcaaaagtaagagcaaaccaacttcacagctcacaaaagtcaagaaataaccaaaatcagagccaaaatgaagaagtttgagacataaataactataaaaagttcaatgggccacgcatgtgctgtggctcgctcctgtaatcccagcactttgggaggccagggcgggaagatcacgagttcaggagtttgagaccagcctagccaacatggtgaaagcccatctctactaaaaacacaaaaattagctggccgtggtggcacatgcctgtaatcccagctactcgggaggctgaggcaggagaattgcttgaaactggaaggcagaggttgcagtgagctgagaccgcaccactgcactccagcctgcgtgtaagagtgaaactctgtcttaaaaaaaaaattcaaaggaaccagaagttgattcaatgtaaacataataagatagataaaacactagactgatgggaaaaaaagaaataattcaaataaaaacaattagaataaaaagtaaaaacaaaaacaaaaacagatgcttgtgaggttgtggagaaattgaatgcttatatgctgctggtgaaagtataaatttatttaaccattgagaaaagcagcttggcattttttcaaaaacctgaaaacagaattaccattcccaatcccgcaattgggaacatacccagtgaatgtaagtttttctaccatgaacacacatgcacgcgtatgtttattacagcacgattcacaatagcaaaaacaagaaataatcctgtatgtcttcaatggtagactggataaggaaaatgtggtatgtaaacaccatgaaataggatgcaactataagaaagaacaacatcatgtactttgcagcaacgtcgatggaactagagaccgttatttttagaaaactagtgcaggaacagaaaataaaaaactgtatgttgtcacttataagtgggagcaaaataatgagaacacgtggacacaaataagagaacaacagacactgaggctcagttcagggtagaggatcagaggatgaagaaaatcagaaaacaaatctgttgggtactatgcttagtacctgagtgataaaataatctgtacacaaaaacttcatgatatgattttacctatacaacaaacctgcacatgtacccctgaacctaaaataaaaggtaaaaaaaaaaaaaaaaaatcggctgggtgcggtggctcacacctgtaaccccagcccattgggaggctgaggcaggcagatcacctgaggccaaaagttggagaccaacctggccaacatggtgaaatcccgtctctactacaaatacaaaaattagttgggcctggtggcacacacctgtaattccagccactcgggaggctaaggcaggacaattacttgaacctgggaggcggaggttgtaatgaggtgagatcgcaccactgcactccagcctggaggacagagcgagactccctctcaaaaaaaaaaaaaaaaaaaaaaaaaaaagcatttcttggaaattactatcttgaagaaaatattcaagcctaggcaaccacagcctgccaattaatctctgatgacataaccaagaaatttttacctggatctcacaaataaactacataactgtaccaaaccaattattgaatctggtttgcttcgtcatgaaacttataacagacttttcttcaagtctctcccatggatcacaacccacaaaccatagctgggcactctatgattcttgaatcacactttgatcagattctcatttttagagtgactcccgtacatctctaaaaggaaaaatgaggaactaaggaccccaggaccacagctctttccactcatgaatcttgcaccctgagtcaggattctcccctgatgactttcccatccctgtacaatctgggtgagatgaggcgctgggagtgcagagcaaaccagagaggcctccagtccagggtaaagccactgcagaggaaaaagacagaaatcccagggtcccaggcgctggcccaggcaccatcttgcggctggaggggacgagagccgagctgggccaaagacgatttgggtcgtcaggctctggagctgactgcgagaaagtctgggacctgctacagccactttctgccggttccaaccagcccccacccctctctcacgatgacagacccagcactcaccatttcccggcttccagggggtcccggtcttttagccataaatctgcagatacctgcaggacacaaggacacataggcttggcctctaggagcagaggacacagagc

SEQ ID NO: 1614 - DNA, 7682 bp, Homo sapiens
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcgggtaaggaaagcgcgcaggccctgcagacctctccaccccggccccctggcccggctcgcccctccgccccggggcggcggcttcctgctctgcagcgagcgtccgcaggagggacgccaggaccccggacgccacctctgaggtctctctgcacctgggtctctgacagccgggaacaggcaggaggtggggcgagagggcatatccagaaggtaaagaggagagtgacattggagatgtctgtcacccctcctgcagccagtaaagggcacaagtgggcactgacgcagtttctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtaggtatgggataagtttagctggcgttatttttcgaaggtcctctagcagattgctgcgccattcaccagtttctgcttcatattatcttcagttacaaagcacccttcccttgactgcatgttcccaggggctggagtttgtccagttcaccattgtctactcagtgcccagccaggactggcacaacctgcttagtaatgttgaaaaagggatcgcgtgctcctgtgtccagcaccagcttgcagtgctttagatcaaagatcaagggcctcgtttggattagagttagctttgcccaaaggccgtttggacatgtgagtgctgcctttgttcttaaagacaggcagggtttgggatcccacagcttcactttgtaaaccattttcgtgtcttgcgtctcctgctattcttggtgagttcttgcttcagtttgactgaaatttcttttgctgcacttgaagcatctgtctctggtcttctctgagtacacgcaaagtggctagtccctgttctctttgtaacaactcactgggcctcagaactggctcacagtctgcctgcttcttgccctgtcttctagcctattgttttccttccccttgctccatgaattttgaattctacagaccactccctgttgggttgccacaaatgcagctctgtgcagtgcctttccacaacacgtctgcattaagatggagcaatattgggtggtagagaagggaaatgaagggaaggattcttaaggcaacttggatgtggtcaaggttggcctctctgtgaggtgacactttcagtttttattttctgccttgctattcttaccctgagtagaactcagcctcctgtgtccaggaggcatcaggaaggccaatggaaaagagctcacaccaggagctcttcttgctctggtcctggccaggccttgtgaggtgctggctgcatttgttctgacccgtgtcctcttctgctgcagagtgatcatcaccatgctggtcgccaccgccgtctgctgttacctcttgtaagtactactctccccagctcaaagtcagccagttcctttgtcctccctcctttcctcctcaccctagcctgctcttccttctgtcctggtagtaaatgcctcttgaaaggctgaacctataaaacaacaggagtggaggtggtgtggaatgggaaagagagcagtgggccagaagtcatgaaccctgggctctggatctggctctgcccccagagttctggcccccatgggctgtagttttctcacctgggcaaggaaggaggcaggccacctcagtgctgtctgtgcctgactgggtcacctggagtgattgttcaaacacagttttcaggctgcaccctacacccatgaaattacaactctcgagatctgcacttgggaattcctgttgttcatgaatgcccccaggtgactggaatgcagccatcttagaaccactaggtgagaggccagacgtggcggctcacgcctgtaatcccagcactttgggaggctgaggtgggtggatcacgaggtcaggagttcgagaccagtctggccaacatagtgaaactccgtctctactaaaaatacaaaaattagccaggcctggtggcgcgtgcctgtagtcccagctactcaggaggctgaggcaggagaatcgcttgaacccgggagacggaggttgcggtgagccaagatcttaccactgcactccagcctgggcaacagagtgagactccgactctaaaaaaagaaccactaggtgagagtaagtcatcaaacttggaataggtaccctggggatatagaagaacattccaagggacttgaatacctggagagtgtgaggaaatcagtttgcagatcctcagtgtctattgtttagtctcttgctaaaactgccattcacaatagccaatccctctttattaaaaaaattttttaaaaggaaaaagaaaaagaccctgcccccgcatccatcccaaacctgcggttacattgctccatgtttagatgatcctggctgccaaccaagagataagttcaagttctagtttgttgggaggcctgtctcatggttaatcaagctgcattaaggctgttgggtttcccatcttcctatgtcttgtacattatttttatgggttaagcttggcatcgttgggtgttcttaattcagaataatcaaaacaggacaggtaaagtgatgagatgctcattctttaagaggtaacagattcttttgaaacaactggaatattttccagggttgccaaatttttcaaaatacataggacaaaacccactttcaaaaaatttacttcattgatttaagatttgatgttatcatagttaaaattgttttatctgattaggtcatggattctttattcctattaaccaattctcttaatttaccttatgttttattgattgattgattgaaatggggtcttgagaccaggccagtatggtctcaaactcctgggctcaaatgatccttctgcctcagcctccccaaggagctgggatgacaggtgcacaccattgcacccggctgttaactaattagataattgacagggtcttactctgttgcccaggctagagtgcagtggtgggatcatagctcactgcagcctcaaccttctgggctcaagccatcctcccacctcagcctagctttgaccacaggcatgtgccaccatgcctggctgatttttaaattttctgtaggacagggtcttgccatgttgctaaggctgtgcttgaactccttggcttaagtgatccttccacctcagcctcctgagtagctaggattacaggtacacgccactgcacccagaaatgtataagccctcctactgacaaaaactaaacttgttagaaataatgatgactattaacacatggtttaacttaaacccactttttttttttttttcaaaattcttcctggacagagcattctctgaggtcctttctctaatgctatttctaggtccttcagggcttgagaaaagatcctcatctgcccatggcagggcctcagaggggcttgtgtttggtggctgggagggtgggggagacggggcctacacaagatgcggggtaatcccaaataccaactgaatcaacatacgggaaacagaaaacacactgcaaattggatgcatacaggtagaaaggtggggtcattctaagaaaatgttacgcctagaaattatatttacaaaacataaactcggagagaatgctgatgtaaaggaggtaacaatttctgatggcttcctgggcgttaggtcctcctacctactgtgagggattcaaagagggaaaataccgatccttcctgcagaaacagacaaagcagtgtggatgtggtcgtggggggcccttccaggtcaggcactgacagagcgtggggacctactaactactgtggcaaatgaagttgggagctttgtcatgaatgatggggccagacagccacccacacgcccagcagtgatgacaggtggggcaggtccctgagggttttctggcctgaagaacagaggtggcctggcagcagcctgaacaggaggcccctgacccgtcagctcctcacgtcttggggtagttccttctctcataagaggaggtgattctgacgtgctgcccgccaggcctgccctgttcgctccctggtgcatggagccgggggagcctggacagaggtgtgtgagggcacagctgggagtcgctcccaaagcgcccctgaggctgcctcccctcttctctaaccccaggttcagccccaactcggggatcctgcagatctaccgaacatcaaatgaaaccaaaaccaaacccagaagtgccataccaaccccatgtgcctgccggagtgtggatggctccctgggcccttcttcaccctgggaacacaggccctgccatctgctgggttggccgcatccaaaataatatgaccgaggcctcccctgggtgtgggaggaccctcctgtgccaggctcaccatgctttgctgtccctggcagctggctcatcgccatcctggcgcagctgaaccccctgttcgggccccagctgaagaatgagaccatctggtacgtgcgcttcctgtgggagtgacccgccgcccccgacccaggtactgtgtgggcgaggggtgtgggtggggaagaggggaaagacaaggctttcccacacccagggcaggcctcggtcatattattttggatgcggccaacccagcagatggcagggcctgtgttcccagggtgacgaagggcccagggagccatccacactccggcaggcacatggggttggtatggcacttctgggtttggttttgatttcatttggttagagttcttgttgggattcaggcatctatttatttcatgaaaagaaaaggtggggaggggactgaacatcaactcccttcctgcctggcctgtgttggccgccagggatgaaatgggaaccatgctcccagcacccccctcccccatcctcacagcgcttcaccccaaggcaagaccctaacctgggccctaacctggacggagggagggaaagggtaagctgaggactatctgggcaggggtgagggggctttccagggagggttgggggcagtggagtctccactgcaaggccgggacccttccatgtgatgtgcttttcaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttg

SEQ ID NO: 1615 - DNA, 7731 bp, Homo sapiens
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcgggtaaggaaagcgcgcaggccctgcagacctctccaccccggccccctggcccggctcgcccctccgccccggggcggcggcttcctgctctgcagcgagcgtccgcaggagggacgccaggaccccggacgccacctctgaggtctctctgcacctgggtctctgacagccgggaacaggcaggaggtggggcgagagggcatatccagaaggtaaagaggagagtgacattggagatgtctgtcacccctcctgcagccagtaaagggcacaagtgggcactgacgcagtttctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtaggtatgggataagtttagctggcgttatttttcgaaggtcctctagcagattgctgcgccattcaccagtttctgcttcatattatcttcagttacaaagcacccttcccttgactgcatgttcccaggggctggagtttgtccagttcaccattgtctactcagtgcccagccaggactggcacaacctgcttagtaatgttgaaaaagggatcgcgtgctcctgtgtccagcaccagcttgcagtgctttagatcaaagatcaagggcctcgtttggattagagttagctttgcccaaaggccgtttggacatgtgagtgctgcctttgttcttaaagacaggcagggtttgggatcccacagcttcactttgtaaaccattttcgtgtcttgcgtctcctgctattcttggtgagttcttgcttcagtttgactgaaatttcttttgctgcacttgaagcatctgtctctggtcttctctgagtacacgcaaagtggctagtccctgttctctttgtaacaactcactgggcctcagaactggctcacagtctgcctgcttcttgccctgtcttctagcctattgttttccttccccttgctccatgaattttgaattctacagaccactccctgttgggttgccacaaatgcagctctgtgcagtgcctttccacaacacgtctgcattaagatggagcaatattgggtggtagagaagggaaatgaagggaaggattcttaaggcaacttggatgtggtcaaggttggcctctctgtgaggtgacactttcagtttttattttctgccttgctattcttaccctgagtagaactcagcctcctgtgtccaggaggcatcaggaaggccaatggaaaagagctcacaccaggagctcttcttgctctggtcctggccaggccttgtgaggtgctggctgcatttgttctgacccgtgtcctcttctgctgcagagtgatcatcaccatgctggtcgccaccgccgtctgctgttacctcttgtaagtactactctccccagctcaaagtcagccagttcctttgtcctccctcctttcctcctcaccctagcctgctcttccttctgtcctggtagtaaatgcctcttgaaaggctgaacctataaaacaacaggagtggaggtggtgtggaatgggaaagagagcagtgggccagaagtcatgaaccctgggctctggatctggctctgcccccagagttctggcccccatgggctgtagttttctcacctgggcaaggaaggaggcaggccacctcagtgctgtctgtgcctgactgggtcacctggagtgattgttcaaacacagttttcaggctgcaccctacacccatgaaattacaactctcgagatctgcacttgggaattcctgttgttcatgaatgcccccaggtgactggaatgcagccatcttagaaccactaggtgagaggccagacgtggcggctcacgcctgtaatcccagcactttgggaggctgaggtgggtggatcacgaggtcaggagttcgagaccagtctggccaacatagtgaaactccgtctctactaaaaatacaaaaattagccaggcctggtggcgcgtgcctgtagtcccagctactcaggaggctgaggcaggagaatcgcttgaacccgggagacggaggttgcggtgagccaagatcttaccactgcactccagcctgggcaacagagtgagactccgactctaaaaaaagaaccactaggtgagagtaagtcatcaaacttggaataggtaccctggggatatagaagaacattccaagggacttgaatacctggagagtgtgaggaaatcagtttgcagatcctcagtgtctattgtttagtctcttgctaaaactgccattcacaatagccaatccctctttattaaaaaaattttttaaaaggaaaaagaaaaagaccctgcccccgcatccatcccaaacctgcggttacattgctccatgtttagatgatcctggctgccaaccaagagataagttcaagttctagtttgttgggaggcctgtctcatggttaatcaagctgcattaaggctgttgggtttcccatcttcctatgtcttgtacattatttttatgggttaagcttggcatcgttgggtgttcttaattcagaataatcaaaacaggacaggtaaagtgatgagatgctcattctttaagaggtaacagattcttttgaaacaactggaatattttccagggttgccaaatttttcaaaatacataggacaaaacccactttcaaaaaatttacttcattgatttaagatttgatgttatcatagttaaaattgttttatctgattaggtcatggattctttattcctattaaccaattctcttaatttaccttatgttttattgattgattgattgaaatggggtcttgagaccaggccagtatggtctcaaactcctgggctcaaatgatccttctgcctcagcctccccaaggagctgggatgacaggtgcacaccattgcacccggctgttaactaattagataattgacagggtcttactctgttgcccaggctagagtgcagtggtgggatcatagctcactgcagcctcaaccttctgggctcaagccatcctcccacctcagcctagctttgaccacaggcatgtgccaccatgcctggctgatttttaaattttctgtaggacagggtcttgccatgttgctaaggctgtgcttgaactccttggcttaagtgatccttccacctcagcctcctgagtagctaggattacaggtacacgccactgcacccagaaatgtataagccctcctactgacaaaaactaaacttgttagaaataatgatgactattaacacatggtttaacttaaacccactttttttttttttttcaaaattcttcctggacagagcattctctgaggtcctttctctaatgctatttctaggtccttcagggcttgagaaaagatcctcatctgcccatggcagggcctcagaggggcttgtgtttggtggctgggagggtgggggagacggggcctacacaagatgcggggtaatcccaaataccaactgaatcaacatacgggaaacagaaaacacactgcaaattggatgcatacaggtagaaaggtggggtcattctaagaaaatgttacgcctagaaattatatttacaaaacataaactcggagagaatgctgatgtaaaggaggtaacaatttctgatggcttcctgggcgttaggtcctcctacctactgtgagggattcaaagagggaaaataccgatccttcctgcagaaacagacaaagcagtgtggatgtggtcgtggggggcccttccaggtcaggcactgacagagcgtggggacctactaactactgtggcaaatgaagttgggagctttgtcatgaatgatggggccagacagccacccacacgcccagcagtgatgacaggtggggcaggtccctgagggttttctggcctgaagaacagaggtggcctggcagcagcctgaacaggaggcccctgacccgtcagctcctcacgtcttggggtagttccttctctcataagaggaggtgattctgacgtgctgcccgccaggcctgccctgttcgctccctggtgcatggagccgggggagcctggacagaggtgtgtgagggcacagctgggagtcgctcccaaagcgcccctgaggctgcctcccctcttctctaaccccaggttcagccccaactcggggatcctgcagatctaccgaacatcaaatgaaaccaaaaccaaacccagaagtgccataccaaccccatgtgcctgccggagtgtggatggctccctgggcccttcttcaccctgggaacacaggccctgccatctgctgggttggccgcatccaaaataatatgaccgaggcctcccctgggtgtgggaggaccctcctgtgccaggctcaccatgctttgctgtccctggcagctggctcatcgccatcctggcgcagctgaaccccctgttcgggccccagctgaagaatgagaccatctggtacgtgcgcttcctgtgggagtgacccgccgcccccgacccaggtactgtgtgggcgaggggtgtgggtggggaagaggggaaagacaaggctttcccacacccagggcaggcctcggtcatattattttggatgcggccaacccagcagatggcagggcctgtgttcccagggtgacgaagggcccagggagccatccacactccggcaggcacatggggttggtatggcacttctgggtttggttttgatttcatttggttagagttcttgttgggattcaggcatctatttatttcatgaaaagaaaaggtggggaggggactgaacatcaactcccttcctgcctggcctgtgttggccgccagggatgaaatgggaaccatgctcccagcacccccctcccccatcctcacagcgcttcaccccaaggcaagaccctaacctgggccctaacctggacggagggagggaaagggtaagctgaggactatctgggcaggggtgagggggctttccagggagggttgggggcagtggagtctccactgcaaggccgggacccttccatgtgatgtgcttttcaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaagatta

SEQ ID NO: 1616 - DNA, 6169 bp, Homo sapiens
ttggctgtttggtgagttataattaagggcttggctgccttttctggagtactgcatagtttacaaagtgctttcacatacatgatctaatttggtttactgaacttagaaaggtagactttcaaggaaaaaacatcgatttccaccaatagtaaaagctactgcatcagacctgtcactcaacagcgctccttgaggcctagctcctgagatccctctggcgagcccttgcggctccacatcctcgggacggcacgctcccacgggactggagcaaaggtttcagagactcgggatacagccagatctcttcggtgaggagactcagtcttactcgagtgtatgtgatttttaaaaaagacattgaaacaactatggaaacagaggcaaaggcagcaaggctttgggtttgcgactgggaatccgtgcggcctccctttggtgaagacctgaccccgtggtgggggtgaacagggtttccttgaccccgtcccagggttcccttcaggacagatggatttcactaggggaagcgtgatgctggtagcctccactctcaggctgggcagggtaggctcccagggaggcagctcccagcgcagcctcttccatcactccggctggagctagaaggagagaagtgagctgaggctctagaaagtgctgcactcctgcctttctttttcccaagggtgctcttgacatctggagtgcagtcagcaggcctttccgagtgggctggctgcctcagatgcctcagtccctgttgctggggatgcttcggtggggcctcctcactgtgggccttctcttgggtcagtgtgatcctcgtgtcccttccctgtgccagcgacactcgtgggcttcacgtggctggcccctgctcccagggctcttgagatgctgcctctgactgcagctcctgccacactggcacctgtgtggccgctgctcccctctgcacctgggaatagctgcccagagacttcctgttttgaaccttttgccttgctcaggcagccagcaagggccctggcactcacaacagaagggccctgcagtgctgcggctctgctggcgggccaggacaagctgtggggcgcagacacactgggcacactccagacaggcacagggcctctgggcagtgagtttgcaagtgttttgtggtcctggatcatgcacaggcttcttggcagccaggagaggctgtctctgcatttagtgtgcacacctgaaagagcggcccctcacccactaggcagtgtcctcccacatccccaggagggtcttcctgtgccatctgaggtccacttagtggaaagcctttgccacaccaggacactttcaggactactcccccacgtggctgtgctcatggtggccagggctatatggctcttgaagctctccacacacttggcacagatggatggcttttccagtggaatcaaaaggactcaggcattctgaggccagtctggccttggggtttttcagcttcccagaagcctgcagaatcgttctggggggttcccagttgcctccagaatcatcttcagtcttgtttctgactgtgttaccaaatactgtggaagaaactcagatgttagcctagtgatggggacacacttcttttgttcagtgtgacctgctcagcctctagcccccagccccagcgagatgacggataaggcagcgtcctgtggatgccagagccggggccaagtgtgggtcagcatcccagctcagaggagcggcccagtttgtctgagaacactgaagtcccagagccctggggaggggcttctgaccagcactcctcctgctctcattccaacacacacaaagggaatgtcctggtccagggagccagggctctcttgctgccatgtgaataattccctgtagcagccactgctagacagcaagcttgggaagccttcttatgcagaaatcaaagtcatttttataaaaagtgtcacagagtcccttatgaagacagctggacagagcaggagccgacccttccctgactgcccagttcagtgagcccggtaaaatatctgccgtcagcagcctgccatgaggtgcagtgaggaccttctacttcatccctccaagctgagtcgtatcataaaatgcatactttatgttccttctgcctgtagagaatcagaaagcacatgatggaggtttcagaaaagggcttgtgagatcgagcatgtcagagctgaagatctgtgtctgtgagacatgtcctcctgaaagagcacacatgagctgacatagccacggcgccggattgccctcaccctgattgtcccatcagtgtagcttgtctcaagaggtttacactgtggctgtgtttctcacaggttacccaaactcctatcataaaggcaggaaacagaagtaaaaaacctgaatccaaaccacaggaagtgctgcggagatactgattcgtgggttgatcagagcccaggaggcactaaaggctcaatgaacatggtgatctttgtgcaagagatgttccatcaaggcttacctggctgggtggtagctttttggcctctgttgggggctgggaatccttcacccaaagctcatgttccctttcaagtctacaagtgatctctggtttggcagcagcatgcactgtagggagaaagacagcccagtgcccctcaacccacactgagcgcacatagacccgtgtcagtcctgaagcctgacttgcaccacccatttaatgccctgggctcaccctatcaatttgggacagcgggggtaggttgtaaacctaagagagctccagaagtaggcagggcctggcatacaggtagggatgtttatttcagggcaacttcaggagtgccaagggctgataaaacagtgcaattgtcataatatgttttcccactgccagggcccttgaaggagaaacaggctcaactagtcacagagacaaccatgctctgggtctagttctccctgaccccacaggccaggagtgcccctattagatggcaagcaagcaaggggccaaggtcctcacccagcaagactcccagctcctaattccttcttatcacatcctggtataattccttctactcatggccaccagaacaatgggtggaaggtaggtggttacatcattaaatgtcacaggccttatttgcaaagacagagacatctggagctgttgttctcacctccgacacgtgccccgtctgcagagagcattaggatgcatctgtggctctgaggtgtgatttcctagggccttcaagtgtcctggggctcctgttcatttgcactgggggacactcagggaagttttaaagagcctctttcagtggctccttctccttctaccctttctaggaattcatcagccccatgaaaagatgaacgatagagatgtcaccaacatcaggaccccactccctgggagatgtcatggaaacttgtcaatcacacccaaagcactcactgaggagccatggcagagcagtcggtggcgccaataccaaccagaagccgccagggcagaggggaaccgtgaagccagtggaatgcacagctccacctcaggggaccggggtaggcggggctgtgtctggtaacatgccctttgcctcacattagtgcctctgaaaatagtgtcctcagcctgggcacaaaccctaggggtgagctgggagtgtggaggagacgctggattagggagaagtctcggccatgtgttctggctcttttactgatgagctgtgtgggcctaggcaagttacttcacttctctgggcctcagttttatcacctgtaaagtgataggattgccttagcctctaagatccctttcagctaaaaacaaagttctagaaaataaatatgtggtactgtggaactctggggagctgtttgatcaggtgaacagtttacccatggaaatggggctccagcacaaagctgctcacatcttccagtcacgctccagggaacagccagggcttgtgggcccagatgaggctttagtggttggagaaggagccagttcctggttttaatcccttcatggacctcagaccatcacaaagctgccaaacaaatgacacaggcaatcacatgcaaattaggacagaaatgaaacatcaaagacattaaaggaaaagagtaagagctgcaggctgctaatatgagtggctgctcagactcagcaatgtttttggttctggccaaagccaagacaaaggagcagaggcaaagaaggaaatacatttcactttacagctgtcattttctacagaggatttttttttttccagaacaaaattcaaaaagtccgtcttttttgagctatagaactttcgtggtgattttttttttttttttttttttgagacggagtctcactctgtcccccaggctggagtgcaggggcacaatctcggctcactgcaagtgcaagctctgcctcccgggttcacgccattctcctttcagcctccaaagtagctaggactacaggtgcccgccaccatgcccagctaatttttttatatttttagtagagacggggtttcaccgtgttagccaggatggtctcgatctcctgacctcgtgatccgcccgcctctgcctcccatagtgctgggattacaggtgtgagccactgcgctcagccctcgtggtgattttttgaaggcctgtatggacatactcttaactctatctcctggatgccaagtgcacccttatcctaggccagtgttctcaacaatgtacacactctggatgagaaaaataaccattgtttacaatccagctaaaatctcacctcctccagggagtcttcctggatttctccaccctctgaattctcataatgggcatttggctactttgatcacagggctcttagaactgcgctgtccagcattatgattttaccagaatatatcactcctcaactactttagaaacccctcgaaggctaggatggtattttatacctaacagtttggtgtcatcccacgcccacctccaacttacatgaatgttggaaggatggatagggaggtttcaactagagaacggagaagggcggatgtaactggttcttgatttcagaaaacagccaggagcacacatggctgacggggtcagtgcaaggacaggcacatttcccttctgcatcacgtggggactgcgcctccctatgtcatgaagccagggaatatgtgtggccggccgcttggggtagcacttgttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatc

SEQ ID NO: 1617 - DNA, 29060 bp, Homo sapiens
agcgcgcttatcctgggtccaccggcgctaccgccccccgacgtgagagagcgaagttcttgggccgcgctccctccctacctgggtgccctccccctccgggagcctgggtccccggggcggtcgcggcggctgcatcctcaggccaggccgcggggggagggggcggcacgggcctccgaaagcggggccatggagcccagagagtcggggaaggtaggactggaaggcccgggggccgcccgctccctcccgaggatccccgagccgggctcgggcgaggcggggcggctcgggcggaggccccgcagatgagccaggcttgcagggaaggactcgccggcccgccctctcttcccgcacttcggcgcccgaccccgggagggtggcggagaggagcggacgcttccgttcggtgtccgcgcatcctccccgagctgccgagcgtccgctgggtcgatgctgggttgggtgacccccgagtggagcgatgcgaaggtgcttcctgttttccccaccaccttcggcgttttgaagaggccctgctaaggcttggagtctggatcggacgccagtgggagctgcagggtgggacgcttgagggcttgaccctgcctagatcctccttaccaagaaagggctgaaaagagagggcatctggcatgctttttgccacttctgtttctaggttatgtacttcatggaatatctgggcattgcttagaaacctgtgtcataaattggctttgggcaagaggctttgagttggaagaaaaggtggaaagaaagtgcttgggggcggagttcagggatttgacgggattgccagcgcttccaggccgtgtcatccaagaccagtgtggttgtgggcacattagcttggagacagtggcagcctcttgggactaacatctttctggatgttgtttgctgccagttcttgagtattgtttcttatttggcacagaggagaattctctcaacaaacgttttcgactgtttattgagtcccttaaaaaactgtccatttaataaacatttgtgatctgtgatttgcattgaacgagatgctggaagtatgaggataaataggaaatgatcacctttctcaaggagctctcctgcagttttcacttcaataacttggacacgcctgaaagggttgtcccacacgaaaagagagaaaaggataatgaggttcttttgatgctgtagtttttcctgggaagactaggaaggactctgaatttcaaaagaggtgatttctcgcatgagcatctcttccatcctccctccctccacaagctacagtgatgcatgtagcagacacggcacctacagagtacgtggtccaagccaataaagctcaacaaaacccaagcaaagatggagcttatggcccttaccctttggaaatatccccagattggtttagattgaacctgaatttgaataaagagaagcaaaatgtagggggaagaaggattataaaatattgggattgatattggtatcagtgatttgaagttgatttccaagctattctgttcagtcagaggctttcttagcctttaacgggagaagagaaatacggtcatgcgctgtataacaaggtttccatcaacaccgctctcacgtacaatcccctgagactacagtggggctgagaaattcctatcacctggtgacatcttcatgatcctgaccctgtgtaggcttaggctaatgtgtgtgtttgtgtcttaggttttaagaaagcttaaaaagtaaaaaaaaaaaaaaaaaaaaaaaaaaaaaaaatttaaaaatacaaaacctcatagaattagaatataaagaaaaatactttttgttgatggaatggtttgctggaaaataaaaatacaaaaatatttaaagaaaaatattgtacaggtgtacaatgtgtgttaagctaagtgttattacaaaagagtcaaaagtttaaaaaattaagtttataaagtaaaacagttacaataagctagggttaatttattattgaagaaagaaaaatttttgataaattcggcgtagccttagtgtgcagtgtttataaagtctacagaagtgttcagtcatgtcctaggccttcacattctctcaccactcactcactcactcactcactcacccagagcaacttccagtcctgcaagctccattcatggtaagtgcccaatacagatggaccttttttttttttttgtcttttctaccatattcttactgtaccttttctatgtttagatacgcaaatacttaccatgtgttacagtggcctacagttttcagtacagtaacatactgtgtaggattgtagcctagggggcaaaaggctatataccatatagcctagatatgtagtaggctgtaccatgtagttttgtataagtacactctgtgatgttccacaatgacagaactgcctaaggacacatttcctagaacttatccctgttgttaagcaacacatgactgtacaaacattttgggaggtagaggagaaacctgattccgtgtcctgtccaaccactaagtgaaacctcagagactggaaatttcacccttgattataatcttgattttagggtatctcagaaaggtgctcacccttcccaaagatagttgttttctaatatgggaaatgagaacttcatacaagaatgaaataaagtaattacaaaaccaactgtcagtgtaagatgtgttgcaaatgagtgacaaggaatagcggtgctgttctacaactccactccgaacagcattcttatggctcagaactgggagactacctcgtgagatagtggtttggtctattactagactcttccttgggtgctgttttgtggtctttattaactgacagccatcttgggccattggattgatatcccacattgaatgtaggacatcttgcctgtcattgacagaataatggataagggtcagacttttccccatcatgttctatcccatgatcctgttttattttcttcctaacccttatcactaaataaaattctcatgttcatttatttatttacgtatttgttgacttgactcttacatccccagctagaacagtggagcagttcctggcatttaatagggtctcaggaaggaatgctcataaaatagcatcactacaggagcccttttgctgcaaggtgtgggtgctctgaagaacactgcagcccgccacctcatgtgcctcctaggagactgtgctgttggtgccccgaaagagaagtctatatgtgtacttgttgctgtatgtatttgttgcctcaacgtttctgtttcttggccctctctatctttcctgtacaagtgactgatactcctttctcatttttttctgaacatggttctattattgcacttatatcttagttgtctgccacctcctgatagattttaatctcatatctttgaattaccatgcatcaagcacatagaaacacttaagtaataaatgtgtgttgaatgaaaaaatgaattaaatgcctataaaatactttccatatagcatggttgtggggggaagggtggtgttgatgaaggaagttataaaatcaagcagcatagatttccttaacactggactccaggggggatataaagccttccttgctcaggagaaggataaatgcttgggccaggtggttaggaaatccttcctgaaagagaacgtgaatcgcgactttatgggtgggtagattctaagttggtgggaggaagtgtgcagtcaggatctaaagactgggaatgtagagagaggaaaggtgcgagataggctgggtgattaaaatgatatgaatctggctggaggagacattccaagcgaggcaatgcacagagctaaagttagaaagtgggttagattcagactgaggggactttggtgctagactgagaagtcagacagctttaccttgtagagagtgactgggaaccgctaaaatagaacatcgagagagattctttgcattacacataggtgaggagctcctcttattcacgcagatttgtgttttctttacattgcagtcacctggaatcagaaggctcttgctataatattgcttaagagagataccaggtgttagtgttatcactcttgttaggaagacactattatccaaatggacagtcctagccatgttcctcctcaggtggagctaacgtgatgggctccttggcccttatgctcacctgtgcatgcccgggaaggatgggcatgaagagggatcctggctgtcctgaatcacaagtgttttaacctgccccaatctggacaggctgccctcccgtcctgggatacagcagtcatcctgaatctgccttcagcctaatcttggggttgtcttcaatgcttccccacgttggctgtccctaggttgtatctcatggtgactcctgtttgaccactttctttgagtggagcttgtcttccaatcggtttttggaaatatttcattttgctttggaagccactcgagcaaacagttatttaaatgtacacatttggcagtacaattccatttttgtttttaaaactgttcatacatattcatagactaaagactgggaggttatataccaaatgttaacagattctcaggaaagaagggtaatgaaaagtaattatttttcaataaagggaatgtaggtgatcttaatacatttttttctgcttatttctattgtccaaattttctgcagtcaacatgagaaaaatctattataatagtgaccggtaagaatgattgatatcattttcctcaagaaatgtctactgttgaggttaaaatcgatattccacctattttaaatggcatgctgttatttcccaatgttatttttctttggagtgagaagtttgttttttgttgataatttgatttatttctttttaaaatttctttaactaggtaatgttttcatggcacaaaacttaaaatgataaacatttctacttctttttctgttgatttcttttataacactttgttgcgtggctgtggtaccttaaacctctttgatggtgtagcttgatgatagttttttttaagtttttttctccatgccttccctccattttcttagcaacctgccccccaaaccccaacacctcccatctattttggtctctatagtccctgttagatcctttccccgagtgtctggtagtccagtctgctgacatttagtggtggaagaccgaaaatgtaatagctctgtgcttgtgcgagggaggacgggcttatcagctggagcctcatgtaaaggaacctggggaggcatttgttggggcacagccctcccctagttcttgttccattgggctgcctgcccgccctcccatgctggaggtttccggtgctggaagatgccaagcctttgaggatgcagagtgtaccttgggtggttctccgctttgcccgctgccgggtgagggtttgattttcttggatctgctgaagtgactgcttttgcatctgcttcttggttttcaagagtgtattgctgtcatctccttgttgcgccccctattatagtgggggttttgttttggggagggggtcttttaaattcacggggaataaacaaaattaaatgggcttgtttaatctgccatcttaatctggaactcctccaaacactttctgaactccctacccctcagagcccctttacaagccacacgggatgtagatctcagccccaaagcattgcctgttttcatcatcgacttcattcacagacatagttctaaatgactttcagctatttctagaaattagacacatcttcctaagcgaaggtttaccatgtttaaggttccatgaaagaatgtgccctaagttgttgcccagcccctggctgagaagaaacgggcgtgtgggaggcgggtgaagagcacacagggaggggacggagaagctcctgagccagcctccttcatggctcagtttcatttcagtgcgtggcacttcccagaagaaacgagtctcgttgtcactgtgatctgtacccaggtggggagagatggggtgtgggccatgcatgtaaattgacaacacccctccccgtgtagggtgccctcaggtggtcaggaacacttttggaagataaatctaaggaagagagtggtacttagcagctgtcattttcctttcaggctcctgtgacgtttgatgacatcactgtgtacttactccaggaggaatgggtgctgctgagccagcaacagaaggagctctgtggttccaacaagctggtggcaccactgggtatgggtgcccatccacatccctgccactgtcaatttagatcggcattcccaacctcatctgcgtcaggaacactggagagagttttctggaatccaagcatttgtctaggcatctttactccacctgtctgctcgatcccgtatctaccttaattgcatgcaaattcacacatcaccctttctcttctccccttaaaatggtcaagagaagtggggcaatctggcaggcctgggctagactcctgggtctgtctcctggtgcctcagaatgccccaaggggccgggagggaaactcggaaactaggcctgtggatctgtggagcccgtaggacactggaggtaggaagcagtggtggcaagagcatcacatttgtgatgtggaaatctggtctcaatcccagctctccactggatacttgaatgcccttggcctttttaagcctgaatttccatcgtcttagagatgagtgagataaaacagtttaagagtttgcacaagtgtaggtattttcatctcatctatttttgaatgctctttcctttgattctttgggtagactttctgtgcgaaggacagaggtggttggttgtatttcaacatgtgtgtacacatatgcactgtttgctgattgcaagttgatgactgtctaccatgcctgtcttttcttatttcatcttggcccctgtgtaaggcacggtagaagcaacaatcagcattttatgggtggaaggattgcagctggggtgagtcttcctgtgccggctaaaagagtttgaaaaccactgattcttccaaacaagaagttgcaaaatagcagctcatgggccagatatggctcactgcttggagttttgttttgctttgttttttggctttcatttcttttgtttggcttcttaaaaatattaagtaaattgccaatatttagttattaggagttttcacataagaatatggatttctggcatctcttgacaaacgggatggtgtggcagggctgagcctgcatcctgagtggcagcccttctgcagctgagtagctgctgttcccttacgtcttgcaggttgccacagcccctgcacttggcctggtttcttctgttatattaccaggctggcccctctcagtatttgggtttctgacccatagtttgtatacctgtttagcctccttgtgccctcattcctttctcctagtctcctattctattaggggcctcacagataagagtttctaaaccactgaaccactgtgctgaaccaccaagactcctactttcctccttggccccttatctcaccatgccgagagatgtcgcagacagatacctccttcgtgttgtgacccggagccaggtcttcatagtgcttttctctctctctcgctctcttttttttttttggactcaggaccaactgttgccaatcctgagctgttccgcaagttcggacgagggccagagccatggcttggcagcgtccagggccagaggagccttctggagcatcacccaggtgagtgtggaactgcactcaggggcagatgcttggctggagagggagcatgggcagccccaggactccaggctcatcctctgcccttcctgttctccaccaactgacactgctgttctcctcccaggtgccatctgattaatacctaaatatacacactgcccctaatgtccttctccaacctctcatctcccattgtcttatttctacccaggagaatatgtttatttataattattataagttccatgaaggcatgactttgtcttatttacaaccatatttctagtgcttagaacaatacctggcacccagctgttgcacagtagataatcactgaatgaatgaatgaatgaatgaacagctgtctgctaagttctagggatttatcttttctttcctcttttgataagaccctcctgttcaggggttggcttagccaggccagatgacatcttggcattacgtaaaataactgcgttaacccagcccctactgtgggagaagagggaggtggggaacaagatcctgtatgaatcaaatcacagaagtttgttttcccttgtgatttctctcagaccacaaagagctctagacagctttgtgactctggaaagtatcatagagacaaatttgtttcatttccccttgcttggctcttattttgagccttctgactcttactaacagcttcatgcccttacagtgttgtagaccagtctgttggcctggcacaaaaatgttgcgtcctcagccactgggcattggaacttatgttggtacataagaagtggttccacaggagttagagtcttttgagttgcatttcatctaagtgaataaagaaacttctagttcagcttgaagaagaaagatgtgaggtcatgagagtcctcatctgttcgaaggtttatgttataagagaggaattagacttgagtttctcttgagaactgggtcagcatccagtactttgaggtagaagtattcgaagatagattacagcttaaggaaaactacctggggaccaaaactgcctgcccaggagataggtagctttcttcccctggagttgcggtgtgtggctttagtgatcttttttaaatcctatattctattatgtcagtgttcttatccataaataaattttgactcctgaagattgtacgtttcatagatcagattgcaaagacttccttttggccggttgtatctgtcctttaaattcaaaaaacaaaaaggagggggagggttccgtaaagcccatccctttggctttattctggataggtgagggaagggcctgcagacttggccaggactagaagaaaattcaggtgtgtgtgtgtgtgtgtgtgtgtgtgtgtgtgtgtgtgtgctttccgtctttcatatttggtgtacctcagagcccctgtgagttgcagtggctctaactataggattttaaagccaatcccttctgtctcttctctaaaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggtaatacgtttataatgattgctgtatcttacagagaaggattctatactgagaacgatgtatatccatgctgatgatggaaaaaagaatactagtgataacccactgctaacatcataatgttggcatataccaacatgcttatcatggactaggcattgttttagacgcgttccatgtattatctcatttaatttggacaacaaccctattatcatctcctttttgcaaataacgtaattagtgagatagaacatttctacttctggtataaaggaaacaatcatctttattcagaatccaaaataaacacagatctcaagaaatagcctacaaccacaaaatcacagagctcttaagtagtcaatatttaaatttgttttgtttaagagacagggtatggccctgtcacccaggctggactgtggtgtgatcatagctcactgcagcctttacctccaaggctcaagcaatccttcccactcagcctcccaagtagctgggaccacaggtgtgtgcccccacacctggataattttttatttttcgtagagatgggaatctcactatattgcccaggctggtcttgaactcctggactcaaccagtcctcctacctcatcctcccaaaatgctaggattacaggtatgatctaccactcctggctagtattttttaaattttaagtttggagtcatgttgcacttgtaaacattgcagttttttcacacatgttgtttgatgtaatgtttctgatgttgctgtgaggccggtagagcaggtgctattaaactcatcttgttggaagaacacagactttggaggaagtgacatgtccagggtcctagagctcttgtagtcagtgccagaatctgcccagagtcctgagctgccagcccatgctttccttccactccccgcagcactgctgggcactaaagtactctagcgcccaccttaggtttcctttgtagttaccgaatgctttggaaagttgtcctgtaaggaaactacgttcattggaagcttccccatttctcacctattgcatagaagtagaattttacaacaaatcatttttaactcccctccaggagtctggtgagaatagctcggaggttcctcctagagctgacatcataaggaatccagttcaacttcgtaaactctcatttttccaaaatccagaaaaacagcatagctcatttcttttcctgttcctgatattttttagtattagaagctaatgaaccgatgtaaccttttatcatctgaattcagcagtgaggcgtgtgtaaaccagtcactggtcataagcatctttagcttttttgaccacctctttgttcccatcccattgggaaatcttaggtgctcctagaggcacacagtcaccttttagttgtaggtgaccaggaggcagctctcaggactctgaggacagcatgcagtgagaggctctgcccagctgcctgttctttccacacgctttcatttccgcccaggagatcctaggatctgaccaagtctcacttggcttttacctactaattctggcctcctgaatttgattctttgactttcagtggataaattaattcctctgagtgcatctgggcctcttggtgagcttcccaggagaaatagggcttccaaaggccccagaagtgtcacgtgggagtctggctcggcaggcggtgctgagtggccgctgctctttgttccaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttgggtaaagacgcaccgagcctcttattcaccaccctcctttgacttgggaagcccacaaggggagctgtggcttgtggttatcttcccattcctgccccctccctgtgtgtaggcagagaccgatcctgtcttttgcacctcataactcccctgcttggggtaactgtgctttatcaccttctcatccacccacctgttcatccattcgtcccccaccaaacattttggagtacctactatgtgccagatgaacacagctgatccatggtctctgctttcaagggcctagcacgtttgtgggagagacagacattttaataagaaactataaaataatacagtctcccataaaagagcttccagaagagtacccggggctactgaagaagagggatttgatttcctgggcattggtgggaggaatcaggaagcctttatagagtaggaaatgttttaattgagttcaaaaccaggtggatcagaaggaggaagggcattgagccatgatggaggggacggcctggcagagccacccctatctgtgcagcccagggctaaggctcctgcatcctggccaggcgccggcaagggttggcagccttcagcacgggagtcatggggtttggaccttggcagattaggaagagggcagtgcttcttgctcctcaggatggtgctctcctctcctgcatctgctgttttatcttctctttgcctctttctggcagattagcaaggttcttatgaagcatcaagatggaaagacaactttttttgttggagacagtctcactctgtcgcccaagctggagtgcagtggcgtgatcttggttcactgcaacctctgcctcccaggctaatttttgttttttgagtagagacggggtttcaccatgttggccaggctggtgtcgaactcctgacctcaggtgatccacctgccttggcctctcaaagtgctaggattacaggtatgagccagcacacctggccaacatgtttttgtcattgttcgtaatttttaaatggcttcccaaacattcagaagtgactaaaattatttattttgtggtgacagaggttttgttgtcatgccctaggttaggtgtatcccctcagagtatcactgcccgtgctgtgctgaagagcagtgagagtgagggcgaaattcacacctgtcttaaaaatgcataccctctgcaaaaagttgggttttcctttaatgtaatcggcactagcgactcagtttcactgtgaggcccccgggcgattgtgaaggtaccaggcgatggtgttgctggcccagggcagcttctgcagcagtgcagggagggctggccaggattgtttagcctgtgcctgtttcctcacgttttgtgtgttgacagagcatgatctaaacattttatcagtttctttttcatttacgtaaattaggcagtagggaaatctcagctaactaaggtctttaaattttatttggatgaacaaaaaatgtaatcagagggaagggaactcattttcctcgagggtcagaggcaggaatcagaaaggctttctagggggtgggcctggcctctccggttgtctgtgaaattgagacaggtatgggagtctagaaacggagttgcatgtgtgtgattcctttcagttactttaattggatctctggttatccttgaactatccccgaatttaaacagttcttcatgtttgagatatagaagcatcttaaggagcctggggactatgggcagggcctggcataagctatttgtatgtttaaaagtggtatataatagtattaaattgggatataaagtagtgttaaaacatagtggagattctttaattgttattattatttttactttggcttgtttttttttttatttcccacactttaccctccataacaaatgctctaagagttgaaaaccaaatattattttgcattatcttttaatacacaaaacaacttcttggggtgaactcagttttgtgtgtgtgtgtgtgtgtgtgtgtgtgtgtgtgtgagagagagagagagagacaggctgtcactctgtcacccaggctggagtgcagtggtgccatcatagctcactgtaaccttgaactcctgggctcaagcaatcctcctgccttagcctcccaagtagctgggactacaggcgcatgccacaacacctggctaatgtttaaatttttttgtagagatggagtctcactttgctgcccaggctggtctcaaactgctggactcaagtgatcctgctgacttagcccccaaagtgttggattacggcgtgagccactgcacctggcttgccatatctgatgaagtctgttgcttcttcccaaaaagcagccagaaatctcaattacatcccactgttaagaaactaatatttgtcattaatggaaatagacaggccaacatagggactatgtgggtagcccttgcttttatttgtaaaggtgtcatcgtatgctgagtggccactcactgcaggcgggcagtttcttgtccacaggagaagtcggtaactacagccaggccttacagagctgggggaaggcgttgtgtcactcatggaaaacaacactgagtgggagggccctaaagaagatgagcaggggagttcgagtcccccagcttctccacggcaggacatgtgatgatggcctccaagtgggggcagccggagctagagaaagaagaaccaaggtgaggggctagagtggcatctatttatttgtttgtttgagatggggtctctctatattgcccagtcaggactgaaactcccgggcccaggcgatcctcctgcctccatctccggagtatctgggattacaggcacacgcactgcacctggctagagtggcttttgcagaatggattcatgggatagggcctgctggcccttggtgaagttagcctggaaggatgaggagtcctttgtaggccaaaccattgttatggactgttatggaatgtgggtgtttgtgggtgtgtgcacgcactcgccacagttatgtgccctccttctttttccattactaagtcatagaaaacgctgaaaattcccctccatttcatttgtttggaagggaacaaaaagaagaggttttgataagatgtaggctgcagcttcagagaggtaccatcagggtacggtattcctggggccagggtagtggcgccagcggcagtcaaaggtggacagtacccaaaaggaatataaatggaggcaaacagatttgggaacatttggtccctgtttgttttcaattattctttaaaaatatttctgccgggtgcggtggctcacgcctgtaatcccagcactttgggagactgaggcaggtggatcacctgaggtcgggagttcgagaccagcctggccaacatggcgagaccccatctctactaaaaatacaaaaattagccgagcgtagtggcacacacccttagttccagctactcgggaggctgaggcaggagaatcgcttgaacctgggaggtggaggttgcagtgagccaagatcgtgccactgtactccagcctgggcgacagagccagactccatctcaaaaaaaaaaaaaaaagaaaaatgacagtcccctgtcccacctttctcttttacaaagtcctgttccccagaatcttgtagctgtttcttccagtaatttgccgcattatttctaaataacgtatgtggacattatcttaggagggacggactccagcaggacgcgcttataaaacaattgcatcctcccgttcaccgctgagcgtgtcagctctgggggccttttctttctcaccctctgggttaaatctaggcagggcctggaactttttcttatcacactcaaataacatgaaatcttcctgttctaatttcagtgagtgcaatgcctggtacaaaactcttcaaaagtgtcccgatcaaaaaaaagacagagaaaggctggcaaactacctcaattaaaggagactgaagaggtgtgacaacttgagtgcatgatgctaggacagatgctgggctatagagacattttggggacaagtgaagaaatttagtatgaacttagattagataatagtatgatatcagggttgagtttcctggttttgatcattataactctggttatattataactttgctttctgctgccccatttcaaaggactgcagactcatgtattatctcacaactctgcaggtggggagtccaggtgggcctgatcaggttctctgcttagagtcttagcccaaaccaaggggccggccaggcaggctcctgtctggaggctctgagctcacttatgctgttgccagaatctagctccttgcggttctcctgctgcctgccagcggggagcactttcagcccaggagctgctctcaggtgcttccctgtggccccctccgtgctcaggccggcagcagtgtttggaatcgtcacgtgccctgaagctctgacttcctgggctgctgccagctgagaacagcaccagcttttaaagagctgtgtaattaggtcggctccactggctaatctccctttgctgtgcaaggtaacgtgatgacagtgtgacctctcatcctgttcagagtcccctaacctcaaggggtaaaggttaggccagggtgagggccctggagcccatgttcgaatcccacctactacctatgaaagggtccttttttgttgggtaatacacatgaagtatttaggaataaagggacatgcaaacaatttactctcaaatggttcagaaaaatattgtagctatacgtatagacccagcaggagagcgtgcctgtgagctcacaagcatgctggaacacatggggcagaatgtcaatgattggagttccttgtgttattcaatcttttctgtaaatttgaaattatatcagagatttaccaaaaggaaaatgtaggaaacaaaagccccgtctctgtgtagtagtagaaaatctggacttcatttaacactcaattcttgcctttccctcctcaacctgctgcggctgtagaatctggacccatgccataggaagaaaggggctcctcttctcccaccccctgctggtttcagaatttctgactcatcctcagtgggaatggcgttggtgggtgggagaggtataagaaaggtttcatttgacatgtaatctgacaccagctacttagagctgtagtcctttaaagctggttctcttctttgggtgtttgtgggttctgcagtacccccaacaggcactgagaccctctcgcttgcagttgcctggacatgggtgaatgtctgccctggcagcctgtctatataggcgccttcacaggggagtatcacactggtagccaaccgtcacgggcaggccccacagacaacgccaggcctcttctcattccccatgtggcccacatctgaaccatagaagcacttccagaccctgtgctctcccagacctgggattgtaggcctttctcgacatggccacctccaaggcaccccatggctaccttagtcttatccaaggctggactcgtggccattcacggctcccagagatacaggtcaggttaagggaaagggcgcacccaccactccccacagtcagagaggctcacaatatccttgacaatgctttccagaaacatccctggtgcccaacttcctggctccttcagtctcagctctgtgactcctctcgatgggcgcaggctggagccacagcccctggccctcagccattctctttccaggtcatgtgtccgtgtctggctttggaatgaggaagagctggctcctgctctgggggctttcagccggagcaggcagccggaatcacactttcatatcctgtggcttatgtttattgtattcctgatttattgattttagatattctctattgattcctactgtggaagatggagatacggccctgttacatcacctgggcccccgcttctcttccctccatcctctcagaacaggtacatcacactttgttggttacattggtataaattatttgcccagttatgattatgtgtgatttactgctgaacaaggtggtgtattgtgatggtgttgccttcattgtcggactcttccccctcgaattggaaaattttttcttctttttcatttttctcactttctttaccctcatcagttcttcccagactgtccagtggaattataaaactcctccgaagagtcttttccacgtgacgggacatcctgtgatctctccatttcattctttctctggagacttcgctccggggccttctcctcccctgctctgtctgacccaggcagctgttaggcctgcggcacacctgtggtctgagatgtgcctttgtctctcccccatttcccgagtctgtctcttcttttgtggttgacgtcttcatcttcttagtgtacatcctccagtggcttcctaaggaagggtgcaggggaggccttctttctgtgacgcatcctgtctaaaaacatcatattcttccctcatgattcagtgataacttgtttgggcatataggattctaggttggaaatacttttcctcagcattttgaaagcattgcccttttaggttttactggtgctattgagaggtctagtgccttcttattccagaatctttgaacatgacatatttgttctactctgaaagcttttgaaattgatttcaattttctcaaatttttaatgatatgccttgatgttttatataaagtgtgtttttaatctttttttttgggtatctggtgtttcccttccatgtggaaactggtctttccctgtttgggaaaattttcttgtatgatttcttcctattttctcttttctttcttccagaaattccttcctattagtttgatattggacttcctggattgagtctctggttttctgtttgtgtctttttctcctattttctgcttttatcttttttatactactttcttggacatttcctccattttattttctaacaatgctattttttttattctattgggttttttagttgctaaacactgttatttcctctttcatgaatggctatcatgagttttctttctaggaatattaattctcattattttgaagttttgttttgcttcctgctgtatttcaagtttttccaaatcttttcctacttgttttggtttctctctttcatgttagaggcttttcttaaataattatctctcggttcattcctgtgtacgagtaagccttagaaacggactggaagccctgtgcatggctgcagacctgtgcatggctgggaagcatcaagagtaggtttcacttttcactgtaggatgaccagttcttcttactgaagaacccacaaaagtcagtgtccatagatcttttgaggggagagggaagggcaattccatttttccaaagaaaacgcttcccgtctcctgtttggagggtatgataagcccagccaacattcttggagtcgagcagtgcaccccttggtccatagacatgactcgatctccctgctttcagtaccgcaccaccccttcacctttctgtgtacgtggtatatggggtctggagcctttctggataagtttttctgtaggccaaacctctgttctcctctggggtgtggtggtggtgtttcctggtttcccggaataggtgagaggacctgggattgatcagatctctgtcagatttgagccagtccactgctcccacccattccccatccaccacgttctcccatacctgttgcctgcagtttctgaatctttctgggattctctggtaccaaccagcttgcttctccttgttaacccctctgcaggcatttggtgttcagctctgtttgtttctctttcttttgtctccttcccttccaaaaatggacttgcattcctaatccaatttatcttgggcttatacctcattttgttatttttattcctttgccctcattttagagatattttaagaaggatatatgttcaatttaacacactttagtaatttacttatttatatttttattagtagtaaatatgtagatattgacacacacatatatgtatcattatatatataagtatattcaagcgatccaaagatgagtagtggaaaccaatctcccttttcctttgtccttcacttcctccccaggagcacccacaggcccagttgcttgtgtggctctccacagaaagtttatgcacacattcacatagacacacacaaaagcatgatgtagatagtgatggattttattttcaatagaggaaatggtttatctgcatacccctgaacaatattcctattttaagtaaaggttagtgcttaatccaaagacacaaatctcctttagtcagatttcaggctccattgcaggtggtaggtatttcagggggccctccaagtgcccctttcaaaaacccatgtagttggtcaccttcacaaaggccagctgtgggggcagaggggcacacgcatgggccagctgtgggggcagaggggcacacgcatgggccagctgtgggggcagaggggcacacgcgtgggccagctgtgggggcagaggggcacacgcgtgggccagctgtgggggcagaggggcacacgcgtgggccagctgtgggggcagaggggcacacgcgtgggccagctgtgggggcagaggggcacacgcgtgggccagctgtgggtggcaccttccacttctcatatggctgctgtttccccctgcctctctctcctgcttagtccctatgtttcttcctgtttccacccttccccctctggtgtgtatggctggcccatggatctgaggaagccctatcctagctgagggctgcccctccccttactgcctctttggcactctgggtttgcgctcagcctgcccctggccgactagactttataaggacagaacccagagacacctctgtgtacttcagggactgggtctagcttgagggggctactcgatttggccacagcagtgacatcagcatgattcttcatccttacaacaggacctgccgctgccaagccagacttgatctccaaactggagcggagggctgcaccctggatcaaggacccaaatgggccaaagtgggggaaaggtcgtcctccaggtgagtgtaaacctacagcattctgaaggacatgtgccagggcccaggcggctatgatgagtcaaacagcatgagctcagctgtgctcatctgatgggggccgattgggcaccaagcctggcaggaggccctgggtagacaagatgaataagcaactaaccctgcccacagagtgtagagtagtctgggaaacagggaaaaaacaggtccttttgtaagcagaagtactgatggaggctgtggcagagctggtgggagcaggtacgtggggacactggtctcgaggagccaggggacccagagatctgtgagcctctcatcccttctccctccttctccagtgctcggtgacagcactattggtttgtgagaattcgttgtcttgcctatctcaatcagtaatttcttggcttgtagttgctacacttacttctgtacctacttccttctgaggcttgtaaaagccttggcaggtgtttaacctattctattgtggagcctcacacgagagtgaaagccacctgcttatccaacagtctctgtggccaagggggttaattgaacttattggtatctggtgtcacatgatcccagggtagctgtgtggatagggtggttggggcgctggtgaaagaacccacaaggattagcaacaactctgggggagccagatgaactttcacagatgagaatgggtgagggtttaagtggacgccactttctctagaaagaaggattgcattcatcttctctgccttgcttaagggatacttattaaatttgggggtgtcttagctgatagaagatggcagagttctgggtagcagaaccaagcatgattcaattttctccaaagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctgcctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagtaagtacacgtggcagagctcccccaaggcagcctcatgctgagccagaggccaataagacaggactgcaggtgcctgtggagcttctgtcatgcacccacccatttgctaggccagtgggtactcgatgcgtgacatccaccctccaggagcttgcacccctgccagggagatgacgcacatgtgctctaggcagcagggcttagtgcagagagcgtgcatttctagagcctgtctgccctggtgacagtgctgtgctggctctgcccccaactggctgtgtggccttgggcaagtctgtcctttgatgccttggtttctcatctgccgaatgagttgtgtgtggaaaacactcaggacaatgcctggcaggtggtgcaaatggtactagttaaaggtcaagaccactgctgggagtaaggagagggctgaccagccccaggcagcgccatcacattctaagtggggctgtatagactctggaccgtgcaggaattttcaagagggaagaggtccatgtggctgtggaggaggtgagatgcggaggagatggtggggctttcaggcagaaatctcacggggcaggggagaacagaaacagcctctctggaccggagggctggggtcaagaacttgcttgagggggaagctgtattagaagggagggcaagttactgaaagccacagacaggaaatttttctcttcaagtagtcactgaaaaccaaagaaaatatgcccattgttggggttctccagaccactcgcgaccacttgacaaggatggagcagtgctctctctcctcgcgtctctagctggcctccttccggctgttgctgctcccagtgctctctctcctcgcgtctctagctggcctccttccggctgttgctgctcccagttttcacctctgagtctgtggtcaccagaaatgggactggatctcatggctgacagaggctctgtaggaagcaaggtggccctgaagccacagtagggcaggtggggataagaaaagagacccctcactgataagagaaagggaaagccgagagagggctgggtgagttgctctgtgtccagccctgtgggtgctaaggagaaaaaaatgatgtcaggtgtgccctgatgcgagttactctttccacagggacaacaggaccagcacagattggtccaaacactgccaaactacgcaccgctgcctccttccaggcagggctctcagccttggcattgttgatgctggggctgggtaatctctgttgggggcccttcctgttcactgtgggaacttgagcagcatccatggcctctacctattagataaccactggataccagtagcacacaccccatttgtgaccacaaaaatcatctccagacattggcaaatggcccctgggggacaaaatcgcccccagttgagatcccctatctcaggataaaagaatgaacagagtagcaacagatgagggctgcaaagagcagtcgtggtcctgacttcagtctgttctgccaagctttcctcaccaaacagcccctgggcgaagctggatgtggaaggcggtcactgtcagtcagtctaattgtattctccttcctccctcacaggcgccaggctcaggaaggaggagatgggagccctctatgtggaggagcccaggacccagaagccacccatcctgccctccagggaagcagcggaggttctgaaggactgcatcatggagcctcccgagagactcctgtatccccacaccagccaggaggcccccgggatgtcctgagggacagggagtccttgggactgccttggagacgcctctgtgatcactgggacaggctctgcagattctaggctgccctaggatcttctgctggtggcgatggtctctaagcaccaggaagtgggcagtggcatcccagagcagcaggggtatcaggaggtgcatgacctgtttcctgaggccccactcagcacagccatgcctcacagcacacaaatgtgccagaaggttctatatctcaagttcatttttaaggtgctgcagaaaataaccccatcatgaaaggtttcagcccctgagttttggtggcaagaggagtgtcctggtaggggagactgttggacatccctggggaatgttccagggaggctgcccacagtctaagtgggaatgggaaagaccaccttgttagagggggaggttgcccctgctctagggacagctggcctggctgcaagagcccccagaggcattgttctgggacttcctaccctggctcccacagcagaagcagtgaggccgtggtctcgtgcggaactctacctcttcccagggcttcctttagggcgaaacaatcacaagccctttgcacagagcacccaagaaagttctcttcctgcagctccagatggtggagctgggctcttctggcagggggtctggtgcttcccggagagccgagccgcgtttaacccgtggcatgcccggcccggtttacccaggagaggatgggacgaagttggagttgggaggcttgggatgcagccccagctctgctgcaggcagtggtctgattaatcccttcctctttgtgcctcagtttccctctccatgaagtggcagcagagatccaagtgcctgctgactccccatctgccctaggattagtgaatgagagcctcgagctccctcaaagacctctggctgcagtgtggacttagctgccatctgccccatcctcgtccttagtgggacaggtaggaatttgtctccaaagtccttgttgtaggagttgctctctgaatgcaccatctgcacgacaggctagtccactcttctctgagctgccctggggactctgcaccaggatctccagggcccactgagacatccccgaatgggcgctcagtgacaagggctttgaacaacctcctccagggactttgggcctgctctagcttcagaaccacagaaccaccgccctagaggcacagaggggcttctggcactgctaggttcacaccctcctcgccccgatcttccttccacctaaagtgaagcacttttccttccaagggcagctccgtcttggcaggctcaggaggccgcttatcaggaggaggatgattttgtctaggttctgccttccttaaccatgggcaggaaatgaggcaagtcagcaggcagggtttctctgccctgcctgatacttgttttaaacaggcaggaagtgggcgccatccatcccagcttgcttgctgcctggctcaggcaggtcctgtgctgtgctgcaggcccctgtgggtgggccctttctccatagtctgccgcttcccattcccagggtagatgctggcatctgagcacctgagtacccttcctattcccagggtagaagctgctgtctgagtacccttcccattcccagggtagatgctggcatctgagcacctgagtacccttcctattcccagggtagaagctgctgtctgagtacccttcccattcccagggtagatgctggcgtccgagcccctccctggtaccgcaggtaccctggtaccccacctgccctttcatccccaccccagtacttagccttagcactgttgctttcgtgtcattttcagttctagtcaggaattcctttcttgctttctgcctttgacctgtggaaatgtctcccagccctgtgggtctggcggtcagagggaccccacaggcctgtggtgcgggagctctgggaggtgttactatctgcgtggctaaggcacacacaggcctccttctccccatcaccgtctccatgggcgttcaggaacttgcccaggtcaggcactgtggatgtgaactcgtggaaagggagggagaaaggcttttttaggtggggctatagcctctgccctacccacagggattccacatcaaggtgctgttccagcacacatgcttcctgcggcctcttcatccttgaagaatccctcagagcaggaggccatcctgtgagcagccgtgagtgggtctctgtgggagtagttctggagctgaggtggaagctaggggaagcaactcgccctctccacgtcagcatcagcgtgctccgaggacaccggccagtgccttccttaggtggtgggaaaggggggtccctgtgcagcggggccactgagaatgctgtttgtcataaaatttgcactacccgatttctcaaggggcacaggcctgctccgttcccctttgtcagccaatggccaagaaggaagaagatgactgccatcttattcctgaacttcctcattcaggacccccgtggaaacacagtgagcatccttatcagaggccctggcccaggctggcccctttgctttgtttggagaggctggctgagtttcagcccctagtgctggagacccccttgttggagaggcttcctgtttatgcctcacaagaagaaaaaccacagggctctgggaggggaagaagcatgcactcccgctttggctggagtcccagcgcttgtcgccaccctcctccttgcctgtagtcttgacagcatccgtatgtacgtgtcctggcatttcccctccctctccctgatgactgatacccaccgggtctgacattccaagtaaccagtatgtaactggtagtttgatcccaatagccatagcgactccaggtgggagtgagggagcccagccccctgtcctggaagataccttagagtatgtgaccgcgctccagacccttgcttctctctcctgcagaggatgagtttctagggtgctaagtacctatcagaacagtgtggaggggcgggtccctcatacaggtgtgtgcttagccaaatacagtaactgtgactggcccagggatgttctctcctctattttcaaagatgaaaggaggttttaaaaaccatgtttgattcctaaccttttgctacctgaataaagcagagtctatttcaacaca

SEQ ID NO: 1618 - DNA, 31148 bp, Homo sapiens
ttaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcattattacaagcatgtcaaaaatgcagagacattaaataacttgcctaaagtcagaagtgagtcagagacccagctcaggttccatccagacactctgcttcccaggatcctgtaactgcattgggaatttgtaatt

SEQ ID NO: 1619 - DNA, 31014 bp, Homo sapiens
ttaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcatt

SEQ ID NO: 1620 - DNA, 31148 bp, Homo sapiens; identical to SEQ ID NO: 1618

SEQ ID NO: 1621 - DNA, 31014 bp, Homo sapiens; identical to SEQ ID NO: 1619

SEQ ID NO: 1622 - DNA, 157124 bp, Homo sapiens
tgcaattcttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaacaacacaagatttaccatgcctaggggatgaatggcaaacccaactttggctaatgtcattgagaacaacttggaagcgtgagcagagatatctcatgaagtggcagtgaacctacatttccatttatcagaagcaaacatggaaggttacatacatgatgaagtattggaagttaaagacttaagacacaaaatcactaatttaaaagaacatgcaacatgagtatcaacttgctatgtagtgtacatgtaaatgacccaaatattcacctctagcatcctgaatctcttcttactacagctgttatttgtacagccactgaatgtagattagtaaatactgacatcacaatgttgacacatgcagggagggggagataaagcaacagttcttccttccaccttttccaaagtctcaggattaggggaggtaataagttttggaaagaaactgaaatgcaacctggaggagagttggacaagccacattttccactcatgggaaagaagcggaccattctgctactttcccaaagacaaagggactccttaaagggtaactgaaaaatgagcgctatcctcccagactgttttcttctatcaagtactgcatcatcggtaagcactgaatcctacctttcttaattatactagccaatgacttccttgttctcgttctttattctaagatttcccaaaatttgtaatatcaaatccaggctttagtttatttggaaagtggtttcagcacctggaagatgagctggctctggggctctggaaaatcatattcctttatccttgtcccagagaaaagtaggtaggaggtagaaggtttgcttttgtggctctggatggtggagaaaggtaaaaggaaaatgagaataatgggagggaagaagacaggttaaatctgcaagggtagatcaaaggtaaaaataaggtggaaaaacccattggtacttccctttttctttctttacacagttagttagttagtttgtttttttatagaaaaattagggttctacatttacacatagcctgagaaaatgaattacaggatagtgttaggctcacatgggtaagtaaaaaatctacagaaaaatctagtttcaactgacatggctgaacactgaaaaactgccaagaagttacccccaaaagatacagagaatgtatagacagggacaagtcaaagctcttcctgttataccctctccctaccctgttacagggctgagcagagttggtggtagatgatcataattcaagcaactattgctttttcttctatggctttggctgaaatgtatatgctgattgattgattattatttgattagtacatatccagatatattcagattttgacatttaatacacagcagaggaggctgcatcagacacatgacactctgtgacatccatttcattcacaccccccacccccacagtcagactgaaaactcacaagaaggtgtctgtggtgaagaacattacaaaggttataaatcttaatagggccctgagagtttttccccctatgcttaggtgaaaaaggcaatgaacaagatgctctcgttctttaagtgctttgtgcaacaacgtccgtgtcgatgccgaaatctttttttaaatctttttttggaggaatcttttggacggaggcaaaagtcttcctccagagttccagtctcagaagctgcgattccgccggtggtgacgctccagttaccctacggtgatcacacgtgtgctgatatacctcttgtgcccacgttcctccttggggtcagtcctgcagacctgcatcaaaatgctttcagagagtctgtggactttggggaggtgtcatctgggtgaaatgctggggctagggaaggagcccgaattccttggtgactgcaaagggatggcggaggatgtgggggatctcttggggctacacaggtccccattgtgcagtttccacagaagctcctcgttttccatagagagtcgcttgttgactttcgactccttctccagcgactcttgcagaacagcctgctccgtggaaagctgccttgaagaaaaaggccagaaaccatgagatctatgtaaaaaaaaaaaaaacttgaaaaatttttcttagcgtttgaaactttaaagtccaaaattattcctttgggataaaacagaatcctgcacaaggtcacaggtatttggctggctaagaaaacccaaacacaggccgggcgtggtggctcaagctcataatcctggcaccttgggaggccaaggtgggtggataacttgaggccaggagttcaagatcaacttgggcaacatggcgaaactctgtctctattaaaaatacaaaaattagtcacgcatggtgacatgtgcctgtagtcccagctactcaggaggctgaggtgggaggactgctcgagcctaggaggtggaggctgcagtaagctaagatcacaccactgtactccagcctgggcagaagagtgagacctcatctcaaaaaaatatataataataactgtactttttgggcaatttcatagtaggctgagagccacttttgcaaatattcgacatgttttatgactaccttatgttgcaggctgttttctatttggttttgtgttgctctttgtctgaaagcattctcagaggcagccagaggccgtgggagcaggcttgctggcctgggtctcagtgtacagttttcaggccgctttggtaaaagcatgaactactacaatcatattttccacagagaaatcaatgcccttttaaccatctgcttccatcatatttccaggaggtgcaggggtagagcgtgtccagaaagtacactggatgtccaagggagcggggagctcgggagaaacagcactgttttatttttaccttgagattgccatgtgcttgtccatccgagctttcaattcttcattctcctgctggaaacgcttcaatttgtcaaccaatgctgtgttgttgtccaccttggcataaacaagaattccaacatttatacaatattaaaaaaaaaacccctcatttcttaaggcacctcacgacacaagcacactttggagatttaattaaggaaaatgcaattccatattaaaatatttatacactaacaaacatactgaaaaagattttaaaacagcaaaacagagcggctgggtatttttaaaacatgtatgccaggacacttaaatattgatacgagtgggtaacagatttgttccaggtcatgttgttttggaattctctaagaattggtgcctctttctgtttcaatgtgaaataaaccctgcagacacactgcccacacttatcaaagcttatctatctccttacggtgaattttgctggaaaaaaaaaaaaaaagattcccacatctgatgaaaactcacaggccagcaattcacagtccctggcaacgtttactatggacttgaactcagtttcatggtaagttttcagcatttgcgtctgagtggccatacaaagcttcaattcgatagagctcttagagcatgccatcaaagaagtaacatgccacgagtctcctcaggtcagctgaagatagataggtctgttctcttgctgccctgtgcaggctgaactttcaaggcaaacaaactgatcagcggagagatgaaaggataagatgcctgaggacatttaatcacttaacatgatgaagacctgattccatcccccactcactttctaaaggtaaggctttatgaagaggcaatattatagctccgtcaggattaagtctaagtccttgtccttgtagcaggactaacgcgctttgagtatgttgcttagtttggaacctgattgttcttaagacatcctgttatccagaagcagctcaggacaacctgttcaggttaaatcactttccagaaaaggagtctacgttcagtaattatgaaggattcccagataaaacaacgtggaaaaaaacctggaatttgagattgggaggtattgtcctttaaatatctcatcctagggaaactagtcctaataatgtcacagagctgattatgggcagtgccggtttcatgggaaagctgtctttcttagaaaacttcctgtgcttctaagtctcttaatttcatcagaggcctgtaatttacaaatatgaagggaacagtgggtctccctctcattgtatcaactcattcttgcacacatacacaatgcaaggctgaaggatattatcaggatacctctggggcatggcaagaaacaaatagtagatcatcagaaattaaatgtgttggtaagtttacagcaaagtctgatttattgcacatgattttttgaaagttttgatgcatgaatggcatatggagcagtcctattaacaggatcatctgagtcatccctgactaccagattagaagataccagactcagtcgaacaggacgacctttggcaggaactggtatgtatactaggttggcccattaacaaccatgagttcctttccttcctttacaaaaatttcctgataattcaaaatgctggtatatccacacaggggcttggccgttatctccctcaacagaagtcatagtctccagaagaaaaccaaacgccaaaccaacacaaaccaagcagcagagaggtcccccatgtcccctactgtccagggctggtttgggtttgaatgaggcacttgtagaagcctgagtcactcatcactgtggggagaagaggccagtagcatgcggcagctggacagtcaacagcaaggcaccgcgagggcggggatcacttaagctgccttgccaaactctgccaacttggttagagtcctggctggcagcagctgtatttcagggccgggccaagactgacgctgaacactgaacatgccactcacactaacatcgttctctgttctagacactgcaaagtgaatgttaattcatatttttggtaacacctgctacttgtccaaatggattaatcttattatagcacaattttttttttgagatggagtcttgctatgtcgcccaggctggaatgcactggtgccatctcacctcaatggaacctccaccttcccagtacttgggattacaggcacccaccaccacacccggctaagttttatatttttagtagagacagggtttcaccatgttggccaggctggtctcgaactcctgacctcaagtgacccacccatctcaacctccctaaactgctggcattagaggaatgagccactgcgcccagcccacgattcttttatcacatgctaattcacaagaagcaagatgaagaattttgataaatagtattgctattcatttctattaaattcatttctattcatttctattaaacgtatccaactgttttggatctaagaaacctgtccagggtggctggtatattaaagtactgattttacatagatatttaaacatttttcttatgcaggtgaagatccaaaataccactgaaatataagcctgatttgtttgtagtttttccaaggactgggtgctgttttacatgttccttgaaaaagaaaacattctaggaggcagcaatgaataaatatggaacaaacttggaaagaaaatgtgaactttatcttttgtataatttctaaatatctttaggagcagttaacccaactccacagttctaaaatgcagggctcaatttcacacatattaccccatttgtaagatcctctttcattctgaaggaaacataccagtttctccattttcattaacttgatgtcctgttgatgcagtttctcattcttgatctctaacacagctttcaggctttctaactcctgttctagatacatgatctgaggatttttctggaaaggacacagcaagatactgctcttattccacatagttcaaattcttaacagaaagaatctttgattagattgagacattagacaagtagcaagcgacagatgttcatcatcttagagcaatttcaaagaaagaggtgaaaaacaagagcaccttaatgtcgaagactggtcctaatactgaaagcaaacatttcacttatttatcagtaacttaatatgcaaaaatgtgagttgcatcaaacatgttattgtatcaagagaaaaactttgcttacatacaaaacagaatcttggctggagatgaggcaatctgtgagtcagttattggcattttctgggagaacagggaacaacagttctctcctaccaaacaaactgatcaggaaagaaaaagcagtgcattatacggctctctggaaaacaacagggataacaatgtcctgagtgtttggatttttgttatgatggggctacgttgactgggccatacttctagggcagacataatactatcattttctattgtgacaccccagtacctacacggcatggagtacacagcctatttaaatttctctccaaaaattacaagtttgccaggcatagtggcatatgcctacagtcccagctactcaggaggctgaggcgggaggatcaactgagccaggaggtcaaggctgcagtgaactgtgaatgcaccactgcattctaacctggtggcagaacaagatcctgtctcaaaaacacaaaactctccaaaataaatgctacatcaggggaggcgtcctctgagagcacaccatcagtgtggatttcccaccaccgcccacccactccttgctttattcggaaattcaactaaaccattcaaaatttatgctacagaagaacagcatatggtccactgatcagatatgtttaatgaagcaacgtcttaggtaagagtcggtggtgtggtcatcaagcttatcttccggggcattggtttctgctctggaccaatccttagggagaatccaggaaggggcctcggggattacttaatccaaaccccttacttcacacagaaagaggaaacgtgttccacgggttaagcgccctactcaggaaagatcaggaaagcttccagagctggaaagggtcagggcagggactaatacatctttaattctaggttctttagatagttccctgaggctaggagaggtatgcgtgtgtatggtgggaggtggggtggggtgggatgaggagaggttggttaatgcatacaaacatacagttagacagaaggaataggttctagtgttcaagaacatagtagggtgactatagttaataataatatattgcgtacttcaaaatagctacaagagaagatataaaatgttccaaacacaaagaaatgataatgatgacggataccctaaataccctgacttgggcattacacagtctatgattgtctcaacacatcacacgtaccccataagtacatgcaaatactaagtatcaatttttaaatttcatacattttatacagtgttacccttgtacgcaggatttttttttttttttttaccttgaaaatagcgaatcctacctcatttttgttagagggaaatggcataacttaccgtcagttttaaaattagagcatttacaagacttgtaccctctgcattttctcctcctcctctgccagcccatccctttctcccggactacagtcagacgcactctttttccgcagcctcagcatgcttacgtgacagaagcggttggatgcttctgtgttcctcactctgactctgccttagcttttcaaaagcggctgcagtagaagaatcccctttgtgtaccggaagctctttcaaacctgtttcctgagccatcaataaagtttataccctgcatatccctgcatgtaagtctagatttcttttgaaatcactgactcttcctaagaatcttctagaataaatagctttgaagtttctttgaatataagctcatctaatgttatcaaatagctagagggtctcccaatgacattatttgcagaaggtctcactgagagatccacacatgtactttctagagctggccagagatttgaagtggagaaaagctttgcttctgcagtctcagagtataaacatgaaatgaaaacagtggtactaaaggcagaagcagcaaggaaacaaatttttttcaaaaagacaaaggttggggtaaggctggggaaaaaggacaaatgtgccacaagaaatttcagcttccaagagatttgtacttttcagaattgacatttatccatacggcgaaatattattcatccataaaaagaaatgaaatactaacataggctacaccacggatgaaccttggaaactttatactaagtaaacgacgccagtcttaaaaggaccacatgttctacaatcaaccttttctattcattcctcagaataagtaaatccatagagatagaaagtagacgggggagagcctggtgctggggaatttgggggaatggggagtgactgctaatgggtccagggttccttttgggggtgataaaaatgttctagaaagaggtactggtgaccaatggacaactttatgaatatactaaaagccactgaattttacatgttaaaagagtgaacttttcctgggcaacatggtaaaatcccatctctactaaaaatacaaaaattagctggccatggtgatgcgtgcctgtaatcccagctactcgggagggtgaggcaggagactcgcttgaacccaggaggtggacgttgcagtgagccgagatcacgccactacactccagcctgagtgacagagtgagactccctctcaaaaaaaaaaaaagaaagagtgaactttgtagtttgttttatctcaatacagtgattttttttttaaataaagtcttcacataaaactctaatcctaattggtagtttccttctttttagcttagaccaccagaaacatcctggacttcatccgtatgtcagattttaggatggtaaaacaagacgccagtaagcaaagcagttgttttacacaccttagaaagcacattgccagacatgagaaggattcccaacctgtgttatttctctggctgctgagtacttgaatgactctaaaaggcaactgagaagaaaaattccatactgataaaggagcacacacaacttaccaaatttgctttttctcttgctcttcttttttgttcttctgatttcaatttttcatttaaagcatcattttcactcttcagatcattgatttgcttctaaaacacaatgaaatgtggaacttaagttaacaagaaaaccccagaaactcagcatacgtacacagaaacattaaaaccaaacaaaatcaaaaatgatatttttttttgtgggggatactgggatattgacattcacccacctctagcgattcctgcttctcagaaagtaaatcttcaagcgatttcttttctatttcatggcctttcttaatttctgggaaaataaacggatatttttgaggcaataacattctatgagatcaatgtactctaaaacagttaaagcatatagatgtaggggttgatgatgaagccgtatgacgttactttacatctatagtatgcttttatgtaaattggccatctgttctcaaaatggccttgagaggtggttagggtagacattcccattttatgactgagagccctgaggcccactgaagcccaccatggcccacagaggccatgcgaccttaggacaacactgagtgccatttcagggcaggctctcataaatgccactccagactcctggtctggaaaccctgtgctcttttcaatttgctcttcataacctaaacataagtctaaaattatactcatttctagcaggaaggaagaaaaacaatgttcactacaagtctgcctggagccagtcacttttacacattatcacctctgcctgactttgggcaactctatttttgtggtgagaaagtccttgctgaaggtcacacagccggttcttagcactcatccacgctgctctgtaagatgcaactggtttagtagaaagactgtgagcgacactgccgattctgttctgaaagcaatggcttacaccctcccactgatgacagatgaaaaatagaaaagactatttttctattcaataagtggcatcgacatttcacagcaacactgctgtgcaggagcacttggggtggatcctttactgtggattacaagatagaaacttgtacttgccacttcccagggacctaagctggcaaccaccaccgccaaaatggcctttacagtcttccaaagcccatcctatttaacacaaggctggcatttgtaactattatttgcatccttagtgggaaaaggcatctgttaacaataaaccacgcaaaaaggaaccaagaacaccccagcctgaaggccacagggcattcgctgaagcaggaagttatgaatcatttccatcttaaaacatcatgtggttccttcagattttattctgtttaaagaggaaaaaaagcatccttgcctgaaagggaggcttcataggccttctttagcaattcaagtttctctgagtggctagcttcaatttccaacttagaggtttcatgcgcagcatttaagttgtcaaactgtaagcaacaaacaaaaccgtggtttaacagtaaaaccaaatgtcctaagttgaatacgcaaagcaaccacattaggagacgtcacagcttcacaggtaagcgtgggctctagtttaaaggctcctcaacacatacaaaggtcagggcagtggttcacacttgtaacctcagcactctgggaggcagaggtggaggatcacttggagcccagcagttcaagtccagcctgggcaatgtcgcgagactctgtccccacatgtgcacacacaaagaatgcatgaagagcaacgcaactgggattcaccgctcaactctcctctgtctccttccctaccctcaggaacacagacacagaggctctccagggtgacagatggaaatggctgcatcagtcacaaggaatgaccaggaacgaggatatgtttcacagtgacagggccacatgctctgcgcctgtcacttgaccactcaggccctagcatgtgcctggcctggagtaggcactctgtagatatttactaaatgaaaaactgagttaaaaagggagctacaaaattaaaaaggtttgatattttattcagtgaaaaaaaaaatgggatatttaaacagatgccactaaaaaaaaaaaaaagaaagaaatgcaaaacaatagtttggcaacacaccaccaggatgtttacaagggattatttctgggtagaaagaaagggttgttttttcaattttatcttttcctcctccttttcttcccttctttcacttaacataatacattcctttggtcataagaaaactattcaattaaaaagatactgtttccaaggcaggcggatcacctgaggttgggagtttgagaccagcctggccaacatggtgaaaccccgtctctactaaaaatacaaaaattagctgggcatggtgatgggtgcctatagtcccagctactcaggaggttgaggaaggagaatcacttgaacccgggaggcagaggctgcagtgagccaagatcaagccactgtactccagcctccagcctgggagacagagtgggactctgtcttaaataaacaacaacaacatgctttttatacctattagactaaaaaagagaagctcatcaagatgtgaagagcaaccaggattcaagtaagcagcagaggcctcagacaagctctggctgcaaaagcacagacctgctcttgcaattgcattttgtacttctctgcttcttcaatgtaagtgtcccgaagcttttcatactccctggtgtaaaactctttaagccgattctctcgttctgttttttcagcctggtgctgctggacgaatgcttcatacactgtttgtaactcattcctggctttttctaatttctcacaggtggttgaagcagtgactgaaaacagaggagaaagaagagggaagaggtcattttatttgtgaaatgtcctatattcattacagtcacacacagctgtgatgacacctgaagcatacacccatgatgtcttgggtctctagtgaccatgtcttcaaatataacagtatggaagtgaactgtaaaaaggaacacgagggcagggcgcagtggctcacacctgtaatcccagcactttgggaggctgaggtgggggaatcacctgaggtcaggagttcaagaccggcctggtcaacatggtaaaaccctgtctatcttaaaaatacaaaaattagccgggcatggtagcaggtgcctgtaatcccagctactcgggagggtgaggcaggagaattgcttgaacccgggaggcggaggttgtagtgagccaagatcacgccactgcactatagccggggtgacagactgagactccatctcaaaaacaaacaaacaaaacccccccccaccccacattcaaaaaactgactcccaagcagtaagagaagtacttcagaagacccaggtttctaagagaagatcccctctcatgtggtgaccagtcaatgcagtggtcaagaaaagagccttggccaggcagagacatttcttaggacaagcgactcctccctctcccagccagccagtgtggtagaagctcacacaagagcaggaaagacgagggataagaaacaagtggaccggccgggcgcggtggctcacgcctgtaatcccagcactttgggaggccgaggcaggtggatcatgaggtcaggagatcgagaccacggtgaaaccctgtctctactaaaaatacaaaaaattagccgggtgtggtggtgggcgcctgtagtcccagctactcgggaagttgaggcaggagaatggcgtgaacccaggaggcggagcttccagtgagccgagattgcgccactgcactccagcctgggcgacagagtgagattctgtctcaaaaaaaaaaaaaaaaaaaaaaagaaacaagtggaccttaaacttgtagttaatttgagttgattataatttgttatttcaaaactaataaaaataaaatattagcctctattaaacgcaaatcaccagagcacaaatatcttagggaaaaaaaaacacatcttaaaagcacccacataggccaggcacggtggtttgtgctataattcaagtattttaagaagctgagaccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagagagactccgtctcaaaaaaaaaaagaagctgatgcaggagaatcatttgcacctaggagttcatgaccagcctggacaacatagggaaacccatctcttaaaattaaaaaaaaaaaaaaaaaattatccaggcatgatggtgtgggcctgtagtccctgctactgaggaggctgaggtgggaggatcacttgagctcaggagattgaggctgcaactgttgggcaacagagcaagaccctatctcaaaaaaaaaaaaaaaaaaagcaatataaaatgaaaggttaaaaaaatttatatatgtatacataggtacatatgtgcacgtatatatgcatacatatgtatgcatgcatatatgtatatatctatgtgtacatgtgtatatatgtacatatatgtatgcatatatacatgcatatacatatacatatataatacatatatacacatatatacactatatatatagacacacacacacacacacacacacacacacacacacagagtcttgctgtattgcccaggctgaagtgcaatgacacaatcttggctcactgcaacctccaactcccaggttcaagcgattctcctgcctcagcctcctcagtagctgggattacggcacatgccaccacgaccagctaatttttgtattttagtagacacatggttttaccatgttggtcaggctgttctctaactcctgacctcgtgatgcgcctgcctcggcctcccagttaatatattttaaaagggcaaagtaatctgatacacataattgaaaatcagaacatcttagctcttccctacaactaccaaaaatagaatgactaacaatataatacatggcagaacacaaccaaagatatatgtacacacactacaataaatcctagaaaatcttgaattccttaggaagcctgactttggacattcccagtcttctgtcaccgatgtgtaaatacaggcagacagggtactactgtaactgtcagggatacacatgctgtccacatccccagagtactcgtggattaatacgacagggttgctggcaaatctgttaaattaacccttacctctctttggaaaggaataacatatcaggagttgaaggaagaagattattttagggcacagaaaaggacaatttagatcaataattatttggcctaaggaacgtgaaaatggcaggttcttaggaagatttcctacaatggtgtcaacttgttatctcaggaacctgccatgtggtggtagaaatacccaagtcacttgcccccagtcagtattctttcagaggaaaaggaggccacattgaaataatggcaggaatagtgtctgccaaagagaacccttaaaaattaaatcaatctacaaatgtttattgaagggcaaagatttaacattaaaaaaaaatccccaaaacaaaaactatttctcgttgcctggcacagaatggggctctttatcttgtttaaccctcacagaggaccctcctaaacatatagataaggaaaccgccacagagaggctaaatcatctgcccaggggcacagagctggcaagcgtgagaggatgggtttcggtgagcagtctgaattctgattctgcctgcacccaaagcccgtgccccttcttttctaccaagctgtttcttgtgctggggctggcaaggcgcatgatggggcctctactggaagagacaacagacagaggagaagtggcaggaccaggccagaccttggggcccagggagtggcactcaggatagtttacgtccagtcagggtggaccaaaggtttggtcagatttttaaaacaattaaaaaataaataaataaaaactgtgatgagggctgggcacagtggctcacgcctgtaatcccagcactttggaaggccgaagcgtgcagatcatgaggtcaaaatatccagaccatcctggccaacatggtgaaaccccatctctactaaaaatacaaaattagctgggcgtggtggtgtgtgcctgtagtcccagctactcagcaggctgagtgaggcaggagaatcgcttgaacccgggaggcagaggttacagtgagccaagatcgcactaccgcactccagcctggcgacagggaaagacttcatctcaaaaacaaaaacaaaaaaactgtgatgaagcagataccaaattaaccattttaattatttttaggtgtatgattcagtggcattgaatacacttacatcgttgtgtaagctttgtcatcatccattctccagaacgtttccccccaacctgaaacttcgtaccaattaaacagtaacaacccatcccctccccttccccaaggccctggcagcgaccattttactttctttctctatgaatctgaccattcagtacctcatatacctggactcaaatagtacttgtcctgttgtgactgtttatttcatttagcgtatgtcctcaaggctcatccaagctgtgggatgtgtcacaatttccttccttttgaaggctcaatattattccattgttggccgggtgcagtggctcacgcctgtaatcccagcattttgggaggccaaggcaagcagatcgcttgagttcaggagttcgagaccagcctggccaacatggtgaaaccccatctctagtaaaaatacaaaaattagcggggcatgatggcgcacgtctgtagtcccagctactcgggaggctgaggcaggagaatcgcttgaacccaagcagtgcaggttgcagtgagccaagataacgccactgcactccagcctgggtgacagagcaagactccgtgtcaaataataataatgataatattccattgcacgtacagatgacatttgtgtatccacttaccatccacggacacttgggttgcctccacctttggctactgtgaataatgctgctatgaacaccgggggacaaatacatgcccgagtccctgctttcaattctttggtgtatatacccagaaggaattgctgactcatatggcaattctattattaattatttgaaggactatggtactcttttccatagtggttgaaccattctacattcccatcagcagtactacacacaagggttccaatttctccacatgctcaccagaacctatttgattttttcaaatatatgtaacagccatcctaatgagtacatcactgtggttatgatttggtcagtagattttcaaattaagccatatgatagaaataaaattgaggcatcaaggatgaaaatcctatcccagcatgagcaatgatgggcgacagaacggtgagccttggtgattaagaaactcacaaagcagagaagatagaacccaaaaagacagacggaggccagattacaggggccatcgcacgcaactcaagcctttgggactgaatattaaaagtttcttttctcctttaaaagaatttagtgaaagatagtgatggtcttgactgctggagaacattctctgcacattcacttttccttctattacactagtaaccacagaagaaaaaatgactcaagaagtccaatgttagtcaaacgagtaaacactgcattagcttctgccaagtaactttccgactctgaaggctcctcgtgtgaatctcgtattagaactttctatgaaaacctacaacagaaacatactttgcaagccgttggtgaaggtatcaaatagcttctagtcagagaaattctagtttcacgcaggcttttcacttgcttctcttaaaatttccggtatttccaaagttaaaaaataaaaaagcaggaacaagatctgaacccatctggaagctcatatctgggacagaaacatctaagtgaactcagggactcagcaataaacaagagactgcctccaagccctgggctagaagagcttcgaagctgacgttaatagcagactaccctggctgattttaacacatctgtttatgataaaaatactgtcgctttgaatatgtaattgtggcacatcagcctttaaaaccaaataggatacacagaagtcctttcctattagccatgggacagggctgtttccctctattcaccaaaaaaaaaaaaggcagctctgacgttttgataagtgaggtgaagagaggacacatgggaagaaacgggaaagagaaagggagaaaatgggtcagatgggggaacaggaggttcactgctgttattgtaatagtccaaagcagcaggcccagccccagacagtgacatcagcctgcagctgtgcacagacctttgctctgtttactggcccggtgtgctgctggggaacagctgggctgcagtaatcgctcacactaatggctttcgtttgaaggaagtggcctgggctgcgaaggaaacatttatttggcataaagactcatgaagtattttttaaaggatgcacatgtaaacgctgtattaaaggttctcagagtgctcctcggcagctgtgacataaacgtgtgtgtgtggcggtggggggcgtgcataaccccgattttaggccatggactttcctgtgcactgactacagcttaggagagatttatggtgccacctgtgtgtgctctcactcctatcctcagcctagtctcttcttgctcattctccagaattccactcactttcaattaatcagacaccccacaaagccaaaaccaaacataaaattgtttcgaatttgcaacaagcaagcatggacatgcgaatgtttgaaagaaggtattagacaaacacaaagtcaaagtagtctttttgtccctattttttttttttttttttttttttgagatagagtctcgcactgtcacctgggctagaatgcagtggcacgatctcggctcactgcaacctccacctcccgggttcatgcgattctcttgccacagcctcccgagtagctgggactacaggtgcacaccaccacacttggctaattttttgttttttagtagagatggggtttcactatgtgggtaagactggtctcgaacttctggcctcatgatccgcccacctcagcatcccaaagtgctggaattacaggtgtgagccactgtgcctggcctctgttgttttaatcattccattagtctattttttaaaaaagcacatatatgattaggaacaccaacagaccaccatctgtaggagaactgctgggcaacttttgtatacatgtttgtaaaccatgaaagctatctccagcaatctagcttaaaagaggaaatacagttctcaggatttaaggaaaaagagaaaaaaaaaaaaagaaaaaggaagaaaggaggaagggagggaaggggaggaaggagaagaaggaaaggaaggcaaactcatgtacaaaaacatctctaaaatgtaaggccacattgagattagaagtcagtattttcactctgcaatgaatcacccaagaagaattctaggccagtgaccctccctgacagtttaaatcatggatatctcagcaagaaaaaaaaatcgtaatcagtgaaatgctttaagttttgcttttcaagtaattatcaagatgatatgtggaaaatgcccagtgccacagtcaaacataatctctggaaaacagagctggagtcctcccaggtccttcattacttagccctgcagaactggagtggagccattacttaattagtcctcatggctttttctcagaggggaaggtcagacttttattatttccatctcacagagactcatttccctttgttgattgataaatgtactgtttacagagaaaagcattacacagccatggcccgacattgttaatattcttttgaaatgatacagtgctttcctagtttttatatctgagtagcatggttcattatgagacgaccaaaaatattttaatgctcaagaacataaataaatgtcctaataggatagagccaaaattacttgggttcaaatctcagtcacaccactcagctgctacatcacttgagcaaattacttaaactttctaagcctactttttgttttgttttgttttgttttttttgagacagaggcttcctctatcacccaggctggagtgtagtggcacaatctcagctcactgcaacctcggcctcccaggtttaagcgattctcctgcctcagccccctgagtagctgggattacaggcatgcaccaccatacccggctaatttttgtatttttagtggagacagggtttcactacgttggccaggctggtctcgaactcctgacctcaaatgatctgcctgcctcggcctcccaaagtgctgggattacaggcatgagccaccgcacctggcctaagcctacatttcttcatttttaaagtggagatattattagtcccttctctagaagatgaaatagcacaggtgaagcactcaccccagtgcctgaccacagtaactttgcagataaattgtataactgttacggcttgcaagagtccattgattccagtgtgtttgaagactcctggaagacaggcttagggttccataacagaaatataacagttaaaaagcagcattgctggcctcgtattcaaatttgatgcatatgaacacacagacgtagctattatggtggagtgtacactcacttcaagtctttcccttccgctactattgttcttgacattatacgcaatagaattttcctaatttggaggagattttatgtaaatcagaactaaaatataaaaaagaaaagtgccaggcaaattttcatagcgccacataagagaataccatagaaagaagagacgaacaggaaaaagagatgattccattcccaaactgcacacatactcctttcccagacgctctggccagcctgctgtgggtggcgactctcccccaccccaccccgaaatccccctctctgcaccatctaggatggagaagagcagcctgcctccagctctgcctgcagtgggcccctcactctctcttggccgcctgggaaaccggcctcctcctctcagttctgggctccttcacttctttcttcaacagtacatacccattacacttctcggggtaaacagaactgtcacttctcttgtgccccacccccagaagcaggaggggacactacattctaccgtaggagtgtgatgatgtcataacattctactaagggaaatccgaggaaatccgatcctgacacacgtccatggcaagcgactatgtaggtgacccccttaagccaaggtctgatctggtttgaaactggaggtagtaacatcactgaacaagtaaccaagaagtcatttttaaacatcaaattgatgctttgtggacaggcagtggcctaaagaagaaaaaaaaggtgggacccagactatcccacaaataggcatgtccagtttcctgggcctccgtgtcctgatatggaaggtaggaacaaataccacctgttctgccaacagtatagattggtgatagtaaagtgaaacagagttactcttatgctttgtagaaagtcttcccagcctgtggaataatcccctactcacatagtgccagggtttgcctctctaaagatactttgtcaaatgaccaagaaattttgcagacaagtggtagaccaggttctttttctacatttccaaattatctccaaatgcctttctgattactcctgggcattaaatcaacaaatcactaagagctcatttcaaagtcttccataaatcataaattattaggaacttgctttttacaaaaggcctgcacaatcaaatcaatcctcccataaatgccacttcacctttaaaactcagttcatactttacaaggtgctctcacatttgtttcatttaatgtaacaatgctctgaacgaataaaataggtattatcagacatctcattttaccaaagaagaatggaaataacggagctggatctacaactccagcctctttgttgttgttgtgttttgagtagatatggggtttcaccatgttggcaaggctggtctcaaactccgggcatcaagcgatctgtccacctcagcctcccaaagtgctggaattactggcttgagccactatgcccggccctagaactccagcctctttgagagcctaaccacagaacacccagcgggatctgactggctatttttcccagcctgagatgtagaagacaaagttaattcacacgtaccatggatgcctcagggtagtagggcttaattctcttgtggaagcactgctgaaaagattccaagataaggcaggtaaaaaaatgacctttccccccctatactgggtagtgctgacaaagtgtgactcacaggtgggaagacaattccacccagccagcctgtcttccatctccatcttggtgcctaggtaccagccgggcctcccctaaggttctagcctctccctgccagtgttcctcctcccacccttgaagagaagcctgcaaaggccatttgctgtttttcagctcattcactggccagcatgctgcagaacagatgcttttttttttttttttttttttttaaatcacaacagcaaacactccgtgtataaacgaacacatttaggaataaaagtgggttggaggcgagagcacagctgaatatctgacaatatgttctaagattcaggcctgagaaaaagtgaggctgactttaaaggaatcctgtttcaatcaagagtttcaatgtaaaaaaaaaaaaaaggatgattttaagtcagggactattcattctgcctcttctcctcactgacggatcatttttagagcacgagggtcaaaaaggctgctaaaagtccttggcatgtgtaaaatttaaaagcttatttataagaatggactcaattcactcggagttacttcatattattcttactatgcttgagatatgtatgtatttttttacataaaagaaacaacattctaggcagctagagcagtgtcaaagggtagtcctggggcacctacatgagaaccacctggatgatcattaaaagtgcagattcctcctcaatttccattaagggaaaggttttgctttatttttctttgcaggtagccaaagctgtactcagatattgctaataaggaagaaaaactggtctcctgttaacctgaggacactagggccagaggtcaggaagagggatcaccttccccatcaacacaacatctttttagaagtgctgcctctccttctgtaattgggaagcacctattactattccttaaagcccaaagaggggttagtaggatgatgggtataggagacgttggggtttaaaaaaaacaaagtgcagattcctggacttcatccccagccaaccaagtcagaagcaatgggcatgagaactgaggatctgcatttcaaccaggtctattttcgtacacaataaagtttgggagccactattctacacaataaggtattaaattaggaaaatcccaagttgagagactggagttaggacaaggaacaggacaaggaggaacagtcagtgggtttcaaacacaggtaccactggtaaaactgcatatctgcaggtgaaagaacatggccttttacttataaatacagccaaccaaagtccaaattgagggcagatgtggataggaagagaatgagctaagtctgaggtggctatcaactcagtcttcaaacaagtcagggagataaacagccctgttttggtgtacagttggttttcagtatattaatagatttttcattaaagcctacttcaagaaaagtcacttctggaattttacaactcaaaagtgacttacctgtaaagagtttaaaaattattttaaatacatagccttgttaaaccaaaattgtagataaaaacggaacagtgaatgaatcaacacattccatatggcgtgaggcaatgtgaagttcatagacactgggttaagtgttgattaggcaatgtgtatactgcttttggcaatgtactgttttttgcaagttactttcctcagtaagatacattttaacaatatttcttaaactcttgattagaagaaaaatattccaaaagtagctatcaatgcaaacgagcgtttatttcaaatagttttccaatcttttaaatcatttcatcaaactttccctgtggtgactaccagaagattggtggtctagccatcttgggttcttatgcaagctctttgctttccagcttcccttgggaagttacttaacctctgagccacaatttattttttataaatacaatgcagagaagtagactgagagctgaacattgtttgttagggatgagtaggcaccaaacacacgatgttgttatacctagctcataattttcatgcacaaaaatcaactggtctttttacactattataggaagggcaagcatttttagtgaattaaggattaaaatcttgtttcacaaaatagaaataatcaggactaatgtataaaaagatgagagttagctgttaattgtgatggctcaaaaataattttgaaatacaaaataatcttcattaatttagatcaagcttgtccaactcacagcctgcacgtggcccaggacagctttgaatgcggcccaacacaaatttgtaaactttcttagaacattatgagatgtgtgaatttttttcttttcgtcatcagctatttgctagtgttagtgcattttatgtgtggcactagacaattcttcttccaacgtggcccggggaagccaaaagattggacacccctgatttagatgaaaagtctgattccaaggattaacattaatgaaaagcaaaaagaactctaaagatcataatcatggccctctattgcaccagctgttattcaacatgactctggaaagaatcttatcctagaggcaaaatgtctgctgcagatgtagaccatttaactgtaatctatttccaaggctgacactttcaaaatgatctgattaactgggattgtcggacataatataaaatgtatccaagagagttacagctctcctttatgactatgcattcctaaaggacaattatcttttcttttcaagatgtggatttcattttttaattattctgactctgctttaaacttttattttaggttcaggggcacatgtgcaggtttgttatttgggtcaacttgaatcacaggggcttgttgtacagaatatttcatcaccccggtactaagcccagtacccgatagttattttttctgctcctctccctcctcccgccctccaccctcaggcaggccccagtgtctgctgttcccctctttgtgtccatatgtgtttgtcatagaaatgttaaacggtttatagaaaaacatttgtgcataaaaaacactgagtattagcatattttaagaagaaaactacctttccctagctaccactgttggtaataaaatcattcattgattgaagtctaagcacctgctaagtgccaagcacaaggtgggagaactacaaaaattaaggagctattggccttgcccttgaagagttcctaattctagatggcaagaagaggtctataaacaaatctctgtaagaacaaaatcttaaatgtgtacagggtgctttgaaaagcacactagaaggcacagttaacttacttgaaagatttgggtgaaattcaattgaagatattttagctaagacttaaaaactgagtaaaagagaaggagcatgaggggtccgcgacgggaggggagtggaaagaggagagtgcactccaggcagagaggataccgtgcaaaagatgtggacaagaggtgcaaatgaacccatggccggggcctgggaggggaaaggaggtctgaacaaaggggaaagagtgcctagacgtgaatttggactggaagatttcaatcagtcaaatcataaatggtgtgcttagtatgtctggattttttcccccaaggccaaaatagagtcttttgtgtttgttaaaaatgtccagtacaggccaggagtggtggctcaagcctataatcccaacactttgggaggccgcagcaggtggatcacctgaggtcaggagttcgagaccagcctggccaacatggtgaaacctcgtctctactaaaatacaaaaattagccggccgtggtggtgcgcacctgtattcccagctactcgggacgctgaggcaggacagtcacatgaatccaggaggtggaggttgcagtgacccaagatcatgccactgcactccagcatgggtgacagggtagaaaactccttctaaaaaacaaaaaaaacaaaatgtccagtagagacacatgtcagcctgactctaagtacagatcctggccgcaagtggagttgggggcgcaggcctggaggcaaggtgacccattgggtagctgttgcagtatcttccaggtgagaaattgtgggacttaaaacagcagcagccagaatgctgagcagggatggatccaagtggcatttaggacacagactgacatgcacgtggaggatgggggaacaggagtatgatttcagttgttagcttgggtggtaagtgaatcatatcgaccctgccaaagctgaggaacaggggtgaatgaggagacgctgcatggcgctcaggaaggaaggggctggaccatcaggaaggtctgattatactggactggctcacctgggggcagcccctcactgggaagcatctgcagcttgggaaggagagaactagaaaaataaatctgtgtcactgttgtataggtagtagcggaaaccatgggaatggatgagaaaacagctggcaatgaaacccttgctatatactatgacactatttaaggggtaagtgaacgtatgggacagccacttgacagactttcccccagcccattaaaggtgatcataatgaacactatgaggcaatgtggaaaagtgcttgacctatccagtgaaaaagatcacagcagacatctgaccaggtgccatggctcacatctgtaatcccagcactttgggaggccgagacgggcggatcacttgaggcaagtgttagagaccagcctgaccaatatggtgaatccctgtctctactaaaaatacaaaaattagcccagcatggtggtatgcacctataatcccagctattcgggaggctgaggcaggagaactgcttgaacccggaaggcagaggtcacagtgagccgagatagtgccagtgcactccagcctggcaacagagcaagaccctgtctttaaaaaaaaaagattggagcagacacttaacatacacaaatctcaaaagtattatgaaacaagccagagacaaaaaacagcatactatatctttccatttaaatgagaatctagttcagacaaaacctttgataataaaggttaaatcagtgtttgcttctagggggaggggtgttccactgtgaaatggcatgagggaatttactggattgacagaaatagtctatgcttgataaggatgtaggttttaggagtatatgtctgtcaaactgatggaataattagcattccgctgtatgaaaattacaccttaatttaaaaaatcgtagtatgaagttgtatatattcatataaactaagaaaagggaatatgcaaataaagttatgtcagggcagtggagctgccggctgttttcttttcacttaaaaatcttaattttcatacattgttctaaaaaaaaaaaaaactttaaaacttaaaatacccaaaaatatttatcgagtacccaagaaaacagaaagcatattatattatttttccataggaaacagaaaagaatccctacaattatggactttatacctgaaggtaacaagaaaacacgagacagtaaagacatcaacgtagagtatcaaaaaatcactggaccaaagggacacttttaagagtttctgcagaagcaaagaaccagtgcttccatgaagggagtgtggctcagacagtggaaacacacaggctgctttggacactgccacagtgagactgagggaacaacgggaaagtcagtggatgctgggacagctggaggctgttagatgcggaaggtggaaagcacagactctacctgggtttcagtgctcctgagtttatgaactgtcctttttctttgcagttcttagtagtttgggtaccttgtctcaactttcattgagaaggtgaagaaaaattacccaatgggagagtgacaccaactcccatcgccccacccccattattttggagggaagaagtgggtgctttgatgacggcgatagtggcagctctcttttcttgagttgctgtgatgggccaggcactacaccactgctttatatgcattactattttattcaagctccacaataacgcagcaaaatacatactgatttcatatcaccagcgaaaaaaccatactcaaagaagttaggtaacatccaactaggagtggatggacaaaaacctaggctttgactccacacaccacactctactggatcaggagaatactctgatgaggtctcatttccacttgagtttgaagagcctgtcgtttgggatttctaggaatatttagtctaatgattattcctttctgtagcatagatgatgccctcacaaaacagccagtgtggttaattactacacagctgtcaagctgcatacatcctaatacctattatttaatagcagttaacacttggtgctagatgctttacaatgcattacctcatgtaatcctcacacccacccttggggcagacaattagcatcgccatttttaccgaggatgaaattgggacagaagagatacaaagtgacttgtcctaagtcactcagttaccacaaatgtggccccggacagtgtgacaacatcagcctaaccactttactgcctcaaaatttaaaactgggttcccaactttgctatgtcaatgtcaaagttagtttcatgctgaaactaacaatcccactggcagccttgagagtgttcttcctggaccgcttcatcacaagtgtttacaggtttcgcttccctccacttacagaaccaaaacccttctccaaacggagaacggttaccatcagatgtatgcctgctgcaacagcagcaatgacacattccctaagaagccagcactgggtgactggggatctggataggccacccactgtaccaacactcgggaggcaggagaagcagtgcaccaggacagcttccttatcaaggataggaaggtgacagtgggcacagactgttacagctatttcctgtcaggctacctgactcactggaggtgctgaatccctgggccccaactgcggttgcttaattgtgctgtccactaaaatgtaaaaagagcatccttcattgaagcagagcgaatgggcacagtgttccattctcattgctgccttgtcttcggagagaggctgaaatgtgaacctctaggtaggctcacctccacttccactgggttataatgaactctgaaacacacacaaaaaggcctctttcctgatcttctaactctgttaattatgttatttaaggcatggacaaaagcaagttgggttggtcatttaggtaatcataagggctgctgtcaagttaagtaacatggcagaaagcctgcaaagtctgagagctgggctgtctctcagctgggatttccttgaactgtttcaccagaactctcaagtctttgggattctgaagtttccatctgtcttaaaattacttttccataaagaggccttcatttccacagcctaaaataaagtgaggactgatgtcttggctaggtattaagaatctggacggttagtcagggatttggcctcacctcccactggaaggggaaaagggaagatgaatgcagagaagtcttttacagagtcttgctctgttggccagactggagggcagcagcacaatgacagctcactgcagtctcgaactcctgggctcaagcaatcttcccacctcacactccagagtagctgggacaacaggcacacaccaccatgcttggctgatttttaaattattttttgtagagtcagggtcttgctatattgctcaagctggtctcaaactgctggcctcaagtgatcctcccacctcagcctcccaaagcgctgggattacaggtgtgagctaccacacccagcccagacaaagtcttgaccccacgttcactgccgtttgatttctgctgtggtgaaggtgggagaattaagagtgttcaaatccagcaaatcaggttggcagtgtggtcttgtccaaaagaaaaaagggcagtttctcctagagttgggtgaacacaatttgcttctctggatgttaccttgcattattcatacaacatacctgggcatattttggtggagactgtaacacacacagaaaactgcaaagggcaaggaaataagccctagaatggtcagctccagatctggctgaagctgaagcaggaagttgattctctaggttgaggagcccagggcagagagaagaaccccaaagcggtcagatcactccaagatacgagttgacgtagaaaagggagtgtcggctgggtgcggtggctcacacctataatcccagtactttgggaggccaaggtcaagagatggagaccctcctggccaacatggcgaaaccccatctctactaaaaatacaaaaattagctgggtgtggtggtgtgctcctgttgtcccagctactcggaaggctgaggcaggagaattgcttgaacccgggaggcggaggttgcagtgagtcgagatcgcaccactgcactccagtctggtgacagagcaagattccgtctcaaaaaaaaaagaaaaagaaacagaaaagagaaaagcaaaacaaagcaaaggcagtgtcgtgtctgttccatgaaccctaagggcttccaggagagaatggaactaaaataacagcgtagcctggaaactggagggctgggtggtgggtgttgagacctggaaactgcagggctgggtggtgggtgttgagacatgtaaactgcagggctgggtggtaggtgttgagacgtggggctccctgtggagcggggaggtggtgaaccatcagcccccctccaaatagtaagattagcatagaacgtgcctttttcagccaagttgccttcatggacagcatcctttcaacttcatactcactactcacaaaccaacccttggaagtacaacggatttactgtttatcaagaggggaaactttcactattctcatatgaaaagtgcttcagaaaaaaaaatgacaacattatttaacaggaattcacacaattacaaaaataactctgtccctctcttcagcaagagaaatattttgctcatcagaagttctgctaggcttagtcagatcagtgccaggaattctgtgaactgaaggtcaagctgccaagattcaaaagaaatgtcgatagtaagtgtttgcccagatactagacagggagtgccaacagctcccagcatgcaactccagccacaacgcagacaggacaaccacattttccagtgttccccttgtcccataaaatttaacaacaacaacaaaaagctcttacctagctctccccggaggttaacaagttcttgagatagggttttgtgttgtttcagtgcttcctcccgctgcggaaaacacacatcaagttactcatgctttcaagagggtccctttcagtaaggtacacatttgttatcactaggaaaatgagacccagtattgggaagccaagatatgaatcatttaggctaacaatttgtgttgttaaaagaaacacagttgtcccttagctgttaaggaaattcgtaattcaaaaatctgtatttttgcaggtcccagtgaaactttggtttgacgcagtgaatggcccatttagaaatatttactttgagccagtgcttcactgctgatccatagaacctttcggctaatgcatactgtacttaagatgtaatgcgttctcctcctccaagggcaataaacatctaatcagtttaagataaatatttaatgttctaaacataagcacatatatgcactttgtcctatatttgcacataaaaaagtttcgttacaatgccaatccttctaaaagaaagacaaaaagtttgttagaaagctatagcagaaagataatcctttaaagacaaaattaaattaatttttttcagctacataccattttctaaggattatgatattttggatcagtgataattctaaatcgatgttagagaaacaaaccaaagaaaaccggatggctgtttttagtatcagagaagcaagtatcaaccttgagctgaagaataatgttcaagttaccagcaactcccggcaatcacacatacacacatacttacacaaatacagtaattacatacagttccttaaaaggtagattccctagcaccagggagtaactaaaaaaaaaatgaagaatttcaaagctcgctgaaaaatgccctcacgaggatcacccaagacggagctcccaccacatcctgatcacagcgttgcagagatcatgagacccggcctttgcaggcaagagttgcttgtcattcaaagcattttccctgaattccagacagcctctgcagtagtcctgacattcttccagaaaagcactataaacaaatactaattacccttgttgctgcacatggagaatagaggcacagtttgctgctggggcagcccattttccagcttctgtctccaagtccccccacccctcgcactgtgcaagaagcatacaggtggccgcgccacccaccagtcgggtctgtctacattcaaagctctagcaggaggcgcgccattggccctcgggcgtcttacttcatgtcctgcaggttaccgtgtgcctcggattcctcactcacagaagctgatactgcagcttctgcctttggcacaggcagcctgtgattacttaaagccacagcctttcatttatgaaaaacgagaggcaggcattagactgatcgattgccatttagttaaatatcagctgcaacggaggaaagaaaaaactgaccccctctgcatggataatggagttatttttagacttgtgagcctttttcttcccctctctaattgtggtcattatttgatcacacttactaatagaaaagggaaacttgttcttcgaagcccatatactaaatgaggttatgaactaggtgaagagcaaggaaaggggcatgctgtcgtttacaaatttaaatgacattatgaaatgagaggtgtttcaaaataagtctgaagtgctgatctgagagttggagatcccatatatttttaacttttactttgttctcacctctcagtaagagctacggaagtcaagtctaaacgccagcactgaaacgtggtcagcagggactgggatttaagacccacttttcactgagtacctttctggcttcaatggtattctaaatgcttggtttttaaaaatatggcattaagttgttctgaaatcaccagtgagtcagagtttcttaaaataataagtaattggttttctaatgtagaaattaaagcctgaggaaaatcagcccgcataataatggaagaaaaacataaaaatatgtatcataaatacttctcgtaatatcaaatttaagcctgaattttgtttagtaatctacttcaagtaaacaccaggaagctttaccactcaagtaacaggaaaaacaagacagctttactaaatgcccacaaacaatcctgaaactcatttggtgaacttgcttaaaattcacttttcagtagtaaccaagttactaacagaaggaagagatggcaagaaaattcaatcatttttcaaatttatggaaactaatgggaggatgaaagaaattaaaaattacagttagtataactgcaaagaaaaattgtgtgaaatcattatgttctactgcaaaaatacaccaggtgatatttttgcttattaagggaggttttgggaaagggagtttcaccaagcatgtcgacatttccccaaacttcaactccactgcactccacgttcctgtccttaatgcctcagaaactactgacatcttccaacctctgtcaggcacagtaacagtaacaggaaaaccttgaggtcatctttcactctttgtctaaatgggttgtgcaaaagtcagttggttcttcccttgtaatgtgacaccattcccctcctccaaatgcatagaccatttacccttctaaattggttggtaacttattacttcaaactaattaactaagcatttttcatagcagatgctgtgaaaatataaaagaaatttaagacatggtccctgccttcaagaagcatggggcctacctagaactagaacatccaggctcaattcttttggtcatctatcaaggcagatgacctcatcggatgggaagcagtaatgaaaaaaaccaagggctttaaataccatccatagatgaaatgctgaccccagtgcccatactgtaaaagacacatactaagggttagtttctgcctgactctccctggtagcttggcctttacatgtacttaccctttacttgtagatgataaaatgcattatgtcctttagatactgatttactgtttctttttactcagctgctcctagatcagtgtttctctcttagatgataaactcttaaccgtctagataacaggttgattcaattctctttgtattgtaacatgcagaattacacacaatgtgaaaaaagagaaaggtggaaatctggatataaagatgcctttatgctcaggcattaaatatatgaaatgctcaagaaaaaaaaaatggattcaccataattgaattaggagtccctgggacacaggcacttagtctctggctgtggtcccatcggtgtgcctgcatttttgctagccactgagtagcatcaacagcatagagcatcttgcagagaatagccacatcagatggctcagacgtgtgctgcatctgacctcctccccatcacccacacagtgaatttgctcaatgcatctatgtttttttgttccaagtcaactttactgctagtgccattcaaaattcacctttgttcaggtgctactttaggttaaattccacttgcaaaaaaaaaaaaaaaagatgtggaggcattttgaagaattagaggtttggggagggtgacctcagccctgttcaagtttacctagaaagccacccaatagacccttttaggaagaagcttaattactaccatcaatactgttgttcactttggctgtctgtgcagaataccgtctaactaagcaaggataaaccaagaattagaaaaaaactaaaataactttagtgtgtcttctgcgaaacagagtgtgacattagttctcagattcatgagatataagaatgtctgatatgtaatgaaatatgtctgccactacagtgggaaacttatagttactaagtagacttgcaacaaaagcatggtagttgcaagattctcttaaccattttcacccataatcgaaggctctaaagccatttagaaaaggttagcaataacaaaaaatatatatacacacacacacacaaatacctatatattatacatatataaaaatacatagacatacaatgtataggtatatcatgtatataaaaaacatacataatgtatatgtatacaatgtgtatctgtatctattttatatacatatgcatgtgtgcgcgcgcgtgtgtgtgtgtgtgtgtgtgtataaacacagtatatatacttctgtaatgggaatgggaactaaaaggttaagggagtttttaaaattgtttaactttacccatgattttttttctccaactatttttattttatttatttatttatttatttatttattttttgagacagggtctcactgtcacccaggctggagtgcggtggtgcgatcttggctcactgcaacctccacctattgggttcaagcgattcgtatgcctcagtctcttgagtagctgggactacaggcacatgccaccatgcctggctaatttttgtattttttggtagagacagggtttcgccatgttggccagactggtctcaaactctggacctcaagcgatccacccgcctcagcctcccaaagtgctgggattacaggtgtgagccaccatgcctagcctccaactgttttataatagtgctcagtatacattacacaatcagtaaatatttgctgattataaaataaagagagcaaagaacatttacataagactttatgctcatcctacatctggaattccatcctctccgttcatatgttcactcacatatatactgtgttgactattaaagctgctggggtggtttcataagaaagaactagatgcagatcctgccttcagtaaatttcctgtcttaaaaagcaaaaacaagcattaaaccggtatctctaatataacacagacaatgaaagagaagcatatatgctcctggaatccagacgggaacagaacgtagatctagaaggccaggaaatcattcctgagtgggttctggactgggagtggtggatcatgcctgtaatcccagcactttggaaggccgaggcaggtggatcacttgaggtgaggactttaagaccagcctggccaacatggtgaaacctcatctctactaaaaatacaaaaattatctgggtatggtggtgggcatccgtaatcccagctactcaggaggctgagtcaggagaactggttgaacccaggtggcggaggttgcagtgagctgagattgcgccactgcactccagactgggtgacagagcaaggccactgtcgcaaaaaaaaaaaaaaaaaaaaaaaaaaaaaaaagcgggttctggagctgtattcagtgcagtcacaattccttggctgtcaggacctaaatttaagtataaggtgaaattcacacacagtacaattgtctgggaaattcactaggagcttgccatgtttgtggacaatgcatctctctgtagatccaacccagtgaatttttttcctctagcgttggatcaactctctctataactgagcacctgataaaggcctcggcttgtgtttagaggccaggttgcatgagggaaaagtatctttaaacactaagatagcagagagtatagaatgctcacgccacaagaggtgttcggggactgagcagacacatgaaggaagggtggactcctgaccttcatctcaaattgactcccgggccttcgttcactggggggaatacaaggtggacttgtgttcttcatttaatttgctttttttcttttttttttaagttggaatctcgctctgttgcccaggatggagtgtagtggtgcgatcttggctcactgccacctccacctctcaaagtaaagtgattcttctaccttagcctcccgagtagctgggactacaggcacatgccaccacacatggctaatttttgtagttttaggggagatggggttttaccatattggtcaggctggtctcgaacttctgacctcaggtgatccacccgccttggcctccccaagtgctgggattacaggtgtgagccacagcgcccggcctgcatttttcttccttcagttgtttgtgtactgaatctatgtaaattaaatgcaagtggtgatgtgatgctgctgtaaaaccgacctgaacatgtaggtattgtgggcaaggacagcaacccagtaatgatacgtgaacaatggatgacgtacaggaagtttacaggacatttttagttgatagcttcctagacctaggtttacgtcctggttctcctcttgctagctgtctgatagcaggcaaattacctaactctatgcctcaattttcatatttgtaaattccaactcgtgtctttggtgaggatttaaataaggtaagtaagaatatctggcacttagtaaatattaggctggtgcaaaagtaactgtagcttttggcatgatggcaaaaccgcaattacttttgctcaaacctagtattcaataaatccctcttgcttctcctccatctctttatgtacggctacagcatctgggcatgataataacattaaaaggggcagttgttgccaaatgataaagagccttatagtaccagttgaaaaccagactccccaaaacaaaataacatgagttacgtaattataaatttcctagtagccacgctgagaaaagttgaaaaagatgaagctaattttaataacgtattttatttaacccaaatatatatataaaataatatttcaatatattcaatataaaagttgttaatgagatattttacatcctttgttttcattctaagtttttggaatccaagtgtattgtacacttaccacacatctcaattcaacggatttacatttcgaatgctcagtctcatatggctagtggctaccacactggacacatcagctgtagataagggagaaccactggaagatttaatcagcagcgtgggatgctttggtaagaggacgctgtcagcagtgcttgggatggattataggtgagaaacagtacaagcctaatgattggttaaaaaggtgctatcacaggttgggcgcagtggctcacgcctgtaattgcagcactttgggaggccgaggtgagcggatcacctgaggtcaggagttcaagaccagcctggcccacatggtgaaaccctgtctctactagaaaattacaaaaactagtcgggcatggtggcgggtgcctgtaatcccagctattcgggaggctgaggaaggagaatcacttgaacccgggaggtggaggttgcagtgagcccagatcacgccattgcataccagtctgagtgacagagcaagactccatcccaaaaaaaaaaaaaaaaaaaaaagttgctatcatgatctagtggaagctatccagggtctgagcaaggatggcatgaatggggacagcaaagacataggaaggggaaaagcactgtgaaatgagagttcacaggacttgactgacgtcatgaggaggatgaaaggagagaaaacagttgaggatgggggctattaggctagatataataaaataaaataattggtttatttctaaacataaaaactaattgttccccacatttgatagtatacagtttctagttagcttacttggttatataaacacactcttgattcctttcttacaaatgaaagagaaacaaaaataccatatactattaccgttactaaaaccctaagtagtctccaacttcccctcaaaaaaaacaaaaacaaaaacaaaaacaaaaaaatctggagaaagctgtaaaatactcatcaagaaatcattaaggctgggcgcagtggcgcatgcctgtaatcccaggactttgggaggccgaggcagacagatcacagggtcaggagatcgagaccatcctgcctaacacagtgaaaccccgtctctactaaaaatacaaaaaactagccgggcgtggtggcgggtgcctgcagtcccagctactcgggaggctgaggcaggagaatggcatgaacccgggagatagagcttgtagtgagctgagatggcgccactgcactccagcctgggcgacagagtgagagtctgtctcaaaaaaaaagagaattcattgaaactgtctactagtctggtagtttctccaaggcacagaccaagtctcatccacttctctctctccccactccctaaaaaggcagccatattacaggggcctctgtatgaaaccaggacaggtttgttgatctgaacaaaactacagaacaaccaaactgaacagttttctttttgcttttaatttttattttttccctatgttgctcaggctggtcttgaactcctgaccacaagcgatcctccctcctcgtcttcccaaaatgctgggattccaggcatgagccacagtactgagccagtctttttttttcccctttgcattatcatgtatagccatctttaaaactgtgatttaaaaaatgtctgaagagctcaagttgtattcttatcagttgccccctgagataattacagcttttattgctatgtcagtaacatgttgatataaacttggttttctcaatgaattttagccagttcctgaaataacatccctgaagaatattagggaaaagtaacaacacggcaaatctgctttgcttttgttgcaccacagagattgttttaggaataaacagaactttcagaaagaatccccagatatgattcagggagttaactcaaaagtgctctttaatccataaatataactaacgtcatttttcaaagcattaaactaagtgtgatatgaaaagctacacacagacaaacacacaaattaagtgaaaaaaatgctaatgctagtttaggtctagaggcatacaccggcgtaagaggcaattatgttttttgctgttgccattctaaccaacagactctaggggaaaaaaaggaagtgagaaaatgtttccatcccaaattgctagagaccgactcaagtatctggtgaagtgacaaaaatgtaatgggatgaatgacacctgatctttcccatcatttacctagatattcccaaggccagcgtgtgagcaagtcctccccgtgctcccccgacctcaagtagaaaggctctttctaggatgcacctccttacctcagacagcaggtgctgaatcacaactgtcaatgcctcaaacttggtattaccacaggcaagaagctgcttgagctgcaggataaatccactttggttttcacattttgttttatattgcgtcaattcaagtgttttctcagggggcagcgcatcgggagctgtctgtggctggatacataagcttcgaggattcttttgcctgctcttttcaactgcaaaacgaattaacataggtacaaagataggtgaggttaatttttaaaatcaccaccacaaggattcaaaaacaaccagataagccacagaaatccatttaagttatgttgctgtaaggaatgcatatggatgagaactggaatgaatcggagatctagacggttggaattcatgaacagggaccgtggcttcatttatgactttaaaagatttatggggaacagagaattaggaacatgacacaaatggatttggcaacccagaaacacaaaaactgggtgcaaaatgttgttctcctcgtttctcattttccagttaaattggtagagaaaccttgactgaagagaagcctgacttttctgatctcatatgctgaaaggaacacacaaatcactggactttaaattaaatgcctttctctcctcccatacattttctacaaatcttttaccttttccctgatgatggcctagccattacacagatttataccgcagatgagtcatttcctaatctctaataaatcataacatacatcgaaaatatactcagattttgcctctttaagttcactgttaggagtactatactgttgactatactattccattttctatcgaacacaagctttgttggtcttttttcccaagtagtaataacggcttacacagtttttttttaaagcacatgctaacactccaaatccacccaaaatgccacgctaagtgattattcccttcctgtgcaatggtgccctgggtattactctgttttaaataaaaaactgttcagtcttggaaccattccaaatgtgtcattttgaatatcaaacagaattggaaaaacaggacatcaattgcttaggttcttgaaataaacaagccaagtaatccaaacaaatgtaaatctggaaaaaagacacaagaaactaaaaaaaaaaaaaagtttccttattctaacagtctttcattacagcatccacgttctgtggtagcaaatctgaaacaacttttaaagaaatttagtaattactgtctctaatttttcaggaaaaggcaagctactacagtgattgcttaaagaaacatcagtactcactttctaagaacaaatggctaaatatattgaataaactaagttaaaaacagggaaaaaaaggctcttattttctatggctgcattacatggttaaataagtcatatttgtattaatacttgataattctcagttctaaaatcactaaaatatccattgtcccactgtgtctctgtaatacttgatgagaggaagtatttatccattactctttattattagcaattattagtagtagcttatgaataattgtcacttgcatagatgtagaaaatagccaagttaatatcgtaatattacagccctgaaggaagaacaaattattagttacatactaatgaaaaataatctaaatatttgaccatgagattagcattctttcatgtcatttcctaaatgtttttagaaattgtcacataacacataacaattccacagtgtttcgctcatcacagtgtgctctcactttccctttcttttcatcctcccaataaccccagatagggaagagaaggctcacaggtgtgaatgtcttccctggatgtagacaacttctatgggaatccagattcaaagtcagaacccaggcctctgatgctaagcctcttctgttcccacacattttggaaagcggattaggtggtgatgtaatatatgacatacataaaaataaatatttatgcaacaaatgtaataatatcttgctataatacatataagcccattatctgataactcattttaacaaacctacatataaacatctatgtgttatataactttataaacaaaaatgttcaaattctttcactatctagaatttactgtaacaaatatagacacagttcattctcctgatatcatttgtatatgtcctaccgaaacttacttaaaaattcatttattgataactcctttatcatttcctgagtcctgagtaacatttgcctctctttctagaatttctatgctaatcaacgctatttttaacacaatttcagagctttaaaactgttggtttataattatttacaaaatctgagaggtgagtcttttatattaatattttggagaaaatattcttcaagattcttgctttttgcttataaatccgtaacaaaaatatcacagaatacatgtaattgtactaacaatgtttacttttgaagggaaggtaataggaatcagacagctaaaaagtatcctgaagcattttttatactttttaaccatggggtaaatatattacctattcaaaagttaaatataagaagtaaataaaatcacttttaacagacagttaaagtgaaattcgaggacatacattttttatataatacttagctatgaaggaaatagtctatgcagaatttttccttggggaaactacacaggaatctaaacattacgcagggtttgtaagtgattactcaggatagctttatgattaaggaggaaagaacacattgatgtattcgtctaagagtacgtgtcttcaaattttaaaatgagagcaaatgagccaacagactgccctctccgtggcgctggaaactcgtgctgtgcagtcaccatcttccgctccatatactgtgctccctaaggatgaagtgtgaccgcatggcagccgatgacccagtttccacatgcttcccactctcagcactcctggctcagctgaagatcagagatgatgcaaaaatctccaatgacgctcaaaaccccaaggctcatcaatacgtacttcacagtactgaaaagccaggggttcccttaaatcctgcaggattcattactaacgtgaaattagcatattatcagccaaactttgcccttacccttgcttattagcatgttactgttttgataacaaaggttttatacagaagtataaattattttgtttactgtacctattaacagaacatgttctgattttaaagggccaatttaatcagaaaccttaaaattaaacgtcaacttctatatcgattcagatttatctcaacaagataattaccaccatcagctgtgatccagccttactgggactcattctaatgaaatggcagcctccatcaggaaaacgaaggccagaaccaaagacatttgctcatttggaaagcagctggatgaccctgttggctatctttgttctttctattcagaaacctcaatttaataagatttaaaactagtgcaatgaagtcatgtatcatcttcttaaagaaagtagttggttaatgaggaagatgcccatttctcaggctcaaatcacttaggcaaatagacctccaaatcccaagaccaaaaacaattttgagagaaaaacctaaccattaagacatggactaaccgtaaccacatactagcagctgaggacacattcattctaggctgaagaagccacacatttcctcaatctgctggcttttccaattattaaaatcaagttagagaccagacctactgagggagtttgccttgggttccgtgaaacacaaactaaacacagaatttggaaacgaacgttgtccacttttgtgtatactcactgacctactcactcactcatgaaatatatttattaaaatctaccatgagggcactgctgtggtgggtgtgcacctgccctggtgctttgcggggacaggagaagtatcacataagagggtggtattgctcagagaggcacaaagacaccaaagatctctgctgactcatgtttccctagtgctcagctcttcaactccaaatctcaacctatctgtaaaaaggtgacagtcactgactggatggtaagtcctttctacaacatattgcattaaaaaccgatgtttgtgggttgacaaaacataggttatgaactcagaagctagtgagaggtctctctctgctagcggcatggacagacagaaaattcccttttttctgccttaatctaatcgtacacatctaaaagccctcacagggacactgacacagaagttctttcagtcagtttccccagcatctggtggcaggtgcttatcctgcctatgcaatcttacatacagttttttaaagttaccattcatgtcaattattagtttatgtttgtataaagttttctagtgttcattagctgtttactctaaaagagttaacagtaataatttaggagacatatatttttctatttacatataatatttttctatttctaggtagacatggcatttactgaaaatggaaaattttaagctcagcaaagcacagtgtttagacatttagaattacccaagccaggccgggtgcggtggctcacacctgtaatcccaacattttgggaggccaaggcgggcagatcacaaagtcacgtgattgagaccattctggctaacacagtgaaaccccatctcgactaaaaatacaaaaagttagctgggtgtggtggcacctgcctgtactcccagctactcgggaggctgaggcaggagaatcacttgaatccgggaggtggaagttccagtgagccgagatcacgccactgcactccagcctgggtgacagagcaagactccgttctcaaaaacaaacaaacaaacaaacaaaaaaccccaagccaagcccaattatttgtagggggagggaggaggatttaggatgcctcaccatttaaacttttcattactatattggtagaattcgttgcaatagctcatattatatcaaaaagggttctacttcttttcttcacattaaaagcagattagagaatagaaagcatattcgagaatagaaagcatattcatataaaaaattcctgtttgggttaattacgcttataaaatttttcctgaagcaacagtccaaacttgccctaaactattttccatatagctggcaggaaaaaaccaaatttctcatactcttatgtacctaaaatggactcctaactcaaagaagagttaatataaattcaccacattcagaagtacttttaagaaggcattgcctctctcctatagcaaccaaaaaagcatggcactggtctaaaaatagacacatagatcagtggaagagaacagagaacccagaaataaagccacatgcttacagctaattgatctttgacaaagtcagcaaaaatacatacaatggggaaaggacaccctattcaataaatggtgctgggaaaattggaacagagaaactggagacctatctcttatcatatgcaaaaattaagacagatttaagacttaaacgtaagacctgaaaaaataaaaattcctgggtggggggagggaactagaaaaaactcttcacaacattggccgacgcaaggaattcatgactaagatctcaaaagcaaatgcagcaaaaacaaaaatagacaaatgggacttaaactaaaaaggttctgcacagtaaaagaaacagtcaacagaggaaacagacaacctatagaatgggagaaaatatttgcaaactatgcatttgacaaagatctaatattcagaatttacaaggaacgctagcaactagcaagaaaaaatacaaccccaataaaaaatgggcaaaggacatgaacagatgtttctcaaaagaagacacagaagcagccaacatatggaaaaagtagaacatacgaaaaaatgctcaacatcactaatcatcagagaaatgcaaatgaaaaccacgatgagataccatttcctatcagccagaacggctattaccaaaaagtcaaaaaaccacagatgttggcaaagatgtggagagaaggcaatgcttatacactgttggtgggactgtgaattagtacaatctctatggaaaacagtatggagattcctcaaagaactaaaaatagaactaccattcacccagcaatcccactgctgggtatcttcccaaaggaaaagaaaaacacagactatcttataacagaaatgaaaattaaaatagccaattaaaacattaaacattagaaatatttacaatacaaacaataaataaaaagagaacatcattctcaaaatactaaactgtcgacaagcaatttggaagaaacgtgcctaggactcaggtcaccagggagaaaaaaggcaaatctctcaccccaaaagaaagctctattactcttaattttccacagagccacataattgctgatgtttataaaaaggaccctcgtgtactaaaatgacccaaagtattgcctaagataaatacagaaatatgatattcaatattagatacctctaaaatcacacctgttgtgtttctaagaaaataatatgcatatactattaataaaatattattcttagctctgaaagaggctttaaagctcataaaaagcatcattacattaatttatagggtaattatctattaattaaccagaataaattgttctaacaaaacaagtatttacttatatacagcttgccatattcctccagtgtctcttgatgaaaaacactgctatccttcccattctgaatgcaactctaaaccgtaatttattacttactttccatttttgtgtaaaagtagatactacattaaaacataatttagtgtagtaaaactctagttatctgaaacttgtcaaattaggacatactgtccctttcaacatctcacttttaaaaacttatcaaaatcttacctattgtgagcaaaacttgccattcaacactttattgtcttcttcaattgaaagctgtaactacaaaagggcagatattcatgtcacggcaaagctacagctctaaaaccgccacagctaccgaagcttggaatcaatccacgacaaaacgttttcagcatcatgccattcatcacaccagttcttagcaaatgcttgtctatgtggcaagaggccagcaaaatctttcatgactgctttcaaggaggctgaaaggaagaatctggattcacagtaagataactaaggggcagtgaaagactacatctctcgttcttcttcaccttggtccttttgatttcttctacattctacaaatccctgaattttaccttttcacacgcaaatgctaatatatgtgtttttttttaatggaagctttctaatatggcttcattgacgtctacattttgtagtacgaaaaacacaagagaaattgaagtttacttactgtcaccttaacagtacatgaataaatgccctcctaatccataacacatccataaatgcgctaataacatattaagcatacaaaagccacatttaaagttgaacacattcttcccaatgtattttataactgaaaattcattcaagagatcaaaaatcaaatgttaagacttacgtccaaacgacaaaataacttgaaagtttaatggaaccattacacacaggtaatcaatgcccctccaaaacgcatagaatagagaaaaaatagcaaggcctgttgcaagatccaacttgttaaataatacactcccctcatttataatcggccaacatccgcttgagaaatacctgttctgccttctctgtggcagatattccaatagagctcttataacattttatacctgtctgtgggacagagactagagaagtcacacgctctatttcccagcctcccttccaggtcgagtcatgtgactaagacccggccaatgagacggaagcttaagcgacctggcaccaccccttcctcatttctttttcttccttcctggagcagctactgtgagatcatgaggcaacaatcatgaggacacggctaagaagacagcagagatgaggattcctgacacggcagagccaccgaacaacctcaaagctgcttttcttcaggtgagacaagttgcttcttagtgaagctgttaattccatctaaaaagagtcaaaagtgaataccaaatgcgagaacataatttgatgaatttcatcctaattaaacaaacgcattcacattctgcctgcctgttactgaacacttctttaaaacggttctcttcacgaacacaaagaagggaaacaacagatgggggtctaattgagggtgcagggtaggaggagggagaggagcagaaaacaataacttgggtgctgggcttaatacttgggtgatgaaatcatctgtacaataaactatttattgtacaagaatctgtacaataaactctgtgacatgagtttacctatataacaaacctttacatgtacccctgaacctaaaagttcaaaataaaataaaatggcaaaagtaaatggaaatattttgttctgatactacctctgccatccctcgatacgtacgtacacatgttcctcccttgcgctgcagtaatcacttttaatgtcactagctcagcagaaagaattctgtctttagcgtactgaattgccttcactggagtcaagaaggaaattaacctgtgaggttcaaatggcactcttcatagcaattaatacaagaatttccagcttcatagaaaaactgaatgctaagtggcagggaatatttcttagcaaagtcttttccctccactaactcattataaaaatagaactaatatgttgaggtagaattccgaaatagaccgagtttaatactttggtaaaaagactattgctgacccttctccatgtcagtgacgtcatcactggacttcttagattttcatctgtgcctaatgtcctgcaacatcacgcacagttcctgacaaattcactcttttcctcctctcccctgtttaaagaggaaagataacctcgatccaacaacacgctttgccagtgatggataccacccagtaataatatatcagagtgcccagtgccctctgcgtgggatcaatgagaaagcttattctggccggatctctacaatgaccagcccccgtcccaccacattctatgctcagaaatactacaactcctttgtttccttgaaggagcccttcctcaagcccctcaaggtttttacatgctgttttctctgtcggaaacactttgtttcttagtaaattctccatttcctgaggacccaacttaaaaggcacttctactggaggacctggattaaaggtacctccacctgctgagagctgcttgggcacaagtccacaccctgcattattaactggtgctctgtctccttctgttaaacagtgggctgtgtgaaggcagggtccatgtgggacttagtcccagtcatactttcagcacctaccattatgcctggtacacagtactcatctaacgggtacttctttatgaaacgaatgaattaatctgtaatgtgaaagacagtctagaagcaagggaaaggctggaggcacagaccaaatactaagctcttcagaaagcccagtcaacatcttaggctggattatacaaaactgttcctatttggctacttttgacttattatacaaaagtgttcatatttggccactttttacctattaattttttgtgtgtggttttttaaatagagacagggtctcattaactctccagggctggtctcaaactcctagccttaagtgattctcttcccttggcctcccaaagtactgggattataggtgtgagccagtggcaccagccaggaagagcagtttcaatgcttcaacatgataatgcctggactagggtaatggcaggtggtaaaaacaaatcaagatttcaaatgatggagtcttagagttttcaaccaattgattgtggataaatcaggacaagtaatgattcaaaggtgaggtttggccagacgtggtagctcatgtctgtaatcccagcactttgggaggctgaggcaggcgaattgcctgaggtcaggagttccagaccagtatggccaacatggtgaaaccccatctctattaaaaatacaaagaaattagccgggtatggtggtgggcacctgtaatcccagctactcgggaggctgaggcagcagaattgcttgaacctgggaggcggaggttgcagtgggcccagacagcaccagtgcactccagcctaggcaacagagcgagactccatctaaaacaaagcaacaaaaaaacaacaaaaaccaaaggtggggtttgatgaccagacacatggtgtcatgaaaagaaacagataattcatgagtattaactgaatttaggaggtaaaaaaataaggagacaaatcatttagataagatgaatttccaagcagagtaatacactgagggttttcaaatcttcagccagaaattcacagatttggaggctaaggggaacctggaagtcatctcttgtggttcccttattttgtagccgtgtgaggttaggtgcacagggctattcacttggtcaccagcagaatcaaggctacaatccaggcctcttgggatccaggtcaacaccactgcactgaggcaaccaacaccacttccttcactaaggataccaacccaagttactgctgacagtccattcagataagagtcaccatgacggcatgaattacccacttgacggacgatttctcggacgttaaaatgacataacatggataagcccatcaaagactgatattgggagtaagcagaattatattccttacatgattttaaaaagcctccaacacacaaaacgcttcctccatccctgctattccttggatctaacaaaattacagcaaaatttgcagctggaaaatatgtacgccaaaaattctaaatagaagtcccaggttttagtcctatctctggcacttactgtgtgcctctgggcaagcgaattcacttctctgggcctcagacttcctggtataagacagattagatcacctctatgtgaactctagctcaaaaaattatgactgcaaataaacagaaaatagttttacgtaagtttagaaaataaaatgtgtccaatacatcactatcaactaaaccctggtaatagaagccttgtgtcgtttgcttacgctgtcttggaaagctatctgcttcacaacaacactacagacaacttagaatgtctactactagagcactggttaagtaaatcatgacttacccaataatggaatgttacagaactattttttttaatgaggtagataaacatgtgatcacatgcaaatctaaaacacattaactttaaaaaggtatagaatatatagtacgcttttatttctgtataacaaaaaagaataaaaaagacctgcatagatttacatgtgactggaaacgtgcaagaacactatgcaagcagctgagagcggctgtctccacggagagcagacagggactctgggtaagagagaggcttgcctaggactgcacaaccttccatactgtttgatttttaacttggagcgtggattacagtatttttaaaagaactctttaaaattaaaagctatttggagctactttagatcagacaaattattgcaaatatagggcaccctttgttatttttcccccctattaatttgttcagttggaagggctgcagcggccctgagctgggagaggagggccactgctgacctcctcctcgctgcctccccccatttaccgtcagctcagactgaaagggagaggctggcaaaatcaaatgacaggtcaaggggagttatgaaacacgagagagaggtgctggaaaaaatgagaattctcccacagagaagggagatgcctctgggaaaactaaaaatagtcagctgaaaacaaatcaccagggacagagatgagccacgtggaaaataagaaacacgaggggtcacgtgcacatgaagcagaaacaaaaatctatttacatcctcatcaaacattcctgtgacacctaacgctattcagcccaaaacaaatataaaaacaccccagctaacatattttacagaataaaactgatttaatttactgtagctgtaaaatcatctaggacaaaagtagcaacataggccaacccaatgccctaaaagtgagcagacaggtcaccacgtgcctaaaatatatactaaatttattttcatcttaggcaccgaaaataataagcagatacaaacataaacctcaggggaagtattttgagactgcacacacttttattatgaagattggaaaactagatttgtgattcacttactacttccccataaccattaggatgttttctgtcagaagtgtttagtatacagaaatcttttagcatattaaaattaactgtcaaatctgactgagaaactatccaatgaaaaacgatgggaaccttctcatctacacaggcgaacaggaaatattcttctaaatttacctgtgtcctatttcccaaacactggaactaaaatataatttaacaggtgctgattttcacacatttggctggtgatggagaaaagagctagggaacaccaaggcaacaattctgccttccatcaacacaaacaacacaatctgctgccaaaagtaaaagtactatgcacttgtgctgaagcaacagaaaacaatttttaaattaagcctcatctctcattagagagagcttttttcctccaattatctgtctccttggaaaaacctctgataaacatctgcaaattaatgaagacatcccccgtgcaacactaaacagagatctatgcgagacagacctgtgtggaaaacaacagtgcttctcctaaaccctgaaggaagtcgaaggtttcgaagcaatcctttggccgtcagtcgtatgtgaatggtggataaggagaatttgggagacaacaacatgtcttcggagcaggtggcgagatttcacagaagaggcaatttccatggactgtcacatactgtctttttaaactcagtactcttcaaggccaagaaatacagtcagaggaaagatgcctacacagcaaatgtcattccaccagagaggcatagaagaaaaaaatcccccagggctggccaagtgtttctggcttccgttttcactttcagatgttgccaaaatgatgctcttcctctgaatacaatctccctcctgcaggtctagaagctgcctctgaaccacatcacactgtgcatgcttgtggagttgttatggttttcatccgagatggtaaaggggaggagaaagtgggtggtctcaggagctttacagaacaaccaataatgtcacagatcctgtaaccacttgaaagatcgctaggggaaattaactacttcaagtgcctaatgtttctttcataattagaaaaaaattaggatttcctgaaagtaaactgtgtcctgattttaacatttttcactccttatattcacaatgataacatgagcattttttctctagatattttacatgtaaactacatttaaacctggtattttggaaaagttttttttttaaagacttcaggcaataaatgttctcaactacaatatttaagaaaatttctattctaatatattaatgacagattgtcaaaaggttaaagttcaactttaattcccacatgctgaggacctcacaaataatcaacagtaaaagattaatacggtttctctatcagatgtaatatcagagttccagaagaatagtccatcagataggcatattctaaagactacatttattgcatgagtaattgcatttatagaacatcatgtggtctcttatagtggtctttcaagactaggagtgtgaggagggcacagttatgaatatcttttgccagttatctactaatttttatttcagtagagtggcttgtaaaagtatgttaaaacatgatagcaaaaccaaaagaacttgaaaaacaaagatatggttataagaattaacaacaacaatatgcccacttaagctaattccattaaaccacgaatagcctgagctcttaacatttttaaaaatgttataaacaaaacaatgttttaaaaatgtcctatgcctgtttccaagatttcctagaaaataagactcagaaataaatgcagaattgttaccataaataacactattaagtgctattaaaactagcaggaagcagttcttttagaaattctatagagtagggtatgaagcagggaagagagagggaggaagagaaaatttaaataagttctcttccctcaagccccctccctcttcactcaagcccccaacttgccattttagaggttgtcagcaagagagacagacccaataacctgtccagggttcctgtgagaaagatacacctagttcatacactgacgaaaaacctgctacatacattgcaccacagcaactgaagctaaatgatcaaggaattaaaatcaaggccagctgcttctaggtgttgccttttacttcatcccagtttattattaaaaaacctgaacaccttttccttccagattctacatactaaaaatataccagaaccttttcctctacctcccaaaaccttgtaaaaaccaagaaaccaatcagcattaaaaacaaacagaagaacagagtcaaattttgccatgattaaaaacagacatgccaccactccatatagtaggaggtggtttttctttcttttggttgtgtttgttgtttcttcagtaacagcaaattctaaattatccttttttgtttgtttttgtttgttttttgagatggagtttcactcttgttgcccaggctggagtgtaatggcgcagtctctgctcactgcaatctctgcctcccgggttcaagtgattctcctgcctcagcctccgtagatgggattacaggtgcccgccaccatgcctggctaatttttgtatttttagtagagatgagttttcaccatgttggccaggctcgtctcgaactcctgacctcaggtgatccacacacctcggcctcccaagtgctgggattacaggggtgagccaccacgcccagccttaaattatccttgttaaaagggaagttctttagactccctaaaagaagaaattaccatctaatcatcgattaatcagattcattaacatttttacttgaattacattaagctataaccacacatattgaaaataaacattgttaatgatatctcttaacagcagagcaagaagctgcaggaataaactaaattcagttctttcccaaacatagtctgcctcctggtggccgtgcagcacaagtgcaccaaagcaagggagctgccttggcagtccataaacaaatggccatcgcttacaatctactgctccaagcactctcttacacactttacgtttgctcatttaaataactggataagcaattactttcaggtcacaactatttttatactatatatgcctctggggggagccaagataaaaaattggttccaaaaaattctttgattatttgatcatctgttaccagttaggaactccatattttctgaaattgaacgaatgtgagaagtacctaaaaaaagcatctttgttatttttaaaagtcttaatttaagaggaaaagataggcatcaccaaggacagtagaggaaaaaataaggaaattttagtgcctaaagtacaacagtttgtagttgtaaaagttagctatgagtctttatgggccgggcgcggtggtgagattacatgcctgtaatctcagcactttgggaggccaaggcaggtgggatcacctgaggtcagaagttcaagaccagcctggccaacatggtgaaaccccgtctctactaaaaacacaaaaaattagctgggcatggtgacaggggcctgtaatcccagctactcaggaagctgaggcaggagaaccgcttgaatctgggagatggaggttgcaatcagcagagattgtgccattgcactccagcctgggcaataagagcaaaactcctcaaaaaaaaaaaaaagatgagtctttatgaagcagagcctgtgttaggatgtcagtggaaaacaaaaacatgatttaaaattttatgcaatgtaggatctcaacattaaacaaaaacgattaagtatattggagcaaacatgccagaatgtcaccaatgctctgggaggtagaagagggaggatttctattttttctttattatatgtttttgtattttcctaattttttttttcaaaaatcatgcagccagaaaaaaattaaaaagtttaagtgttagaataattttatagaaagcctacaaaatgagccgagttttcataatgacacaaagaaaaataaacgatgtgtaaagtctatactaaggcttaaataacaaaagaggatgatacagaatgtttcataagtcagtatgttgtaatatcacagtatattcaaacaaacagaaattccactggtctgcatagaaatgtgtttttttaaatcagtgatttagaaaacaatgatgtcatgattctagacaagaatctagcataatctgtatggggtgcttagatgctacaaaatgccttcaatttatctgttattgtttgttgttgttaatgatcataaagaatgaggaagaagattaaaatttaaaccaagtgacttgtgtggagattcaagcatctctatccaaccaatcttccttagcctaatatggaatattaatctttatatttatctccttactttccctaacacagcattaattgcaacattttcttcattttactcctcacagtctttaatgtagtaagttcaattctctattccagttgtagaaacttcaacttaaggcccaatttttccacactatcctcttcctcagtacgaagataaattgtaattatcaaaaaattaacacaaagcaattagaaaaacaatcaacttccacccacctgtaagatgataagctctcaaagaacagtgacattgccttttattttgcaataagcaaaataagagtttaaattaaaagcagtaatgcttttaattcatgtacaatgtttgtttttaaaaaacaaaacctcatatgttcatcgtagaattttttttttgagacggaacctcggtctgtcgccaaggctggagtgcagtggcgtgatctcggctcactgcaagctccacctctcgggttcaagtgattctcctgcctcagcctcctgagtagctgggactacaggcgcccgccaccacgcctgactaattttttttgtatttttagtagagacagggtttcaccgtgttagccaggatggtctcaatctcctgaccttgtgatccacctgctttggcctcccaaagtgctgggattacaagcgtgagccaccgcacccggccagaattttcttttcaatttaaattacttacacatcagactgctctccaatttgtttttaaacttaacataagcttaataaacttattaaacttaaaaatttcacacttatctttccatgggattaaataagcatttatattgttattttaatggcttcaaaaatgtctttaaaatgtcaacgaacttaattcctgtaaggtatataggttgtttccaattttcccccattgtaaacaattctgaaaagcagtcaataagtaaataaattactttcctaggaccaattctgaaaaacagaattcccgggtggaaggtgtttgctctctgctacagctgctgtaatttaccaaggagctgtacatatgagtgctgtttcttattcttcgccagtaccaggtgctaacattaagaaataagcaagaactgagagcacattattttaactcatatttggtaaacatttttcatatattccttagtccttcatatatttcttttctgtccatccacttatttttccctttctttttgtttagtttttttaattgtggcaagaacacttaatgagatctaccttctcaacaaaattttaaaagaacaatataatattgttaactgtaggcacaatgctgtaacaaacatctcgaaaaccttttcgcccttgcataacaaaccttgtaccattgaacatcaagttcccattccctggcaaccaccactctactctgtttctgactttgactatgttagatgcctcctataagtggaatcatacagtatttgccccatgactggtttatttcacttagcatagtgtcctccagctttatctgtatcacagcatatggcaggactttcttctttttaaaggctgcataatactccagtgcacatatatgccatatttgctttatcctatggacacatttaggttgttcccacatcctggctatcataatgtggcaatgaccattgttgcagggagtcagggaccccgaatggagggaccggctggagccacggcagaggaaacataaattgtgacgatttcatggacatttatcacttctctaaaaatactcttataatttcttacgcctgtcctactttaatctcttaatcctgttatctttgtaagctgaggatgtacgtcacctcaggaccctgtgatgattgcattaactgaacaatctgattgcaaaatgtttatttgaacaatatgaaatcagtgcaccttgaaaatgaacacaataacagtgattttagggaacaagggaagacaaccataaggtctgactgcctgcgcggtcgggcagaatacagccatatttttcttcttgcagagagcctataaatggacgtgcgagtaggagagatatcgttaaattcttttcctagcaaggaatataatattaagaccctaggaaaagaattgcattcctgggggtaggtctataaacggccgctctgggagtgtctgtcctatgcggtggagatagcttggccgggtgcggtggctcacgcctgtgatcgcagcactttgggaggctgtggcgggcagatcacgaggtcaggagatcgagaccatcctggttaacatggtgaaaccccgtctctactagaaatgtaaaaactttgcctagcgtggtggtgcgcacctgtagtcccagttagtagtcccaggcaggagaatggcgtgaacctgggaggcagagcttgcagtgagccgagatcgcgccactgcaccgcagcctgggtgacagagccagactctgtctcaaaaaaaaaaaaaaaaggactgagagagatacgccctggtctcctagtctcctgcagtaccctcaggcttactaggattgggaaacaccaaccctggtaaatttgaggtcagaccggttctctgctctcaaatcctgttttctgtaaagatatttatcaagacaatacgtgcactgctgaacatagacccttatcaggagtttctgattttgctctggtcctgtttcctcagaagcatgtaatctttgctctgcctttttccctttgaggcatgtgatctttgtgacgtactccctgttcatacaccctctccccttttcaaatccctaataaaatcttgctggtttcgcggcttaggtggacatcacggacctaccaatatgatgtcacccctggaggcccagctgtaaaattcctctctttgtactctttctctttatttctcagaccggccaacacttacaggaaacaaaaataacctacattgaaatattgggggcgacagaccatgggaatgcaagtatctcttcaacatcctgatttcaattattttggtaaataacgccttatcagacgtatggtttgcaaatgttttctcctatctcataggctgccttttcatgctattaaatgactgctttgctctgcagatttttaatctgatgtactccaacctgtctatttttgcttttgttacctgggcttttggtgtcataccaagaaaaatgacatgaagttttgccccatgttttgtttgaggtgttttatagtttcagatcttatatttaagtctttaatccatctcgagttgatttttgtgtactgtgtgagataagggtccaatttcattattttgcttgtggatgtccagttttcccagtactatctacaaaaagactatcctttccctattgtgtattcttggcacacttgctgaagattagctaaccgtatatgcacggatttatttctagactattttattccatcggtctatgtttctatatttgtgccagtaccatactcttttaattactgtgtgttgtaatatactttaaaatcaggaactgtgatgcctccagctttgttctttgtcaagattgttttggctatttgcagtcctctgtcattctatatgacttttgggattgttttttctatttctttaaaaaaatgacactgggattttgatagggattgcactgaatctgtagatctctttgggtggtatgtccatttagcttctattatagagttgtctttatcttgctgatttgacagagctctacacagagtatgtgctaatataacctcagtttgttctttgcttataaatactgtttctaatgatttttattctttttattttttttgagacggagtcttgctctgtcacccaggctggagtgcggtggtgcaatctcagctcactgcaacctctgcctcctgggttcaacgattcttctgcctcagcctcatgagtgctgggactacaagtgtgcacaaccacgtgcagctaatttttttgtatttttggtagagatggggtctcagtacgttgcccaagctggtcttgaactcctggcctcaagcaatccacctgtcttggccccccaaagtgttgggattacaggcgtgagccaccatgcacagcctgtttctaaggttttttaaagcttttgttgtcctaattattaatcgtttctattatactagtgttcctggaaagatcttttctacttaagtctatattcttagtgttttaattactttgtgtgtttaaaactaatttatctgaaatactttgtatatatgtgaaaaagatctagctcctgctaaaaaggtagtcactgtctcaagaagatttactaaatgatccactcctcacaacccccaacaccaatttgaaacaaaaatgtatcccatatgaaaagagcatctgtgttttaagtatagggggaaagttatgttaatcataaaacaacagtgaaaaaacagccttctctctactctcaccagaagaaaccctggcagcctcggcatcacctcatcagcaggtttgcaacttgcaaccacttcccagcacttggcaaaagaaggcaagaaagccgccctgttctcctgtgatgtctttactaagtaactgcggaaggaccagtgcattttctaccttccaaggcagacactctggcacctgagagtgatgatcttgtgtaaaccaatcagggtactggataaatacagctctgatgcctctggtatgccagtggctttagtgtatggtagaaccaaggtaataatagtattctgtggtatgtgtgacatcttccttatcagcagtaagccaagattttttttagagtcaatatcaactacaatcttgcagcgtcataacgtttaaataaattacaacagttagaccccaagaggttggttcttgactttaagcagtctttcctgcttgctttagagatttaaaataattcaacttcctggaaaagaaccctaaaaataagcccctagaattataaaaacaatgtaaaagatcgccatcattaccgttcctagcagctgacttaactattatttgagaaccttttataaaacaattctatgatgtcatattattgcctttctgggaattatttccccaatattcccatgtctccaaacgagaaatttgagacttggagaggcttagcaactagcccaaggtcaggacacaaatagaaagcagcaggacgaaggtttaaaccaacatcccgtgccttaaaagttcgttctcctcctgcttttctacattgtcttatgagataatgtaatttctttaattgataaaggtcaagctaaaacaatgatgtaacattttaaactattatgttagtcaaaaaaatttaaaaataatatccaatgttgacccaaggtatgatgaagccaggtgtcttttatgtcaaccacggtataaaatgatatgaagcttttggaaaacaatttggctatttgagtgaagtgactgtaaatgggtacatattgtgatttcctgatactacttttaataatctatcacaagaaattgaaagttgaaagtgctaattgtatagatgttcatcatagaatcatttatgaatgtgatacagaagcaccctaaatattcaaaagtagttaaatgttactgtatctgctaaatgtaaaagtgattactatatgttaaatgacaaagcaggatatacacttatctaaatttcatttaaaacgacaaattttaaaaagctgaagggtgatttctaaactacatgctaaactttttgaagtttggcaaactgctataattaaaagtgattattttactagaactaaggaatatgaagttggtcaactcaactgtaatctccaccactacttacagctttaaaataaaaatatctcaaagccatagtacaacgattaaaaatttacactcagaggaacatgtttatgtgtggaggcaatgtcttctgtatcagctaaaatatgactcatttccagcagaatatgaaaaaagtcaaggtgattttcagtcacagaatatcacagtagggagaaatctagaaatccaccctttcagttacatagaaaactattatcaaagaggttcaatgatccacccaaagtcactggcttttcagcatcatttttcagcatcaaagtcgtctttccaaagcaaacacactttgttgtggtcctctgtccacacagtaacttttcctcactaggctcctcataataccaggttagtcttaagtcatgataataactaaccatcgagaagaacctgggaaagtcatgcttatggtttcgggaaaatacagaggcctaccacacaatctagattaagctgcaatgttgaccccttagaatacattctatatatacagagtcatctatagattcaatgtaacagaaattattagaattggaattattagattacattcctaaaacctcacctgacttcattacagagattgacaagctgatcctaaaattcatacagaaaatcaagggacccagaatagccataactatcttgaaaaagaaagacgttgaatgactcacatcctgatttcaaaacttactaatcaagacagtgtagcactggcaaaggtaacatataaatgcaaagaacacaatttagaaatcagaaataaaccctcacattcttaaccaattatttttaacaaaggtgccaaggcatttaaatgggggaaatacatgtcttcaacacctggatgtccatgtgcaaaaaagaattagaccttctatctcataccatataaaaatgtaactcaaaatgaatcagaaacctaactataacagctagaatagcaaaaaaaacttaaatgaaaacacaggcttaaatcttcacaaccttggattaggcaactgtttctgagatacaataccaaaagcagaagcaacaaaagaaaaaaagttgataaagtggaccttgtcaaaatttaaaacgtttatgtttccaaggacattatcaagaaagtgaaaacacacccaagaattgggagaaaatatttgcaaatgataactctgacaagggtctaatatcagactatacaagaactcctacaattcaacaataaaaatgacccagtttaaaactggcaaatgatttgaatagacacttctccaaagaagatatacaaatggccagtaagcacacgaaatgacactcaatgtcactggctgtcagaatgcaaattgaaacaacaatgaggtatcacttcatacccagtagggatagctataataaaaaagacagacaaagccaagtgttgacaaggctgtggagaaacaggattcttcatacactcctggtgaggatataaagtggtccagccactttggaaaacagcctggaggtttcttaaactgttaaacacagagctaccaattgagccagttttctgataatggttaactaatttttaaacaaagccattccatagaatattagctatcttttttccccagatattaggatgtaccagaaacttaaaaggaaataaaagcctaaatgtgtacagcagagtttcttctgcatttttaccctataaaggctttagtaaccacatatattcacactcagcatcctggggatctttagaacttagatcattctgcatggctgtcttcctagctttaagagcctacaaaaggttacgaattctgagatagctgggcgcagtgactcacgcctgtaatcccagcactttcggaggccgaggcgggcggatcacgaggtcagaagatcgagaccatcctggctaacacggtgaaaccccatctctagtaaaaatacaaaaaattagccgggcatggtggcaggcgtctgtagtcccagctacgcgggaggctaaggcaggagaacggcgtgaaccagggaggcagagcttgcagtgagcagacatcgcgccactgcactccagcctgggcgacagagcaagactctgcctcaaaaaaaaaaaaagaaaaagaattctgagataatttccccacacttccctgcttattacactgaggaaactgaatacacctgatggggcatcaaggatatttgttattcatgttattcatgatgtaatgttatcccaccctgttttctttacacaacaggctcagaaatttatacctcttgcccaggtttccctcacatgacagccttcaatccggacctctcttctaggacaagacaaccctccttcctagaactcagtgcatttgtgattcatgtctatttgagcaggttttttattttatttttttaactatcctattagctctccagagacaaggcccctgctcattcttcgctcaggactgcatccttaacacctgacactcacaatgtgtgaacaaactgtagtcaacattctgtaacattacatgcatacctgggagatatatatcaccccataagacacatgacataataaggcaaatcacaaaaattgtctggtttctcagtgcatataaaacttatattaacactacactatagtctagtgtgcaacagcattatgtctaaaaaaatatataccttaatttgccaggcgtggtggctcacacctgtaatcccatcagtttgggaggccgaggcaggtggatcatgaagtcaggagatggagaccatctggctaacacggtgaaaccccgtctctactaaaaatacaaaaaattagccgggcatggtggcgagcacctgtagtcccagctactcgggaggctgaggcaggagaatggcgtgaacccgggaggcagagcttgcagcgagcagagatcatgccactgcactccagcctgggcgacagagcaagactctgtctcaaaaaaaaaaaacaccttaatttaaaaatatttcattgctaaaaaatgctaaagatcatctgagccttcagtgagcaggaattattttgctggtggaacatcttgcctcaatgttggtggctgctgactgactgattagggtagtggttgctgaaggtttgggtggctgtggcaatttaaagtaagacagcaatgaagtttgcgacatcaattgactctttcatgaaagatttctttgtagcacgtgatgctgtttcatagcattttacccacagcagagagtctttcaaaattggagtcaatcctctcaaaccctgccactgctttaagtttatggaatattcggactcctttgtcatttcaacagtgttcacatcatctttaccaggagtagattccatctcaagaagatactttatttgcttattcataagaagcaactcctcatctgctcaaattttaccagagatcaacagcaatgcagtcacaccttaggcttcacttctcattctagttctcatcctatttctaccacatctgcagtgacttcctccactgaagcactgaacccctcaaagtcatccatgacggttaggtcagcttcttccaaactcctattcacgttggtgctctgacctcctcccatgaatcacgaatgttcttaatggcatctagaagagcaaacccttttcagaaggttttcaactgactttgccccgttccatcagaggaatcagtatctagggcagctacagtcttacacaatgtacttcttaaatagtaagacctgaaagtcaaaattactccttgatccatgggctgcaaagtggctgctatgttagcaggtgtgaaaacatccatcttcctgtactatactcttgtactatatattactatgtaatacactatactatactccatcagagttcttgggtgaccaggtgcactgtcagtcggcagtagtattttgaaagacatctcttgagttgtaggtcttaacaatgggcttaatattcagcaaaccatactgtaaacaaatacgctgtcatccaggctttgttgtttcatttatagagcacaggcagagtagatttaacgtaattcttaagggccctagaattttcagaatggtaagtgaacgtcagcttcaacttaaaattaccagaagtattagcttctaataagacagcttgtcatctgaagccaggcactgacttctcctgtttacctgtgcaagtcctaaacagcatcttctttcaatatgaggctgtttcacctacactgaatgtctgttgttttgtgtagccacctttatcaaatgatcccagctagatcttctggatgactcgctgtagcttctacatcagcacttgctgcttcgccctgtactttcatgttatgaagagttaccttaaacctcatgaaccaacctctgctagcttccagcttttttttttctgcagctccctcacctctctcagccttcatacaattaaagagagttagggtctcactctggattaggctttggccgaagtgaaagttgcagctggcttaatcttctggtcagaccactcagactttctctctgccgggagtctgttttgctttcttatttgagtgttcactagaggagcacttttaattttcttcaagaacttttcctttccatttacaacttggctaactgcttggcacaagagacctggcttctgaattatcctggctttcaatgtgccctcctcattaaactcaatcatttctatcttttgatttaaagtgagagacatgcaacttttctttcacttgaatattcagaggtcattatagggctattaattggttactttcaatattattgtgtctcagggaataaggaagaccaagaaaagggagagagatggaagagggaccagtcagtggagcacttgaaatgcaaacgtatcagctgtgttcactgtcttagatgagcatggtccatggtgtcccaaaacaatcacaacagtaacatggaagatcactgatcgcagatcaccgtaaaagatataataataatgaaaaagcttgaaatagtgtgagaattaccaaaatgtaacacacagacatgaagtgagcaactgctgttggaaaaatgatgctggtagagttgcaaaaagcacagtatttgcaaggctccagaaaatgagcgatgcttgtaccttcgtttcttctgatttgctcttctaatctgccatggatttagaaggcacataactgttttatcactgtatataaaataagacaatgtaggcagtgtacaggagaccttatctatctagagagatcaatccatctatctttttttttttgagacagggtctcactgtgtcacccaggctggagtgcagtggtgtaatctacgctcaatgccacctctgcctcccaggttcaagcaattatcctgcctcagcctcctgagtggctgggactccaggagcgtaccaccacgtccggcaaacttttttgtatttttagtagagatggggtttcaccatgttggccaggctggtcttgaactcctgacctcaagtgatccacccaccttggcctcccaaagtgctgggattacaggtgtgagccactgggcccagcctatctgtcggtctgtctgtctgtccatccatccatccatccaaagtataggaatcgcagtgaagatattttgtgaaatcttttatgggttcttgagagacataaagttttggattctcagctgtggttcaaatagtggaggctgcaggctatcttgggaatgttaagtccagtgaaagtgtgaaaaaaaaaacataaaaatataggctgctgaactgggaaaaggtgctaaaaccaaatattgagaccacttaaaaattaaggaatatccaatttcaaaatagcattgatcttgggggaagtacattttccatttcatttagaccacattaacaaaatcattttttaaaagactataactatctattagtaatacaatgtcctttcatgcattagatggccagtcatgcttaccgtattttaatgctatgcgacccgtcataaaaagttaggtttacacctcaaattggaaattctacttataagcacaccagtaaaaaatcactgtaaatacttgtagtaacataactttacaaaaagattctttttatcgccatccataaagtggtcactcacctgcattaagagctgtaaataaattttttctcgaaggacctaagatataaaagaaacatgtaaaatacatatgttttatttgacatatcacataaaaacaaaccatgttgataagaattattttcaaaaacaatcaatcgctacatttcaggttcccggtgggaaatatcaccgagattcaaccaacttttgtcaagtgcattttaaatataaggtgatatttcacataacatcaaaatgtttaagtatgatatgaagtcaccacaaattaaataggaccagttttaaaaggaaaagccgcagtattttttcagtcaagaacagctgaagttcaagttttaacagtactgaattcacagactgtgcacatatgccattctgctgccgggagagcagaggccagacttcacgaaggacagtcactcccgtgtgctttccgaaactacccgtttctattcagctatgaagaaaaatagaagtttttcctccaaactgataaaatataaaatcaggaggggtaataggtacacagctgtaagtcactaaaagaaatctatgatgcttctacttaacatgaaatagttgtttctaggacataatcatctgcagataccagttagaacagctaccatgttctatctgaaattttacagagatgatgatctcttaaaatacgtggctgttatcaatggaaagcactgattcccacacaggtaaaactgttgcgacataacctatccattcaatagtgaggcattttagaattctgagtctcctgttctacaaagctgtccatggaatctcattctctgcaagttattttagtatcaaagttcaacagcgttaacttcattattgctgtgtggatcatggggctttatcatcatcaataaaaaaccacagttttccaacctgatgtcaactcagcaagaggtcatttggtgcctccgaaatttgattaactccctaggcaaatgacaacctgctgcacactgaagaattcaacccactcctaaaattcatgcctattttctcttcaattcagtacaaagaaaaggtattgacatacattaaccagcctcaaggtaccatattatcctttaaacacacacacagagagagagagagacatgttaaggaggatgctgtgacagagtaacacctctgagaaagttactaatagatattaacaatccaaagagtttcatgcaggttaacccagtaattcctccttctgggatatccacaagtaaccagaatctgaaacaatgaatcttgactcacatttgaagaggttcatctcagtattaataaaccccaataaaagtcagaagttgcccactataaactgaagtggacaaccatagaatagccatttaaagtgaagaagctctcctgatacactactaacttaataaaaagcaagatacagaagagtatattcattattacctcagttttgctggaataaaaacaaaacaacatatacatacagaggaaaaaagtcacaaggaaatgtgacagcaattgctggttgacagaattaaggaagactctttgtttctgtgttttccaaattctctaacataaatgtgggtctcattttataggtcaagtttctcactcacaattattcgctcaggctttagttaagcttcagttcactaagcacaaataatgctttttttttttttttttttttttttttttgagacagagtctcactctgtcacccaggcgggagtgcagtggcgcgatctcggctcactgcaacctctgcctcctgggttcaagcaattctcatgcctcagcctcatgagtagctgggactacaggtacacacgaccatgcccagctaatttttgtatttttagtagagatggggttttgccatgtcggccaggctggtctcaaactcctgacctcaagcaatccacctgtcttggcctcccaaagtgctgggattacaggcgtgagccaccgcatgtggcacaaagaaggcttctgatgtgctttggccccactgagacaaagctgcatgaaaacattgcacattaagtgtataccacatattttgtaaacctgaaaattacttttcataatcacagcaaataaaaagtgagggatatgagaaggaacagagataaagaacatttagaggaagaacaatgtcttagaccaaagacatgaagacacaagtacagtaataaacataaaacatctaccctgatgaaaagtaatcatgcatttctactcctttctcactattctagagcactgttttagaataatttaactcctgaagttttgctgtttctaccttatacctttgttctgcctgctgacttacacgtaatgatttttaactatagaacctaccaactgtcagaaaaacaatttcctcagtgcaaaaatgtattatatctcctttctcaacatatttgtaatcattgttgactataccataaacctaattgtcaaaatttaactttctacaagccaaggactttaagcgtcttgccctccctcttcaaaccacaatgaggactgtaccttttggaggagttttcatcaagtgaacatgagccctggataccaaaggcttcaaataaaaggatcctgaggaaccattctgaaatgctggttttggaggtttctcctcatatttgatgacagcggcattaccagctgtaataaaacagaaaagtacattttattgtatagataaacacagtttcgaccttccacatttattcctttgtccttgaaccaacaaatgctcaataagcacctacgacatgccagtcattactgaacattgggaatacaacatggataacaggtagcttgtgtctcagggatgcgaaataaaggctataatcagagtgaccacacatcctggttagcctggcacagtccaagcttatgcatcttgtccagttcagctttcatcccagataagagttggggaagaaataatacagccacttcatgctatgtaacaagaatgccccaggtgcagctaggaagagcacccatctccatggggacaaggaagaattcgcacagtcagctagttaatgacacaagaacagtaacatacagactccttggtagctataaggacacgctctggttcaaatccttgctcctacagcaaggagttaaaatgctaacttctgccctgaacaaaggaagtttgttccaaagtaaactttatgttttagctccaaagcaaaaacataaaagggaatcttacctcaataacaaaaaccatctttttatattatgtgtaaaaatttcccctccaccaatccagactggattttctactgtttgtttgtttgtttgtttgttttgagacggagtctcactctgtcgtccaggctggagtgcagtggcatgatctcggctcgctgcaagctccgcctcccgggttcacgccattctcctgcctcagcctcttgagtagctgggactacaggcgcccgcggccacacccggctcattttttctatttttagtggagacggggtttcactgtgttaggcaggatggtctcgatctcctgacctcgtgatctgcccgcctcagcctcccaaagtgctgggattacaggcgtgagccaccgcacctagcctgtttgtttccaaataatgatcaatatccaattctaggcacccaattctattctactattcaacgcttataaatttctttattaccaactatgatcccttttctcacttcactcacttagcaaagggttaagatacctaccttgtttacaaatgcattataaatgtgaagacagctagaaatttttcactaggctaacctattccaactgctacaatagtgcttatacacatcacattcaaactttgtacaggcgtgctattattttcccctaatccacacccaggccctgtacaatgagccatctgttcattgttctcgtgcccaaataacattcctaatattaggtcaaatcaacacagagctttccctcctgctgagaaaattctgtcaatttcctgtccttttttccaattctcaccttccctagaacctagagacttggcttttccaaagttgacaggaagctaatgggagtgacagtattaaagacaccgccattacaacattcaacagaaccctttttagatgttcatagaaaatggatattgggtttcaattagcattttagcttttgctgaatcaaatccaacaaagaaaattagacagtcttaaccatggaattataacaatctggattttagtcttacttttcttgaagccgtatttgattatattcagcaacaaataagtcacttattcatattttaaaaaattaaactgagttcaatttacagacctaatatgcaattgtatgattctaaattcatgcttttcttttctaaaatttagagacacaaaggcccacggttcacaaagagatcagtaaaaagattttcactaaagtaaaggacaggttcttcatgagggatggtactcctgtgtcccttgcctctctgtcacatgcaaaataggaggtggtgtgctggaaatcagctgtctcactgccacttttcagactcaatacaacactagatcaacccggcaccacacccatcatcagcttcataacacgcaacatgaagtcagaattcatactgcaaggataaaatgtctgcgtttgactcaggtacaaacacacatgcatttatattttatacatatttacatgaaagctatatatacaagatacatattcatatactctatgatcaacgattgtacctgctttctgctttactaatggcaggcacaacctgtactgagctgaacataattttatgactaacaatatctttctctcaatttctacttactgtactctaggctggcccactgctttccagtaaaccccaacttgaaggatgtataccaccatgagtcataatgctcttcaaatatttcccctgccctctatttctgttcctaacatggcaactgactgagtatcctgatgctatctaaattttccctcagccagagtcattatatccaaacaataaagtcctcagcggcaacaattccaatataagagatgcataatagtttccagcaatggaacaggatgtaaaatatcctagttctggtgctgacttgaccactgcctagctgtgctgaatcacctatctatgaataacaagggtctgaatatcgggtatgggaatagacagtgcattcgcccatatcgggtatgggaatagacagtgcatttgccttcacaactcactgtggtattcagtcccactgaggctggatgcatcctcagaatcatcctaaagacagtgttctagagagccatggacactaaacactgctggcttgaagagacaatacataaaatttttcatgtggccacctacttctcaacctgatctaatatgtagtttaaaactgcccctttgtcatctttggtcccaactgtctcaattatgccagaataacagattctctggaatctttatcttcatttccccatggccaaagtgtggttcaagtgaaataaaggagctggtgagtctaaaaggaaaaactaagggatattctcaggaaagcccaagcagaagacatgattttcctattagaaaagggcttctcatgctgggcacagtggctcacaactgtaatcacagaactttgggaagacaaggtgggcagatcacttgaggccaggagtttgagaccagcctggccaatatggcaaaaccctgtctctactgaaaatacaaatattagctggacgtggtggtaggcacctgtaatcccagctactcaggaggctgaggtgggagaactgcttgaacccaggaggcggaggttgcagtgagccgagatcgtgccactgcactccagcctgggcaacagagtgagactctgtctcaaaaaaaaagaaaagggcttctcattgtttcagacttttatctgcaaactaacattcatactacattctaacacctagtgaaaattcgcttttattacattatgtatatacacacagagccaacattctgttcatttcttgaattttatgtgaatcagtttaacactccccactgtgccagatcatctgcccacttggcttaaaatcaaagtactactgaaatctaaacttttgaatttcaaaagcaatatcactcaactatataataacaagaatgtctcacatataccctagaaaaacgtgaacagagaaagaacgagaacaaagttaacagtggtctggataatatttcctttttaaatagtccattcagaagtgcgtaagtactaacatgttttgtgatgtggagcctaatgaatctaccgcctgttcctcatcttagcctcacccatgacagacatcacgacttgaacacaaaactttccctctgaacctggaggcaccctgagaaaccactgacaccatcctacaggcgaattcttatccactaaccagtgttggccactaaccagtgttggcaggtgagacaatattcacttcccattcctgttgtgagagaagaaaaaaaacaaaaaacaaaaaactaagggtaaataagatccaccctattctttatcagcttaatcacttgaacaactcaaaacaccatcctgccaaacaatgaggccctgtcttattgcagtgaaaagggtcagaaatgtttgttgctgcaaggactttgaagatgacccagtcctcccttgtcattgatcagaggagagtatggaggctggaggctaagaaaagacaaagatagtccaacttaacatgagttagtaggaaaactacggtgggaccgggcgtggtggctcatgcctgtaatcccagcactctgggaggcagacgcaggcatatcacttgtggttaggagttcgagaccatcctggccaacatggtgaaaccccatctctactaaaaatacaaaaattagccgggcatgatggggcatgcctataatcccagctacttgggaggttcagacaggagaattgcttgaacccgggaggcagaggttgcagtgagctgagatcatgccactgcactccagcctgggcgacaagagcgaaactccatctaaaaaaaaaaaaaacaaaaaacaaaaaacaaactaaggtgggtccaaggttagtgcccttttctgcatgttacaccccactcagccagggctgtcagtgaaggtgaagggaaagaacactccatttcttttattcagtctccttctgttccttccatttccaggagaatgcaaatagctttggtctgcacctcttacatttcccctaccatctggctctcaaatataaacatggttttgtggccaaagtggaagaggaagtaatgtctttggaccttactttcctgctaacatcgcaaagttatacactctcccaagacccccttctaaattgcacaatagtccccaaatcttcaactctgttcatgacatacaatatatcatttatttttacccagttactttaatgatcttaaaaactggatattaggtatctgagtgtgaaagaccttataatctttaacctctataaatgagcacatttggtatagaaaccattgtgaaatgttttacactaatatccaaaaggatcaagatcgtaactttgaaattttctacacttaaaagaacacacacaaagaacctgctaaaattcccaaataagaacaatttattgccttacgtattttgatttggtcatttaaaaaatttagtaacattatttctataggatcccaaagttccgagaacccagtgctaattttacaacagcactgtgttatatcagaagttcttaaatgatgccactaaagatatcacatcacaaagaaacaagcagacaaagcgagaaaccaatatttgttaaagggattcaaatacttaagccagtataaatcagaacactgatcaaaagaggaagttaattcttaacatgaccacccattatcagaaacaggaaattttcagcgcgagatgattttttcatgttttgaggtagcctttaaaagtatacatgtttaatactttcagttacaacttaggaaaataaagatgtgatgtttccattttaattttagaaaagtatttttctacacttgcacaactaccagctacatacacacaaaaactagttatttcataagaaattaaaccatcaaaaagtctttgataataggataatttcatgtgccagaacattaacgatgctgctgaattatattaagagtgcaaaacacataaaagagacaacaaaattggtcctacacagaagcattcacatcttaaatatacatacaaaatgcccccaaatactaccattaccataaattacaagttacaaaaacagaagtcaagagatcctaaatcaatttattgaataaaaatttaagcatgcttacaaagaaaagaaaccagaaatcgtcgacctactttttttcccagtaaacgtggctaacaaaggaattatacaaaggctgtacgatcccacgaccagcagtgtcaataaggtagcatcatagtgcctctctgaaccagccggtggggtgagtgtagaattgataaagatttttgaagaaatatcagtttctgtacaactgcgaaatcctcctggtacagtcatttaaaaggatcaaagcaagcttaagcaggaaaaactgcagccatgttcactctcatatccctcatgcttgctcttagtgaattcgaatggagggaaaaaaaaaaaaatgcgtaagctccaaggcactacacaaaacagattaaaccagctagcaaatcaaactaagaaagagactcactgatttgaatgcttaatccgcaacaggaacacatcgccactagacaggctctgtgggtgtatggtaaacccctttgttaaaagacaaaaaggaatggacaaaagcactttacagcctccttaggagcatcagacacagtactgaaacggtggccaagtcaacatggatgtcgatggaaaacacggggctgtggcactacagactgtgtctgcttcaagtgccacaaattctgttgccacaacagtttttctagagcatgttggtgattctgttttggcagtttgtctttaaaattgctttgcaagacaaagagagcttaaaataatacacgtgtgaattaccttttcaaattcagagttccctcttacatgcaagcctgattttgtgccacaccttcaaaattccaacagtaaagctggtaacaatcctgtttaattgcaagtcacatatcccagtattcctgaagtgccagggtatgcagctacttactctcatatgagtccagctactgctgctaggtgacccgtcggaaatgtgctcattaattcggtcattaattcaatgccttctctacaaaaaatgcattctcaattccctcacatagctgctgtgtgattttagaccagtgacaacatctctgagcctcaatcaccttctatataaatatcagggtaacagcagaagttacctgagagaaaaaaataaaagcaaatatggacatcctaaagtactgctccacacccagaggagcctcatgagcattattacactttgtccccaactcctcacccaaaagaagaaactgatctgtcaaactgaagagatcagttcgccactcctctccacacccttgtgtctggttttattggtattctcatcatccatgaaaataccttctttttctcctcaactattttttagaataagggccatttcttttatatcctgtgctcctcactgcgcctatcatggtgtctgtgcacagcgggcactccaagatggtttaaatttatgaattatttcgtggggaagtataaaaaaggaaatgagaaaataagaaccaagtccaaatacatctttggaatgaaagaggtatctcagtaaattcactcatttatacacagaaaatagaactcacgttaactgaaaactttaacaaaattctcctgagtttcaattttttagaattaggattcaagttatattagtcctattacacaaaatctagcatccaaagattccacaggagatagtcttttgcaaagtaaatgaaactgaaataatctttttttctgattccagttagagtccaaatcccctgggttgctactcttaaacctccaaaacaccatcacttcagacgatgcactttcgaatccttcatgcaaaaatatactttaacacataattatttcaagagtgtttttcaaagaattttttttctgccaaactttcagagcaactccaaggaagcagtatgcctatttttcctgaaaccccagaaacaaaaattctaattatttgcagagcattagtttttcttgtaatgactgtttccacaacccccgaagtgtgatataaagtcgacttacaattgttgctgtaagtgctcagctcactgtgggtgctggctattgagggggtgcttcctgtcctccgcagcgcaggacttttcaaagatgctttggatttaggaagtggtctaggcaaattcacccatgacgactgtgcagttttcaaggatgtaggctttccttggggtttaaaaaaaacaaaaagtttccagtgctattcatcccgaaagctggcactttttaagcctgtaaactcaaacttctgcactaacaacaaagtcaaaacacaaaatgaatgttcacaatcatgtaacttcagatgaaagatgaaagcttcacgcagacatgtttatttttgatcatttagaggcaagagagcagaaatgatgaggcaattaggatatgagaagtgtaggagtaaccctgtctcctaaagtaattaactcacacatgttctctgaaggagatgatcaatcagaataatcatgagaaagcagcttttggcaaaactgaaataaaaaaataaacaaattgatacgaccccccatactggtgactaaaaaaaaaataatccattaggacaataggctatcatataagaaataaataagaaccaagtccaaatacatctttggaatgaaagagagatctcaggaaattcactcatttatacacagaaaacagaactcacgttaactgaaaactttaacaaaattctcctgagtggaaaattttaaaatcacccaaacaggaagaaaaatgcaatttgataagcaaaaatttcatttgaaaaatgcctaatgttctaacaccaggtggtgctatactattaagatttttttttttaatctcaccttttcttctttactccccacacagtttatttgccaaacttaaatgatcttcactccaacttgcaactctttcttgcagtaaaaatgtttccacttatcagtgaaataaatatacaggctgcgtatcctctggcatctctgaaactacattctcctgatgctcacgaacctgctacctaaatatgggcatttcccaagcccagtctttcgctcttaaccctcctcatgcccattctcttggagagtctattttctctactttcctctaaccattgtcctatgcggatgaatcccatgttctcacctgcagccctatcttccttctgaatctcaaggctactcatgttttaaagtacttattgagtactctaggttttcatcttagaccgacatgctcctgtttatgctaattatagctccactgttttatttttttaaaaatcttgctttgttgcccaggctggtctcaaacttctggccttaagcagtcctcccgcctcagtctcccaaactgctggaattacaggtgtaaaccaccccacccagccatatagccctattttttatttttttccagcttcaaaccattggaatcatcttttcttccccagatccccatatattctagcactgtctcccaatgctaccagtaccacctaactgaagactacccagagttgaaaaagacctttgatgaaaatgacattgttgcgtatcactaaggatcccataagtgagtcaaataatgctgctggaaagtaatgcccattgctttgttctagcgattttgctcataaaaacctcatcctaatggagaaaaagatgctgaagctcctcaggcctggcatttgaaattaccacattaagctcccctccttcggctccagcctcactcttgtatggctctcctacatccatgtgtgctctgctccgattaacctcgctttctctctgacaccagggcacatcatgtgctattctattaatattccaacaggcacatcatttcttttcaaagagctcttcttccaccctttgaatccttatttaaccctttatatcattgtctaaactgtattggactcctaaaatcctgtccttccatcccttccaactccatcatgttaatctcctaaatgtgaaaattaaggtcatgacccaatctaaaatttgggattctccaccatctacagcatgcggcccagcacagctttgaacgctaacccaatacaaattcataaattttcttagaacattatgagatttttttgcaatttcttttattagctcatcagctatcatcagcatattttatgtgtggcccaagacaattcttcttcttccaatgtggcccagggaagccaaaagattgcacaccccaatctataggatggtgatcgtagtttcaatccttttatttaatatttaatttcacaggcttaaaaggcaatgtggggttgatccctacccacttcttccccctcaggccatgcctctaccccttcatacacacacaccccttcgtggtttctctccagtcatttcgctctattcttctgcttacgcccatccttccgactgaacggcctcctttctatcccctcccctatttctgtccagtgaatccaaagtcagctcaagcttctcttctgaacccttgctactcatttgcagctccaccctaggcctactgaatcaccacctgcagtttcacaagatccccaggtgattaaaatgcacctggagtttctgaagcactgttgagaatcaggacctctctgtgagcttatcctgccaggacacccttctctgaatgccgtggactaagccttgctttctcctcacaccatgtacttgtttctatcacagcatttgcctccacattcttcttggaccatctctaaggttcctgagatcaggaagagcacctgattcaattctggtcctcaggaactggcaaaggtctagcatggagtgagacttaataaatgtttcctcaacaaattcatttttttaaatgccaacagtaaatgatgtattttgataatgtgttctcccatcatctatactgaagcattcagtgcttaacccatttttacaagcttatttgaatcttcagtctattagagacttttttctttacatcctttacaataattagcaactgttagatagcaaatacacactttaaaaatttatggttagccaccagttttacttgctttaggaagaacaggaaaacagatttttagaatataaatttgccaaattgccgccccttcagcagaaacactgatgagtcatcatcaaaactaataagcaaggttgggcacgtaacagatcaaaatgactgggccacagccacagtgcagccaaggcttcctacattttggaaatcagcttattcttcagaaatgcatgcctcatagctttgtttctaaacacaacttaggtttgcagacatttctgagtgtgcctgggaattactacagaagacctgtaccttcacacagctgcactagaggaaagcttaccccggcaaccaaatatcatttccctgacctcccctatctcattgtcacccccatccaggcccatcccctacacctaatggcagccagtcctcaccaaagtcttcccaattccaccatggctcttgactaatgagcaatgaggataatgaatgccgatttcaccaaaagattagtttctttgatagaataatcctaacagtgtgtgactattactatcccagttaatagatgagaagactacttaggtggttaaatggcttacttgggtcacatacccggccagtgacagtaaggcctagaatccaagtgtctaaccacctgcccagtgttccctcggccatgccacagaatagaaacatctcagttaaagaaaagtatgaggcttggaggcagacagagttcagaatggagctcttactggacaggagctcctacagcggaatggtgaaaaccgtacggatgcaacaaagacatataactatttcaccaacagtcccgacgtttagcttaacggtaaagttggcaatactaaaacatagcaatattaggttaattgagagactgcaagtaacacaggcgctaaattcttaaacagtgaaatcaatacaggacttctctgagttacagttccgaaaaggtgacatttaccaggtcatatcgtattgtgtaacttatcccagatgagaaagataaagatttaagatctacttgcaggatattattgacctcagtggtttattttaagctcgtgcacttagcatagacttacgtatagacaacagattggtttttattctgtaattataaccatcttttatgtagggaaaatctggaaggaataacacctccactttgccttagatagtaacacagtctattggatttgaagcaaaccttcactaatcaaccaatttactaaaatactcacctcagaaaacctgagtaagtatactatatttaacaacaataaaaatcagtaaaagacgcctagcaaaactaaaatttcaatggaaagattaagtgaacaacaggatagtgttaatattaatattatcctattctgtaaaacaaaatggtagaatggcgcttgccaggggctggtggggaagggaaatggggagttgttcaatgggtagaaagttccagttatgcaagatgaatacgtcctacagatgtgctgcacaacttgtgttgtaggaagctgggattacacccacacaacaccacacccggctaatttttttgtatttttagtagagatggggtttcatcaggctggtctcaaactcctgaccttaagtgagccacttgccgtggcctcccaaagtgctgggattacaggtgtgagccaccgtgcctggccaaaacagatcatcttaataaaaatctggacaatagattcacatgaaggtgtgtcttacacaagtatttatgtgcttacctagtaaggcaagtgcaagtaatcacaaagttcaaacatatacagagccagaaccacctgacatcctgccacagaattagacgttctcagtaaaaactgtaaactaaagaaaacatcatgtctcaccataaggtatgttgttctgtagtttatacagcttagtaggaacacaggtgggaagaagaaaataaggctggagaggcaggtagtttacagttgggtgagacatggcattgaatgccagactcataattttagaccttaaatgttagggatggatatggtgggaagatgtgggttgggggggtcggggagggtgaggcttttttagcatttacatcagaacttgattgtgtggtagcagtgtgcagaactgactgaagactgaaatcagggaaaaagataggaagctagtgtaccagcacctgccagggttagagaagtgagaattttaactaaaaaatgaaaagattattgaggtccatttgaaatatatcagtatggcacacaagtggcaaggccactaactactaagtaagaaagagaaaatgccaaactaacagacacagttaaaatacgagacatgagaatatgtattttttttccagttaattcagagaatatgtctgtagctataattatataacttgggttccttaaatacaactcaactacttagagacagttacctttagagtaattacctacagtaactaggaattattataaaatcaggggaaacttaaaagtgacaaacaagttaacaagttataagagaaataaattatacatactcaaaaccgtggctgcaggtccacttccaattaagcttaagggaccaaattctctcaccaacactaaatatacatgtttaagaacttagcttcaatggtagagtatcactgtataaatattaaataaacctgatgggcttcttaccaaataagtattatacaaaatccatatatttcctatgtgccaggaaaaaacagaaaaagaaatcccttactttggtaacaaaaaggaattgcacacatagacacacacatatgcactgtttctgtgaataaatttatcaaaaaagtgctattctattgtgaaaattataaaaatgagaaaaataaaagttctgaacaagtgtacacatgtgaattcttccatgaattgatatcttattaaatgctattgcaatctgaacctacatgtgattgcttttaaacgcaggaattgaatttttaaaacatgttaaagtaatctagaataattaagaatagccaaaaaaaaatttagaacagaaaaacattaagactacaattcaacaacgaaaataccaaaaaacccaatttaaaaactggacaaaggactcgaatagacatttctcctaagaagacaacaaatagcccagaggcacatgcaaagatgctcaacatcactagtcactagggaaatgcaaatcacaatcgcgcgagataccactttgtacctaatgggatgctatcatcaaaaaaaaaaaaaaaaaaagcaaaaacaaaaaattaacaagtgttggcaaggacacggagaaactggaacccttgtgcaaggctagcgggaatgtaacatggtgtagccactgtggaaatggtatggtggttcctccaaaaattaaacctgaagttaccatataatccaacaactgcatgtctaggtacagatccaaaagatgtgaaagcaggccgggggtggtggctcgtgcctgtaatcccagcactttgggaggccaaggcaggggatcaccggaggccaggccaggagtttgagaccagtctggcgaatatggtgaaaccccatctctactaaaaatacaaaaaacattatctgggcatggtggcgggcacctgtaattccagctacttgggagggtgaggtaggagaatcacttgagcctggaaggtggaggttacagtgagctgagatcatgccactatactctggcctgggcaagagagcaagactctgtctttaaaaaaaaaaaaaaaaaaaaagtgaaagacttgagcaggtatctgtacaaccatcttcacagcagcattattcacaatagccaaaatgtggaagcaaccctactgttcacaggcagatgaacgaataaacaaaaggtggtacagatataccacggaatactattctgccttaaaaaggaagttgacacatgctacaacatggatgaaccttgaggacacggtgctaagtgaaataagccagttataaataatgtatgattctctttcatgattactagaatagtcaaatgcatatagacagaacatagagtggtgagtgccaggggctgaaagagacggagaactgggggttagtaaaatggatacaggatttcaggggggaaaacaaagttctggagatggatatggaggatggctgcaaaaaatgtgaatgtacttaatgccacagagctgtacatttaaaaaattgttaaaatggcacattctgtgcaatatatattttgccacaatttaagttaaaaacaaggaacttgtgcaactagttggagtaagatattataaaataataaaagtcctactggaataaaaccatactgacagattaatacggtggtatatacatctcagagatataaaaattcaggataggataggataagggaggtatcttaaatcagcaaaaacatacttatttgtggtattaagatatttgaattgccaaattaaaatttgagaagcagaacggtacagtagttaatagttgacaatctcgaggtagatcgtctaggttcaaacccggcgccacctcacactgcctagtgagcaggttcctcaccgttctgcacttctgttttctcatatgtgagaatgggggtgataggagtactccttacctcataggttcttgtgagaattaaatgaatttataattttaaaatgcttagaacagcatctggcacaaagtaccatacaaatattagctgtcagcgctcgccatccaccaaaataaattaaattggattacaacgcaaagggcttaagatgaaaccataaaaaaaataattaaacataggtcagtcttcttgagtagggaccgtcttattatgcataaaaacacaggaaaagttaaaggaaacaatgtatttgacaacataaaagtgaaaaaaaattaagaaatcaccatatgcaaaataaaaagacataaaaacaacaggcaaaggaaatgaacagcagcagatcaaaaaaaaatcctatgcccccaaatataagtgagcgaaagctcttgatgaaacaatgaatacaaagagttgataacttttattattattcttttatttaacctcactgtgtctaacacctttcctggtgagccaactgtcattcctaatccccatcaccattgcttaaccccatagaagagtttaaaaagtcaaatacttgcttccaacctttcatgccagtaggggcaagagccagatctggtctgtacccatcagacataaggacaagagggcgaagggggagctgctgcatgggtgtccccatgaaaaacaaagagaggaggaggtccctgccctgagatgccgtcctttgcttccagcctttgaatgcagtcacaggaagtggtgggatgcacacggaactcctagcagccatattttaactgaaaagccaatgacaaagccacatgctgatgtgagatgagtggagaggcagaaagaggacatttatgaatcgtcaaacctggaacagcctgcctctagccctcccgaggaataaacacacacagcctctggtttatgtccactggttgggttttctgtcgcctgctgtaaattgtgttcttaactgcgccattctcctgccaacagtattggatgcaattggttcctcctttcttcttgaaaggctttccttacttggcttcagggatgcccctacgttcctggctgttccttcttgactctggagagtccagggagcaccccagagctatccttgacctgtgctctctacacttactgccgtggggctctcatccagtctggtggctttaaatatcctctatatggtgctgaatcctaaatttatatctgtagaccagatttctcccacgcacttcaaacttgcatatccagttttctactccacatggcctcttatcaatcatttctatgtaactgagtttcagatctccccttcccaacatctgtgtttccaccatccattcccatctcaggtaaaggctgcaccattcttccattgctcacaccaacatggtcatgttcatccgtgactcctccctttgctctcacccccaatccaatctaagcaaacctcactggctttaccttcaagcacatacctagaatctgagcgggcctcactgccacaacctggtccgagaaaacataacctcctgctgccatcacagcgacccccgcaagctgatctccctgttcctacttcacccatatccaatctactcccaacacaactctcagagtgatcccattaacatttaagtcactccagttcaaactccaagtcctaactatgattttcaagactatacatgatccacgctgggcacggtgcctcacgcccgtaatcccagcactttggaaggccgaggtgggtggatcacctgaggtcaggagcacaagaccagcctgaacaacatggtgaaaccctgtctctactaagaatacaaaaactagctgggcgtggtggcaggcacctacaatctcagctactcggtaggctgaggcaggagaatcgcttaaaccagggaggtggaggttgcagtgagccaagatcatgccattgcactccagcctgggcgacacagcaagactgtgcctcaaaaaaattaaaaaaaaaaaaacagcagacactgtctccattatatacataaacatatgtgcatgagaatatgcaaaaagaaaaggtaccaaatagtcataaatttttaagttaaaagctatttggtggtggtaagatgacaggtgtttattttctcacttttaatttaaaatgctatacctttaaaatagcctactgggaagagagtagtgtaaacttgataaactatccaatttgcctggttaaattcaagacacaagaggtaaagaataaaacagggccccgcatccctttcttgacattgacaagaggctctaggtcagcctcttctttgttgactgccagaaagccaatctgttgtgtcctaatcacctgttggccctcctctgtattttcacaccatcattactgactttgacctcaatctctacattctatattctgagccataactcctcttctcattctaccttctagtatctcagtcaagtcctgaaaaatagctcaatacatgtgcatcctccttacttctcagatctcagggggcaaaagttaaacagcacaaagcatcaacattaaaccaagcctggcccctacctatttaagagtgtaactctattacattatataatctcctatattacagaaagaaaaccattaagcgaactttggtatttgtaattacaccctcttccaaaatcctacagttctttttattaaattttagtattataagaacaaatgtgatgaaacaagaacttgtcacctcttctatttggcagttaataccaagaaggcaaaaactacatcttactcatcccacaatccctcagtgtctggtacatgacttacctagcatacacgctctatctgttaagtaaatacgttgcagaacacagaatatttcagtaacactctagatttatatgttgcaaatagtgattttactattccaccttcttgagttcatcaaggcaataggactctgtataactatcctcatttgcttaaattcaagggtaagctccccagacaaaggcagagcaacacaggtgagtcataacaaaaacacggcaagtcttaagactgcagtaatttgacaaaggagcaaaaagtcccacaaagggaagttctcacgatgactcgaactccacagaagcgcagcattctcggtgatgctgtcagtacctgcctctgcaagtatgttcacaagatgtctgtggcttcaggtggggattaaacaaaaataactgccttagtcacaggcctggaacatgtgtcccacaactacaggaacatttaaattcagaggggaataaaccaaagacttaaaggtgttgcttcattttcccagctaccatacaaaggagataaacaagggtcttcacatgttcaccagcaaatttatttaccatctgacacctatgctaataatgcctgataagaacaaaagaaggtgcacagtgagcctcctggctcattaggagtcaaggtttatgagcagagctccactgagcaatgaggtggtgagatcattgagacctcaaaacttcacaccaacttttttttttttcttttcttttcagagggtctcgctctgtcaccctggcaggagcacagtggtgcaatcatagctcactgtagactcaaatttgggctcaagagatcctcctgtctcaggctcccgagtagctagtagctgagaccacaggcgggagccactgggcctgtctcttatatctttatgtcagctcttttctgatggtttccttagtctctacatatttttactcttaaacctcaggcatgcacatacccctctgaggtgcttcccagtctgtagcctcctccaatttcacatgccccgaattaaactcactattctcctccggaaaacttcttgctactctattccacatttcacttcatggcccaccacctatccagcctctgaaggcggcggttggggagacacttaggactgttcacaccaacagaagtggccagacactctgtctcctaattattttaaacatgcattctactatccgttcccaaaaaatatgtagcactcgtgcaagtttgtgtctacattattagaactaatcagcctctacctccctcgaggcagaggctcatctgtcattgaccccgggacacgtctgctccaggcatgctgactctggccttgacgttccccaagcacatggtatcctttgacaaggccacatctgcaccctcagcaaccccagcagcctcctctgctggcaagctcctgcaggcgcattccaaacagttcaaatgtcaccgcctctcctccagttctccctcacaacaagttagtgttgctcctttactgtggatacacagtgcttcgcacaggtctccattcaaatcaagccaaggaatgtttttaaacacctgttgtgcaaccagtacactgtgctgggcactggaaaatatgaaaataactaagagctgaactctatccttatggatttcaccgtctagaaggagacagacatgtaaggaaataatgagcatacagcactataaatgcaaagcagcagagaggccaggacagctgaggtggaatctgaagagccaagagttttcattggaacgatttgcttagacacccccttatcccctcaccctccaaccagtaagctccttaagagggcatatttgcttaatcctgtttgtagtctcagaatctagtacactgcccaacacagagcagcgactctaagcacttcttgaatgaatgggcaagcctgcactgtgacatattaagcctactcatgagtcattccacaaagcaatcttctccataattactgccaagtaagaattgtgtgaaacgcctggaaaagatcaagcatttacaagtgatgatgtccgtgaggatgaaaagaggacatgtgcctcgcaggcacctgcatggccctgcttggttggtcctgacctcctccgcccatccatgtcctccagcccccaccacacacagtgcgtggttcactgttcctcacgcaccctacaccctgcctcacctcggggtctctgcacggctggtccctgtgcctggaaagtcctcccgcctgacacccaaatgcctccctcctcccttcctttcaggtgtttgcccaaatgtcgccctctcagtgaggcctttcttgaccaaccgtttaaaaatctaatctccttcactgctttatttttattttattttattttttgcttgttttttttgagatggggtcttgctctctcacccaggctggagtgcagtggtgcgacctcagctagctgcaacctccacctcccaggttcaagagattctcctgcctcagcctcccaagtagctgagaccacaggcaccggccaccaaacccagctaatttttgtatgtttagtagagatggggtttcaccatcttggccaggctggtctcgaacttctgacctcaagtgatccatctgccttggccacccaaagtgctgggattataggcgtgagccaccatgtttggctctttctcttttatttttggattcatcatcatgaatccaaaaatgtatttattttcttaatccccttattagaatttaagctccctaatggaaggaacgggtctcttctgtgcacttcattccagcacttagaagagttcttagcacaaaccagccttccccacattctccttcacacatatgtggtttaatgaagaattcacatatgtccatgaaagaagacaggagtgtgtcaagacttctgcatgcacgtaaaggaccagggttaagagcacagactgtggggccagaacacccggcccatttcccgtctccaccaattaccccactgtgtaactttggacacgttactgaagctttcagaccctcaaattcctcatctgtagaatggcgattatcacagtatccctactaggagttgtgggaattaaatgagattatgcatttaaaagagggcttagcactgtgcttggcgcacacaggcactcaaaacatgttagtgactaatactatttttatgaaaagagatcctgatacacactttaaggaaactaatttaattacataaaaatatagaaacatctattagcgacacattaaaattaaattttattcacatttcagagacagggtcttgccctgtcacctagcctgaagtgcagtggtacaattatagctcactgaaccctcaaccacttgggttcagtgatcctcccacctcagcctcctgagtagcaaggaccacaagtgtgtgccacttgcccagctaattttttaatgttttgtaaagacagggtctcactctgttgcccaggtgggtctcaatctcttgggctcaagtaatcctcccacttcatcctccctaattcctgggatcacagatgtgagccaccatgtccggcctcaacttggcttttagaataacttattgggtaataacctctgatttttagtaattactttattcaagtatgtgaaaaatctctcataattttgcttactgtctccctcaaattctcacctagaaaagtttaaaaggatataaaagtaatttgaagaagatttgaaattaccttaacacgaaatgaatgaaaaaataatcagtttacataaaccacgaaggaaataacttagcaagaaagaagagaaacctgcgatgacaggcaagtcactgcaagtttcggacggactactgtcttgaaaggaatttactttattaacccacaataaactcaactgaaataaagagttgcccttttgaaatgtggtttctctttctctagaagaaaaccaaaaaccatctctttcaggaggcctttcttcaccgacccacccctggacattcttctcatggggccttttccccacccatcaccattctttgtgccgctttgtgtttgctgcataaacacgcactctccctcctcagctcacaggagtcacggggcagggagagcattctgcgctacttctgtaatcctacctggctcaggctggcctctgaaatggcaactcatgtgtgtagagaagaacacagatatttatcatctaaaacctgggaaaagctggtattgcctccaaaagagagtgaaggcgggtctctctaaagatgtctgaattgatcatgaaggatttactcagcagttatttattcagcagcattaattttattattactgtattttttattgttttaagttccggggtacatgtgcaggctgtgcaggtttgttacataggtaaacatgggccatggtggttgacttcacctaccaaaccatcacctaggtattaagcccggcatgcattagctatttttcctgaagcagcattaattttcaatagccacataaaatcattcacatcagagttaacatcaagctttaaaccaaggcctgaaaagaaaagtgccacagtttctaaaccattcagctgggcaacaagaattttaatttttaaaaaaattaaacgttagcctggtgtggtggttcatgcctgtcatctcggtactgtgggaggcctaggtgggaggatcacttaagcccaggagttcaagaccagcctgggcaacaaagtgagacccccccatctctacaaaaatatataaaaatcagctgggcatgctgacacacatctgtgataccaggtacatgggacgctgagacaggaggatttcttgagtccaggaattcaaggctgcagtgatctatggtggagtcagtgcactccggcctggacgacagagtgaaaatgtctcaaaaaaacaaacaaacagaaaacaaacaaacaaaaaaacaaattagactttattattaaaaataaaactcaggccaggcgcggtggctcactcctgtaatcccagcactttgggaggccgaggcgggtggatcacctgaggtcgggagttggagaccagcctgaccaacatggagaaaccctatctctattaaaaatgcaaaattagccaggtgtggtggttcatgcctgtaatcccagctactcgggaggctgaggcaggagaattgcttgaaccagggaaggggaggttgtggtgagccacgattgcgtcaattgcactccagcctgggcaacaagagtgaaactccatctcataaataaataaataaataaattaataaatcaaacaaacaaaactcatggccatactaatagtattgagattaataatgtgttggttaacagcatcactggctggtctgaatcccacctctgccactttccagctgtttaacattggacaaattatttaacttttctgtggaagattccttgtctataaaatagggataagcctcaaagttactgtgaggattaaatgaatttatagatgaaattactaaaactgagcctggaacccgacatatacttaacagtgtgagctgctatcattgacattataataattactactacaaataattttcatcactatctcatcttatttcagtatatttccaaagaagcaaaggtagtttagatttggtttgttataatctcttataatctggtctcatataatatatttccacattttgacaagtaaaatggaacagctctttgggaggccaaggtgggtggatcacctgaggtcagaagttcgagaccggcctggccaacatggtgaaaccctgtctctactaaaaatacaaaaaattagttgggcgtggtggtgggtgcctgtaaatcccagctactcaggaggctgaggcagcagaatcgcttgaacccaggaggcggaggttgcagtgatccgagattgcaccattgcactccagcctgatcaacagagcgagactccgtctcaaaaaaaaaaaaggaaaagaaaaaggaaaaagaacagctgtgttgggtttaattacaattccttctcacattcattttaaagcttcaagaaaatggctgtttcaatactgggtctggttttctacttaagtgttctgaaaggatttattgaaaacgccaaattggctggaacatttctgccgcttacctttcagcagagtaactgtgagtcagtatggtggatatccatttggtttcaatttgctaatacacacagacacttcattgtacaatcaatggcaacaggatcacggggatctaaaagcacattgtttctgctccttgatttttctgttctacttttaactctgtggcgattaagaaacacctctcaatttactgagagcatccaaaaaaattagttgctattaatttttctgtaaaacataatacagtagaatcaaattagtcttcttagtcggctcaggctgccataatagtaataataccagatggggtggcttaaacaacagaaatttgttttctcacagttctgaaggctggaatgtccaagatagaggtgccagctgatctgcttcccagcaagggccctcttcctggcatccagatggccacattctcattctacctcacatactgaggacagttccagtgtctcttcctcttttcttttttgaaagagagtttcgctcttgctacccaggctggggtgcaatggtgctatctcggctcactgcaacctccgcctcctgggatcaaggaattctcctgcctcaccctccccaatagctgggattacagtcacctgccaccacccttggctaattttttttttgtatttttagtagagaaggggtttccccacattcccacattggccaggctggtctcaaactcctgacctcaggtgatccacctgcctcagcctcccaaagtgctgggattacaagcgtgagccaccatgccaagcccatctcttcatctttttctaagggcaccacccctactggattaggatcccactcttatgaccccgtttaaccttcatcacctcctcaccagccctgtctccaaacacaatcacattgcaggttggggcttcaacatattaatgtagagggacccaagtattcagaccataaaagtcttctaaccagtcaaatacaaaactcaaattcaaatccagaatgtttccagttacattaactttgtttccattcagatacagaaaaccacccagtaaaacgtaattagtttttaactcagactgaaaaatctggatgcataactcagttatcaagctcatcgacacaggatgataaaagctcaaaagcatgccctgtcttttcactaagactaaacagatccacttttctctaagacacattatgcaacacagagtaaaaggacttaacaactacttccccgctgggtgggactgatcgcctacataaaaggattctatctttttcaatgtatcctgggtactggcctcatttcttaaaagtatgtgcgcttagattttctgggattcaagccccacgaaattcagagaatcataccagtaacagcagttactcagaaaattaggtgagctccaaattgtccctagaaaggtaagggctgtaaaagctgacagggtcttagattctcagacacttacactttcaagatgtgaagatgaagcccagggagagtaaaagacttgctcaggcagcgtattggggccagagtggaactaaaacacagggctcctaactgcaggccaggggccacactccagtgccaccaagctacaggtgttcctcacagaggaggaagggagcttcccattctctgcaagcaccatgagccttattggacaactacagtaaggaccagagctttttcttcaccaccaagggacagggttttgctctgctgcccaggttggagtacagtggcatgatcatagctcactgcagctttgaacttctgggctcaagtgatcttcctgcctcagcctcctgaatagctgaggagcccctacaagggcacaccatcatgctctcatgcccagctgttttttttttttgttgttgttgttttttttttttttttttttagagatagtgtcttgctatgttgcccaggctggtcctgaactcctggcccactttggcttcctaaagcactgggatttcaggcataaaccaccacacccagccaggactagagctttcatctcactcatgccttgactccccaggtgtggcaatatcccaaataagaatcactctttctcccaatggcttttggcctctgtttttctcccagatgatgaacactccaagctaatgaattcctgtttccacccagatcctctggggatggagccatgtgctgcaaacccctcttcctccactcacgcctctgtggtcatgtctccttgaccttgacactaggcctgaatctaaataaacagcccgtaaaacatttctaagcattacaggctttcacacttgaggcttcatggtagggttgaaaaatgaaacctacaaatactaaattgtagagaggtacagagatcttctgggatttgctcgctttcattagtttccataaaacattctcacgtgtgtggacacataactatttgtataagggaacttactactaaattgatttgacatgactttaatttgcccaaggctgtaccggcagaagtaaggtgggttctttgcaagatgttctcagtcaattggaatggctagcaggcttttcatccccgtgacacagggatgacttttccatttctttgtaacacagatctgtacgtccgccaaatttagtatgatacttaatagctattcttgaggcgctcacatttcattggcctaacatgactttaaaattacaaattgtaagatacaagccaacataaataaaagttcacattagaaaaatttaactttttagtcaccctcatatccctcctaaatctatcatacatctttcagtaaaattaaaaaaaaaattaatctcttcacatgtattgagggcacactagggacctaccgtacaacacttcagcattgttaagcacttaaccatttgaaaaaacttaatgaaatgattcaaatttacatcagccacccaattgtatatttatgtacacatccttctgaatagcttataagatggtttatacacctatacctctctcctcaactagcctttgccttgctcaaagataagggatatatgttgtcatcttctttttctacctcctgtgctcaggatgctgatccacaaaaggctaactgctttagtgacagaaggcattagacctataatcatgactgtccaattttacattcaattaactcataaactattgaactattttattcttaccagaactggacacacgcctgatcctctgaggagatacggctcgatcagcactgggatttctattgtcactgttccgcctcaaacaggaaacagggggccccactttggcttttggagcagctatttgcctcaaaccgcaggagtcaggcttggatatattcctacctgaggtggtcgttgtttttgaagcagagccctgtgaaaataacagttaagactgtaaaccaaaactaaaattctaagccccccaactgactgaatgggcccctcctctaggccaaggcaattccaaagaaacctaaaaaacaagttcaggccatgatggcaaagaggtcagacatgcctcattatactctcctccctttagaattcaggcacaactgaccagaattaacattaaaacagaaaccttaagtcagacaaaacagactctttatagcaaaaagacactaaattccaacctgactctagtttagcatcacatgacagacagcaagccctgaaggaaattgaagtattttaccccaaaatatttttctttaacacattttgaaatggccctgcaaagctgtctcttgtaggggcaaatttacattctgtagagaatcttcttcccttcccagatctttggtcccaaagaaattagctgagagtctagcaccttttaaaagtctaaataggtaatatttgccatctattacctctaaaggcggccacgtatgagatttcatctacataataagaaccttggtctccacagccccttatcttatcttaaccgagacactcctttctattgatttcaggtctttagataataacttctttagttttttgacacggagtctcctctatcgcccaggctggagtgtagtggcatgatcccagctcagtgcaacctctgcctcccgggttcaagtgattctcctgcctcagcctcctgagtagctgggattacgggtgcacaccaccatcaatctttttacttttagtagagatggctaatttttatatttttgtagctaagttttgtattttttttttggcattttatttttagtggagatggggtttcaccatgttttcttttttttttttttttttttgattttttgtatttttagtagagatgaggtttcgccatgttggtcaggctggtctcaaactccacacttcgtgatctgccgcctcggcctcccaaagggctgggattacaggcgtgagccaataacttaattctttcaacgaactgccaagcagtaaatctttgaatccacctatgatctgtaagtccctacttcaagatgtctcatcttcccagaccaaactaacgtgtatctcaaatgtattgactgatgtcctctgtctccctaaaatggatgaaatcaagctgtaacccaaacacctaggcacatgttctgaggacctcttgaggatgtgtcatcagccatggtcctcatatttgggtcagaataagtctcttcaaatgatttagagtttggcttttttcattaacaaaattttaatccagatcataccttccccataccacttccttgtggtattagctacgtgaaaggaacaatttctaagtgaacgtgtacagttgtccctcggtatcaaaaatgattagttccaggaccctggcagatatcaaaatccatggacactcaaatctcttatatgaaatggtgtagggtttgcatataacctatgtacatcctcccatatactgtaaatcatctccacgatcattacttacaacatctacctattacttgtttcaggtggattcaacatagtattcagcatgtagtaagttcaagttttgctttttgaaacactgcagattttttttctgaatattttcagtccaagtttggctcaatccacagatgtggagcccatagatacagagggctgactgtattcaattttcatttttactatgaaacaattaaaactcttcacagcttactctttaattcaccatattctgcctttgtacccattagtgagagtgtactcaagatcaccagtgtcacaagttaaattcaagctagttttcaatccttcccctgggggctctctctacacatcgaacgttaataactccattctctggtttcctgacaaagctctttcctggttttccttctacctgtccggttattccttttctgggtcctattcttctgtacctttggaagctagtgatataatttggatctgtgtccccacccaaatctcacatcgaattgtaatccccagtgctggaggagggacctggtgggaggtaactggatcatagaagcagacttcccccttgctgttcttatgacagtgagttcttacaagatctggttgtttaaaagggtgtgtcacctgccccctcactctcttcctcctcctccagtcatacaagacattgcagccttgcttcctgtacagcctgtggaactgtgagtcaattaaacctcttttctttataaattacccagtctcaggtagttctttatatagcaatgtgagaacagactgatacagctagtcttcatgaagacctagccttggccctgttctctttcctcaccatgtactcttcctacatgatcttggctgctgtttcaattgccacgtgtacactggtacatccaaatccacatgttcaaccagtactctctcctgagtttcccatatacctaacttctttctatacatcccaactcagcatccttcaagcacctctacgtattagtccattttcacaacgctgataaagtcacacctgagactgggtaatttataaagaaaaagcagtttaatgggctcagagttccacgtggctagggaggcttcacaatcatggcagaaggtgaaaggttcatcttacaaggcagcagacaagagagaataaaagccaagggaaagcagtttccccttataaaaccatcagatctcatgagacttactcactaccacaagaacagtatgggggaaaccacccccatgatgcaattatctcccaccaggtccctcccacaatatgtgggaattacaggagctacaattcaagatgagatttgggtggggacacagccaaaccatatgactctacttaacttactaacatatagcccgtatagaatactattctaaattctaagtatatgtatcaattcacttaaccctcataataatcctgtgaagttggtaggtttattgtaccccattttaaagaacaagaacatgaagcattttctaaaattaatcttactttcctatctatctcaaaacttatctcttcctgtattcaccacaacatacccaggcacccaacttcaacaatgaaagctgtttctcttttccatctgctgtcatttctcagcaagattactgaaacgatgtccacaggatctttctggtctctccagctttcaattcatcttttatctgcctgctagggcaatctctctcaaactcgaatagggttagacaccttctgtctgtcttccagataacatcttcttcacaaggcccagcaatccttttgcatatggaagcccctgccatcctcttcaccttattccctactgctcagggttccattctcccagctcccaccacacctacctagagtcccctaaattagaaaatcttctcatatttcttcagctttgtactctacccagaatacctgcccttcaaattccagctagtgacaacatgtgatgtcccctataagccttccttgacaactctgcccaccaccacatcttgttccccctcctgcagcacagcagtctactcacactcccaacttagcaatcaacatacccttgcctgtttactgtattgatagaggcaggaggcagagaaattctaggcagacgggggcaggtccccagcaaaaccccaccttcaaggcaaaaaccctgaaacccacagcctaaagtgagaacttctaaacctgtttgcccactctctcctaattagttctttctgaataatgtctttttaccaattgaaagttgccttttccaaaactacctatggcctgccttgccccccacatcccattcatgtaaagaccccagactcacttggtaggggagacaagcggcttgactgatgtattagtccatttttacgctgcttataaagacgtacatgagactgggcaacttacaaaagaaagaggtttaattggacttaagagttccacgtggctggggaagcctcacaatcatggcagagggcaaggaggagcaagacatgtcttacatggatggcagcaggcaaagagagctcatgcaagaaaactctcccttataataaccatcagatcttgtgagacttaatcactattatgagaacagcatggcaaagacctgcccccccattattcaattccctcccactgggtccttcccacaacatgtgggaactcaatacaagatttgggtggggacacagccaaatcatatcaactggagacttcagaggacagctgagtctactgtcatatcaccctgaacacacccaatctcgcctgatctttgaagctaagcagggtcaggcctggttagtacttggatggcagacagacagctggactttggaggagagatggcttagctttggagaagagccaagtgtagatggccagactttagggaagattatctgcccgtcctgtcccgtcttcagctaccctctctgctgagagccactttcattgctaaataaaattatctgcctccaccatccttcaggtgtccatgtgacccaattcttcttggacagtggacaagagcttgggacccaccaactttgggtacccaaaaaaggttatcacactgaccctttgccctcgctactggagggcagctgccccacacagtgaggcaaagggcccactgagctgatgacacaccggtgtccatggatggtggagccaagagagcactgtagcatgccctctggggctttagggtcacagacaccaccacctgggcaccactgtggggcctgcacacagcatgctcctgccggtgctcaaagtggctggctggatcctgtactcacttgcccacacactcctgcccgcaagaggttgagcatggcgggctgaatggggcacccccatcgcaagttttacaaatgggttgagaaaaactcctgcaacagtattacccactgcactaggcactcagacagggtctcttttttccctacatcctaacaatcatcaccatatgtataatacatagtatgcacccaataaatgtttctattctacatagaggaaatgggagtctgagccttactcacagtgtgaattccaacaccaaactacaatttgcaattctccctttacattaatgtaaagcaaaaataaaattctaagccccccaaccatctgaagggaccacttctctcggccaagggcattccaaggttaacctgaaaaactagttcaggatatgaaaggaagggggagtcagacataattatactctccgaagggttggaattcaggcacagctgaccagcattaacatcaacaaagaccttaagactgatagaacagactcttttaagtctgataagcaacatttacaatcaactccccctgaagccggctacctgaaggtttcatctgtatgataaaaccttggtttccacagctccttatcttaacccagacattcctttttgttgattccaggtctttaactctttgaaccaactgccaattagaaaatctttaggctgggggtggtggctcaaacctgtaatcccagcactttgagaagccgaggtgggcagatcacatgaggccaggagttcgagaccggcctggccaacatgaggaaagccagtctctactaaaaatacaaaaaaattagctgggtgtggtggtcctcacctgtaatcccagctactcaaaaggctgaggcaagagaatcacttgaacccgggaggcagaggctgcagtgagccgagagatcacaccactgcacccccagcctgggcaacagagaatctgtctcaaaaaaaaaaaaaaaaaaagaaagaaaaagaaagaaaatctttaaatctgcctgtgacctggaagctgcctccacttccagttgtctctcctttctagacagaaccactgtataccttacatgtactgattgacgtcttatgtctccctaaaatgtgtaaaagcaagctgtacctcgatcaccttaggcccatcttctcaggatctcctaagggctgtgtcatgggccactggtcactcatgtttggctcagaataaatctcttcaaatatattacagagtttgaccctttttttgacacaaagaacaactgagctcaatagagacttagtaacctgccagaggtcactttgcccagtaaatggtggagctacaatttgaaactactctaaaatccgtgcttgtaaagcagcatgttccctgtcatcactcttctttctttaataaatctcaagtgttaatttccgatagatacacataaagcccaatgccgatggcagtcgaattcatacattaggtgaattcaacaataacttagcaggccaatcacccatgagaacagctggaggtcatgttttggcactggagaacaatacagaattggccaagaaaagcaagtgactgtacacaaactaacaaagatcttctgtctctggctaggttaaattaaagctggctaaattcatctcccagagaaaaatcttcttttaaaaagcaacccaaaagttaacctcccagagaaaaccttcttttaaaaagtaaggcaaactgctcatcaatttacaaaagtgaatcttcagcaaatcacttgttttgcctttcagagccaacattccaaaaattttgaaaccgtatggtgtatggagcagaaaaggccaggattcaagtgagggctctgagtgtgaatcccaattttactatttaccagctgtgtgagttttaagtgacctcgctgaagtattaaaatgtcgacaacaattgccctgttgttattgggaagagtaaataacaatgtatggaaagcacctgagcgttacagggcccattaaatggcataatataactaaggcacctgagcaaagtgcctgacccagagcaagcactgaataaatatcaattcctttccttttaggttaagtctccactccctttatctcacacactatcatgaacacataacctctgttgtgaggagctacatctagccccgtttcaaataaaaatcaagttccttcttccaaataagaacttttctaaagattcagatacaccctgaccaccaatgagctgtgaggttgcaggcagtctagggattcagtaaactcaaggcctaaggcaggccaaggccaacaaagcaacagtaaaaattaacatccgaccgggcgcgatggctcacgcctgtaatcccagcactttgggaggccaatgtgggcggatcacttgaggtcaggagttcgagaccagcctggccaacgtggtgaaaccccatctctaataaaaatacaaaaaattagccaggcatgtgcacctgtagtcccagctacttgggagaaatgcgtgaacctgggaggcagaggttgcagtgagccgagatcgcgccactgcactccatcctgggtgagagaggagactccatctcaaagaaaaagaaaattaacatccctccagcatggtctcttcgtcaatccagggcagtaagagcctttgagtgctgctgaagtgaccaaccgacattcatgtttcaggaaaacacgcagcaaattcattcagctctctacagtaagtgcaaagccagtggcctatgagggtctgcccagacactttccagtcctccttcccagagacatggaaatgtgcaagaggtaaactagcaaaattagagagcactgtgcttcagacatgatcgtgaaaaaagagtaggccgggggcagtggctcacgcctgtattcccagcactttgggaggccgaggcaggtggatcatgaggtcaagagatcaagaccatcctggacaatatggtgaaacctcgtctctactaaaaatacaaaaattagctggatgtggtggtgcacgcctgtagtcccagctacctgggaggctgaggcaggagaattgcttgaacctgggaggcggaggttgcagtgagccgagatcttgccactgcactccagcctggcgaaagagcaagaacaagactctgccttaaaaaaaaaaaaaaaaaaaaaaaagaaagcaaaaaagaaaaaagagtcccttatgccagttgataagcatatgcgaatatgggacaatctttcaagacttacaaagtatttcatatctaattatgaatcctaacagccagattcctgaggcgaaaagtgctgtttctccaagacatactaggatccatttcaacctgatgattctatccttacctcagtaccacatcgggagcctgaaaaacaggttttcaagctgcacaggggcaacataaccctaagactcaatgcacaaatcaggaaaacttttagtttcaaaattacacaaccaatttaaattcaagacaaatgtcattaaagaaaaagaaactttatgatagagtttttggtagctggggactgacacaccaaaaaaagtctcccataaatcaagagaataaacatcgtgtttctatgtatatctgtaaatgccaaactaagaatgttgattagaattaagagtatgttgtaatttaattttgcaaaaaaattaaaattataaatgatatcggttttctaagtttgacttcaagataacttaaaaactaaatctgagttttgaaacaacggatgaactcattagtttagaaatcactgtggtgtacccttcttccaaatagagaagactggttgttaaagcccaaacatgtctaaactgatgttttagagaatctagaatatcttcggtctttcctaaccttgtcttctaaacggacctgacaattccctcccttgtggtccccatgcaccctgaagacacacctaagtcagcccttctgcacttgctattctatgtgcttcattcctcttgccacgagccctccaagggacaggctgtctgtgtcacacctgcctttctccgctggcacttagctcccttcctggcccagaggacaggcacccaaggacagcctgtctggggctgaaaatacacctaagtccccactgccaaaaatagggctgaggacacatgcccaacgaccaacagtggcctgtcaaatgtttttaaaacccagaaaaccaatttctacacactattctcaaaaacacatgcatgtttaaaggaaaatcacctttacactgcatgtgaattctttattctttaaacagcactctctaggtcccccccaaatattttagacaggcgctatggaaaacatactggtttttcactatacataagtaaaagattttattttatataccaggaattaatatattaaggctgcaagaggcttcacacatccactaggtccaatcctttcatctttgggtctcgaaaaattacttgccaaaaatcattattggccggtcagaggaaaaatcaagaacactcttgctcatacaagagggctctacttcccagagctgcctcctccgcaagagtccaggagttatttttatgttgacatgtttaccagcactcccaagccctttcttaaatgctgtccaatacattttaaagttgacaacccaactttttcagaaaaataaaatataacctgattgtatcaggcacttaaactactaattatactaaaatattaaagtaacttcatttttcagcacactattaaaaggaacggtgatacttgatacaaaatactgaaattgaggatttttttttccatatgcagttttgttgtattgaaacctattaacaccccagtactgacaagacaatgaattaacaactaaatgtaaatctgcccacctggttctgcaatattattgactaatagataactaaatgctaacacatctcagttttctccacagttctctgaagcatgcaaaaaatatatatatattacttaccaaaaacagagaaccatattcaaaagtctcattcataatctcttgtttcagctcttgtttttccatagatgtcccattttctttttcacccttcttttcagggctaatcctatcaatgttgggaacataggtcatttccaaacattctgcactttccattttaacagggagtatgcctttgatcttctgaaacaacgcagaaacggacccggtctcgcatgctgagttagaagaactggctttgtcaacatcttcctgattcgatttcacggcagatgttgttcttggaaccctgtgtgaagcatttttagaatgagttgtaacatgcacagcctggctagtaatgagtttattaaactgctgcttatgtgtcttgttaattagaatttctgcttttttgtctgcattcaagtcagatctcggtgttctgctcaagactgtttgttgtcttgaattcactgatgagggtgatgaggcactggtctgctgaggtctgggcgtgacctttgataaagcagcatctttgggctgcaacactgctctagacataacttttgctttgacattcttgaagtttggtcttgggtaacttataatttcagtttttctaactttgcagcctattggggtattcgttttgattgttgattttcctaaactgggtttacacaggttcacaggtgcctccttcgagtctggtatgtttttaagccctcgattacccttctccactttcttacatttctccgtcgcttcaatcggtgaaacagaaaaggttacttttgtgggttctaggactggtgttgacatgcacatcgttttgtctgtgctaatgaccatatcatttgcatcccaagtcagtccaaatgacgagcccaccttttgtcctggcgggctacttagaatcaattctgaggtatgattttgggttcccaaatcctttcctttggagaccatttgtgtgtcttcagtctcagtgactttatgctctgggttcagcacttgagcttcgctcttatcaaaagctggcaccattaaagggcattcatcatcaataagacaataggacactgtctctctcagattttggcccatttccttgtgcctgtatgagctctgtgaatgtggttcgctattggattcatcatgggataaacaaaagaactcttgtaatgcagaatcattggggacttccatgccatcagaaactggtgttagtgcttgtgtctccttttctccaactagtctttgttgtgatccatctgtgtactcactggtgacctttcctgaagaacatgcacactgatttccaatatctgaaacaaaaacctcactttgcatcaccacatcagaaaatgctgtgtaagtcatgtcttgggcttctgatggtgtgacttgagggttttcaaagctttctctatcataagtagtttctcttgcatgcgtcttatcagaatgggaagatgtccaagtggaataggataaagaagatgtacttccacttctcctaccagttggtggcaggcttccagcagtatggaaggactgactctttccgatggcatgatgtgatataaaggtgcagttaactttatccactgtcatgtcaaatgtttggtttagctccaaggcatcacagtagcctgcacagttcaaattgtcattaggcttccacacaaaaggcaaagatggctcaacactctggccctcaactgcttctagggaatgacaactgtgttgcagatatttgggcttctcagtacctacaagtgcaggacactgacaaatagaatctttatgcatatctaacacctgcttactaatgaaatcactagaagacttttcatgaccaaatacttcaacaccctgaaggcttaaagaaatattttcaccagtaactacagcagggtcagtttcataatcaaccaccatgtcatctgggttggcagaattccagttcacactgctggctgaagagttttgtgtaggtggtgatttcgggttgtatgcatgtgtatttccatctttatcactggtaaagaaggtttgcaattcatcttctattttatcatctgaattatcatcagtcatcctgaatagtaaccttaaacctctgccattttatttcttcttcaattccttttaaatgagagggtgggcaaaatggtctgtcttctaggtttttcagcacagttgaaaggttttcagtctaagatgctctgaagattaaatgatttgttgttccctggaagaaataaaatgtttaactcaagtaactataagaaaaattaacaggccaccccttggtttcaatcactaagtgattagtttcaatcactttatgttcacatttagaccccacaactactgatgtgggtaactgagatataatcaggcaatctatcaccgcttttcaagatacttttttaatttgagggaatagcaaatggggcaaaatggaagatggggtcattgctcgttaaccctgtccctgactttataactgatatgcctctcccccactcccagggacttgtcaaagagaggaggaggtaaatctggcaatagtattttcttcttgttggctgacagagtgacaattcacccaaatttgcttatgacagtcccaaagtatgtctgttgtcccaggatgattagtaaacatgtccctttcattctcagaagggcccccctattatttccatgcagagtgattattagacaggccatgaaagcccagcaaatcagctgaagatcaatcaagaactcacgtttctcctttgtttttattcctatcttaaacatatgctatttccaaattgaaggggaaaaaaaaattgtcgattcttaaaggctccagtggtaccctgttggaagtcccttgaaatgtgagttaccttatgttatacactaaactgttccccacccctctccaattcatatgtcaagcccaaacccccaccccttatgtaactatgttggagacagagcctttaaggaggtgattaaggttaaaagcagtcataagcgtggagtgctgatccaacagagctggtgcccttagaagaagggaaagtgacaccagaatgctctcccactcttggttcatcccctctctctaccaaattagggtacactgagaagagtaggagagctctcaccaaaaaccaaaccctgaaaagaaccttaatcttcaactttccagcctccaaaactgtgagaaagtaagtttttgttgtttaagccatccagtgtatgataatttgttatggtggccgaagaagacttaagtaccacatgccccagcaattctactcctaagaatctactgaagaaaatgaaaacatatgtcaacatgggaacttgcacacaaatgtacatgattctaaatagaagcactattcataatagtcataaagtagaaacccacatgcccatcaactgaagagcagaaagcaaaatgtactcttatgcatttgacaaaatattcctcagcaatagaaaggaatgcaatattgacacatggtacaacacggatataatattacacttgaaatattatatcaaatgaaagaagccagtcatgaaagtctacatactatatgacactatttacatgaaatgtccagaataagaaaacctaaagtggctgctaattgggatgacgtttcttttgcgagtatgttctaaaactatgtactgatgatggctgcacaatgttatatactgaaaactactgaattgtacacttaaaaatgaaaccattaaaacacccacgaaagcatttaaatctaaaactttttgcaaataaattattattgcttttttgagatggagtcttgctctgccacccaggctggagtgcagtgatgcaatctcggctcactgcaacctccacctcccggtttcaggcaatcttcctgcctcagcctcctgagtagcagggactacaggtgtacaccttcatgcgtggctgatttttgtatttttagtagagacagggtttcaccacactggccaggctggtctcgaactcctgacctcaggtaatctgcccacctcggcctcccaaagcactgggattacaggcatgagccaccacgcccggccacttttgggaaataacttaaattttattatgcttttggtcaaactgcagtgccaaagaaaggtccaaatgttcaagctaggactgcaaacaggtcattgtgaatcctaaaatgagggctgtgtgatttatattctgatggaaagtgtaaatttgttaactctttttactactgcaaacagatacgcacacacttgaactaattttctaatcctagtattcaatgtcaatccgatgtcacagtactgttgtaaagaaaaaaaaatatccatgagggagggaaaaaatgccatttcgtgtgttaattcaacttgccgaatgaagagtaggtctcatttttctatcttgcagcgttttctctgcattcaaacttcagtggcctgaataaaaccagaataggaactatgttaaaactgaaacgatcagttttcttcgctaacagtgctctgtgtctttctggccaagcatcctgataccagcctttaatggaataaagaaaggctgcaatgttgatttcaacagcatgtgcacacatacacatccaaaaagcgattttgaatccaaaaatgaaggctgcgtgatttatatactgatggaaagtgtaaatttgtgaaccctttttaccatataactccttagtgaaatcactgaatagtttattggcaagagccttaataaaagcttttatgaaacataaattaacatttttaatcctccagtataaaatacatccaagctaaatgtttaaatcaagaaatatatttattcatttttaggcttacatgcaggggatataatttccaaaagcactaaatatgctacagctttctgcttccctaacagctaatactcagttaacagactgtggcataagcaaatatatgcaaagtgcactgcaaacacgcacttagcatagatcgtgggaactgtctttgtaaataattgttagcttcaattaatggcatttttattactcaagtttcctcttctgaagtgcataaaagatgatttttaaacctcatataaattgaattaagggctcatatgtcaaagttattttttatttatttattttgagacggagtctggcactgtcgcccgggctggagtgcagtggcgcgatctcggctcactgcaacgtccgcctcccgggttcaagcgattaccctgcctcagcctcccgagtagctgggattacaggcgcccgccaccatgcccggctcattttctgtatttttagtagagatggtgttccactgtgttagccagcatggtcttgatctcctgacctcgtgatccgcccgcctcggcctcccaaagtgctgggattacaggcatgagccaccatgcccggccccaaggttattttttaaataagtatgtaagaggataaataattttatcactagtcctatgtttgtttttaccagttgtctttttttatttttcttttttttgagacaaggtctcactttgtcacccaagctgcagtgcagtgatgtgattacagcttactgcagcctcaacctcctaggctcaagcgatcttcccacctcagcctcccgagtagctgtgactacaggtatgtgccagcatgcccagctaatttttttaaaaaactttttgtagaaaaggggtccagcttttctcatttataaataatactaaactgaaatcttcacaatctttgacatctgatcatttgccaaattgctatatttaaaaagggggcaggattctttataatgtgcatgttactatatatgtatattttatatatatatataaaagttctctttctttttatatatttatatataaaaatacgtaatataaaatatatatattatatactgagttttgcttttaagactcatatactgtggtcagcattgtctctgaagcattttcccatgtcattatactataaaaacatttttaacggttgtgaaacgccactaaagttaaggttaaatgttttagatttacaagctagtggtttacaagagtaacagaaaaataaagaagccatcaaccatttaactttcacttaacattttagtacacttgggtttatgatttttttttaattcacaaaaagagattgggtgtggtcgctcatgcctgtaatctcagcactttgggaggctgaggcaggagcatcatttgagcccaggagttcaagactagcctgggcaacatagcaggaccctacctctacgatttcttttctttttttttttttttttagcacggtggtgcatgcctgtagtcccagctgctcagaaggctagggagaaaggatcacctgggcccagtagttcacagctgcagtaagctatgatcatgccaccacacttcagcctgggtgacagggaccctatcactattaaaagaaaacaaaacaaaataaaacaaatttcaaattggtgagcaaagagactaaaaaacccacaaacatgtgttcataaatacttaaggattgtttttatataaaataaatttactgacatctcttctactttgtagacaagagtaaaaaaatagtggtacagggatttggatatcaaaaaggttctgcagttaagctgatcagttccagcaagatggaagatcaacctcaccattcatgaaaagaaaacaatggctttaagtcaccaccaccaccaccatgaagacaaagccaaggacagaaaaggggtgaccggccttcgctcaggagtttgtcaaaagagttaaaagttggccattttgttttactgcctattttatttctccccgactttaagaatgggtcctaagcttgcaccacttgctcgacatatatattctttgccttcatctcacctgactcataagcaaagtcttcatattgctgtagttgctatttgtaaagccttcaaagttgccatcttagaaatattttgattaaacaagatgcagaaagttaaaaaataaaaagacagagagtgtgctggagggaaaaaaaaaaaaaaaacttgaaacaaaccatcctcacccaaagggataatttctcaagttctcttttggtagtactacctaccagaacaaaggtataacaccagaacaaggtataacaccagaacaaaggtataacacttgtgtaacactccagaacaaagcagaatgatcaagtttcctttctaagagaatcatttgggaaaacaaggagatctttttcagagaacattttggaccagagagaacaaattccccacttattaaagagctgggaatgtaacagagcagctcctcttaaacggttaccaaaatatatatttccctaaggatttataaggattaaaaattagtaaatatgtgctgaaagaaatggtcaaagaactactagtacaagctttgaggtataattccaatgcctttggaaaaaaaactttctaaatcttagcttaagaaaagtgattgtttattccccaaagataaaaaattccattatttcttcatgtgaagagacacacctaaagaactgaatcattatattaattacaattattatcatataatagaattcatcatcattaccatattaatgctagaagaaattttaaagatccaattcaaacttcattttacaaatgagaaacctctgagaaatcaactgcatgacgtgaccaaatcagttgtcaatagcagattatacaatagctgtgtgccttatttcaccaactgaactagaaactcaatagaggcttatataagagtagatgtcttctatatctccctattacccacagtgtctagcttaataatttggacctaatatagttaaccttgtaacaccatattataactataaaatcaagaatgtttccaaaagtaaaacataagaactggcttcattactttataaccacacagaatgtaattttactacttatttatgttaatatatggcacgccagtcctttaagatgtgaatacaaatacagttataatttatagcttccaaatcataaagccattatcagtcttcttaaaagtttttaagaactcacaaatcacaatagtagtttagctctgtaagctttaaaacccaaaatattacctgatcttcaacctcccttgaatcaaaaaagatgacattggcacaacatctaagctatcattttatcttactaaaaacgaagcagttgaggcctggtgcagtggctcaggcctataataccaagactttgggaagccgaggtgggcggatcacttgaggccaggagtttgagaccagcctagccaacatggtgaaaccccgtctctactaaaaatacaaaaattgccaggtatggtggcaggtgcctgtaatcccacctactcaggaggctgaggcaggagaatcactggaactcaggaggcggaggtcgcagtgagccgagatcacaccaccacactccagcccaggtgacagagcaagactttgtctcaaaaacaaaacaaaacaaaaacaaaaattaagcagctgaacaaaatgtcatcagcagcatgtattataaaaaatatattcataagactccacctcctgttaaaaccattcaaggtagctaacagttctactctaagcctcaacttcctactatttttcataatgcaagcttacattcttaaatttgctcttgcagcctacctttcatcaaacttaatagccacctcaagcactacgtttaacggagcatgtctaccacctaggaaccgagtagaggagtacttggtggtcaatttcctaaaagcataacgatttcctatgaagttgcttaaatcaacagcaggaaactagagttgatttaatgcatttcaaaatggtggacggctatgaagtaatacaagttataccttaaataatttagaaaacaagtataaatttgaaattacatccttttattctgaaacagtatttctctgactttaatgtgcccacaaatcaactgggcctttggttggtcaactgactgattcagaaggcaaggatggggcctgagattctgcatttctatccttctccctggtgataccaatccttttggtccatgggccaccttggattagcaaagatgcggcaaagagctttgagaaacacctgtccagttgaccagatcaaaaacaacagtggctgtcagggctgactgctttcacatccaatggtaccttttttttttttgagacgaagtcttgctctatcccccaggctggagtgtaatggcgcaatcttggctcactgcaacctccccctcccgtgttcaaacaattctctgcctcagcctcctgagtagctgggattacaggtgcccaccaccacgcccagctaattttttgtgtttttagtagaggcaaggtttcaccatcttggccaggctggtcttgaactcctgtccttgtgatctacacacctcggccttccaaagtgctgggattacaggcgtgagccaccacgcctggccggtaccatttcttaaagtagatacagactttctctacatttggactcttaatttatgcttttgaatgctgctctcaagacagctcatattttgcatctagaaaataactggaaatgcagagaatgttgtttccataccacttcggcttattccttccacgtggagggagtttaatttgtataacactcctggcttttgactcactccatccaggagaagtgaagtgacttagtggatttttgtaaatttagtgagaattagctgcacaaacccagaatggcccgacctctttttttctcttgggaatgagctgcccaccagagccaggacgacggtgcactgagggagatactcgctggaggcactaaggcaacaggattaacagtaccctacccagcctggagccccaggcaaagggaaacacaagtaactgtggctggctggttatctaactcatctcctcttctttctagcacacagatattatgtttctatgtgttttgcaggtaatgctgtgtgttccagacagcagaatgtgagtggacatcatatgtaccacctctgggcctggaccatagaactcacacataatccttcatgttcttatgtgaccacacagatgaacaaagcaagccaagtgtggaaacgtgttaaagatgacggaaccacaagatggaacaagcctggatccctgaatccctccttggaggattagtgcccacaaattgtaaacagccacccagatctcagcgagcaagaaataaattatacctgaatgttttaaagggttttttggtggggaaagaacagtgatgatagatattcttaaatactgtaactactttgaaagaagagaacaacagttaagaactatgtcattttagtcatcttttgttttgtcaaaacaaagatgttacaggcctgtgcttgtttaatatgaaaaaactctatgatctacaaatccttggggatacagagaatcagggtagctggtgacatctgacctatcctcttactcactgatattgttcagaaatccaagctaagaggttctaaaatagcagggaaaaatggtaatttctatgcacttgcatttttatgaaagaaaactgcaaaaaaaaaaaaaaggtaatttctatgtacctgcaattttatgaaagaaaacccattaaacaatagtttataataatgcatcccctacacactgaacaatttccctgttcctgtttcatctttatatcttccccaggtctgcttcttttaagacgtcttcacacgttaatctagtccaagggctggcaagccatttctgaaaaaggccaatataaaatatcttaggctttacaggatgtgcggtctgtgctgcatttattcaagtctgctgttgtagaatcaaagacgccacagacgatatggaaatgaacaagcgcaactgcatcccagtaaaatgatttacaaaaaagaggcagtgggccagacttggccgtggactgtagcttgctgacccctgaactagtctatgccctaatcccgtggtccccaacctttttggcaccagggactggtttcatgggagacaacttttctgcggaccaggaggagggggaggattcaagcatattatgattactgtacactttatttctattagtattacattgtaatacataatcaaataattatataactcatcataacgtagaatcagtgggagccctcagtttgttttcctgtaagtagacagtcccatctggaagtgatgggagacagtgacagatcattaggcattagattctcataagtagctcgcaacctagatacctcgcatgcacagttcacaatagggttcacactcccaggagaatctgatgctgtcgctaacatgacaggaggtggagctcaggcactaatgcaagcgatggggagtggctgtgaacacagacgaagctttgccccctcgcctgaagcctacctcctgctgtgcagccctgttcctaacaggccacagcccaggaattggggaaccttgccgtgatgaatcaaaactagctgtcattggctgggcatggtggctcatgcctgtaatcccagcactttgggaggccgaggcaggcagataacctgaggtcaggagttcaagaccagccttgcaaaactctttctctacaaaatatacaaaaattagccaggcgtggtggtgtgcacctgtaatctcagctactagggaggctgaggcagaagaatcacttgaacccagaggcacaagttgcagtgagctgagattatgccactgcactccagcctaggaaacagagcaagactctgtctcaaaaaaaaaaaaaaaagactagctgtcatctatacttcaccatcattaaaatacagacaccacacacacacacacacacacacacacacacacacacacaaatgcacacacaatttttttggttttatttttatttcttggctctttcagagacaggtcaactcaattcaaggacagtatactctcaattttctcgtaaagtccattactacatctcttcataaaaataaccactcacaaaatcaggtaccatagggcttctaaattacctaacaacaaacagaaatagcaccaaaaattggttcttacttttcacaaatcctctccactaattatcatttaagatatcatttactatatgaaattatatactttacatactataaattatacactacaaattaagagacctttatgctagcattagtttacctttgtttaaataaaaaagcttaattgtcactttagaggcattttaagactggttgacactgggtgccgatttagtgaatttttgtcaccaagttcaagtttgctacagctgtcaaagatcataaaactgaaagcatacggtattagcaaaaacaagtcttatcagtatccatgcaattttaaaaagaacagaaacttggcaactaatgggtaattaaatgtctgcagaccatcacatgtgagtacacccagtacacaagtaatcatcatccttaatgagaatgagaaaatgtttaattcccactcatgccaaaggccacatacaagtctccttcctccatgagatctcctcctactactcaacatggctatcttttttcaagtttaataggcaaacctctctcagcacttgactggaataactgttgcaccatttgggagttatttttcttttagacatttgcagatcttatctgaaggtgactaagagcccagagttaagtatttgtgaggcaatctatgcgaactctgaacttacctagttggcttatatgaaatttgtagaacgcatggcaggagcctgtgtaagaaagtattgtcctggttttctggtggtttgttgttgttgtggggtctgagaatgtacagccaacccctcttttataacagagaattgattttgatacatattttaaaatatgatagtgcagagttaatggatgttaaaattttattttcttgttttggtaggtagattgaattgagaatcatataatcagtatatctgagaattgtatgaccagtatattttaaaatatgatctttcttttaatcatattttaaagtatgatagtgcagagttaatggatgttaaaattttattttcttcttttagtaggtagactgaattgacaatcatatgatcagtatatttgagaattatatgaccagtatataataagactggcacaaccatttgccatcttttcctgttatcatcacatagtgtgggtggggagaatgaatggaaatcactccagaataatgacaaatggtttttaaaactctatgctgaatacattccagctgataatgaccgacttttcttttttcactttggtgatatcatcctcagggtaaaaaaaaaaaaaaaaaaaaaaaaggcatttataaaaaacagtttcataaatcttttagttataaacaggaaagttttatattatgtgtcatttcatttctagactgttgatgatgatgataaggaatttggggccaattttgatatatgaatgtattgtttttccatgtggtgattaaagcttccattagcagtttaaaaaaaaagagtgagaggaggtaaaaggggctgggtacagtggctcatagctgtaatcccaaaacattaggagtccaaggcaggaggattgcttgaggcctggagtttgagactagcctgggcaacacagcaaaaccccatctctttaaaaaaaaaaaaaaatcaaccaggcatgggggtgcacacctatggtcccagctactctgaaggctgagggcaggaggactgcctgagcccaggatttcgaggttacagtgagccatgatcacgctactgcactccagcctgggtgatagagcaagaccctgtctcttaaaaaaaaaaaaaaaaaacggtgtgaaagagactgaagtgcagcaagatgctccaagtttgggggttggggaacatgaagataaagagccaacggtttggtcagctcaagagtttggcttctactctgagagcaatgggagtctgccaaaggagttatgatggagactgatgcttcgaattggctaaaggtggaagatgtcctagtgaggagagactagacgcacgaaactgctagggcagatgggaactcctggcagtggcagcacgaggcaaaggagaggacaagccagacacgcttaaaaggccactgctgtgtcctctgccctgagcagcagagaggctggcacacaatatgtgcccaatacaggtctgttgaattaaacattattttaaaagactacttcacttacattaatatttaaagaaggaagccacagcagatagtatcagagagctgtataaataatgtatcacattctagagagatacacgaaggatttacgctttgagtataaactaggagagttttataatgttctctcttctctttcttcaaataaactaatatgtgagctcaggatattaattcaggattttccagggtcttgaaggtcttttactcaatccaaaataaataaaagagaggttcaaaacatgaataagagatctgggttaaaatgaataatttattaagcatagagacagatactagtttaattatccaaggaaaactaatttgcttctttctaaaacacacacatttaagactttttaaaagaaaatcatatacaacaaagaaagctatgagagaaactctgtttatgccatggtaaaaaaaaaaaattaaaatgacctcaacaaaaatatatcaccccctttccctacccaccctcaaagccacatgaggtttgtatttaaaatatctttaagagcctttttgcagcaattagaacatttttatacaaacagtcaaaaattatcaagtgacttataagaagatagaagtctcctacctccaaaacaaaaaacaaaaacaaaaaaccattacaagaccaccagcagagaagagagagtcctggtgggcagacagcattccaaagtcctctaaaactgatatcaacacaccagaaaagtcaaagaatctcccaaaaaatcatgtttacaccaataaagattaaacaattaatggtattttgtttacacttctggagttttcgggggatttttgtttttgtttttttaatatggttacaatttaaatgggcattggagtggaaaactgacttactcagtcaatagcacagtatagtcagtttgtcttagataactcacactatgcaattaaaaagcctctgcttgggggtggaggagcaagcccctagctggtgatagcaaagacagcaccccgaaggagaagctcccagcaaagcctgcgggaagtataaagattccagacaaaatcaattcactgacctgctaaggttcaagaattctgattcctcaagttcattccaaaaaatgcttttattccttttttttttttttttttggctcaacaacttcctaaaacctccaaaccagcatgtggaagaccttacacattcacaaactcttaaaactgcatttctgaaggcttagtcagtaatttttttttttttttttttgagacagagtctcgctctgtcgcccaggctggagtgcagtggcgcgatctcggctcactgcaagctccgcctcccgggttcacgccattctcctgcctcagcctccccagtagctgggactacaggcgcccgccaccacgcccagataattttttgtatttttagtagagacgggatttcaccgcgttagccaggatggtctcgatctcctgacctcgtgatccacccgcctcggcctcccaaagtgctgggattacaggcgtgagccacccgcgcccggcccttagtcagtaatcttaataaggaaaatggtttaacattttcagggcatcctatattctttaaacatatcataaaagcagcagaaataacaaagttgtgtttccctcaatcctcatctcttgctgtgaagacgacatgaaagccaaattaaaatgctcagatcattttaaatcataagcactcaagcagtttcagttttcttctctctctgacccactgccacactctttgcttacacacacacacacacacacacacacacacacacacacacacacacggggggggttgggggggaagcactacagtcagaatcacaatgcaaaagtgagaaataagcaaggttctagacacttcagatgacatataaagtatataatacataataatttcctgccgcactccatacaattgttggtgtaaccataaaataaccacagtcatttgtaataatatacaacatttttacatgttgcttaatgagagtttttgtacttgatattttaacccaaagcagagccctgcatttgattattatcctttacaaaaagtacataaggggatactcacttttctgcataatcatcttagcattttcaaacgttctagaatttagcctgaagtaggggtaatctaataaagtatgataaataccacaaacaaaatataagcaggtggaaagcatctaagatttaaagagcagcttcaaaaaaaaatcccttttgaaacttgagtggttttaatttaaatgccccaaatcaaccataccaagctaacttacctatattcctcagaatatcaaaaccaactgctatcaacttaagcaagagatgtcttattcgagttatctgtccaaacaaaattttttaatgcctttggttgcacctcagagactgtctttttcatggagcaatgcagaaactgcaaccagactacaggaaatacaaacaccagaccgtacaatgaagcctctctggggactatgattattcaaagacagttcagccttgcagcagtaatagggctgagtgtaacgacttttttattcttccaaactaaagaattttccttggactctctgccaatgaaacatcacagacttttctgaggctttacaggcagaaaacttgtacgcagatgtttcttggttatactgtacacatcacttgcaataaaactgtaaacaaacaaaaacatgacaagttctttaagcaattttcagatcatctctgaaaacagaaggcacttttgcctgtcagattaaatcagcattcactgtggctgggtgactgcttctggattaaagaaactggaatattccagtgatttggataatgaaaaagaaaaaaagttttaaaggtaagatgttaagtatgcatctataatataattggaatttagatgtaaggaataacctacattaatctggctacaattgtacttctcactcccttgactaattacctataccaataagttcttaggagtgttatatcctttaaacttaggaacttcagactgctcaaaaattatcaagttaataataaataaaataatctgtgtaaggaaaagttcctgaaagatacataccttctcattagcagtggttcaccatctcaggtcaatgatgaggaaggggaggcagggggctgcactgtaagtttactttatacatttatataattatttaaatatttgtaattacttttggaattttgaatatcaaaacaaaataaatttatgctccaatggaatcaaatacatgcttcatgcaatgaagttttcaaatcaacgtttctttcacagacattgcaattaaaagatctgcaaatcttttattcagaatcttgggccagcgtatctgctctcagcaatgtgaataactagtgtcatcaaagctgttactttacaaaatagtcagtgtagtccctaaataaatgtctttcaaattccaacaacagattgtctgaatcagacacctgaaatgcatgccaagaagtcttgcaagcaggcagtctacgcatgaaaacaaaccctatgatagattctcttgaaattaaatacaactcttacaacaaagacaattttactattttccgataaacagggtccactcatggaaaagagatcgactaacatggataattcatcgtccagtgtttacagtggctgagttcatttaacccaatctactagttctgtatgtgagaaaactgagatctagagaaaagaagttacgatttctactagtgtctactgcataactctatgagtcaccattcacaccacattctatggacagaaacttcactggtccatttacattaaagatgatggccatggtggcccagaattgtgcagggtagtggcctggatgacttttaagatgacacaatgatttagaagcagaatcaggatcagaattatctccttcctctcctttagtttaccatcatcttgcctcataaatgtatgaaagaaagcaaaatacaagtgcatttaggataaaactctaatttttatccttgaaatggcatgaatactgcagactaatcctaccttcagaacatcgtatgtattaaaaggaatgcctatagaaactagacacacatgtacaaaacaaaataactgaaacatttaaagatgtcctacaccattatactatattaaatactttgtgtcccaaagctacaggtgaaaacaagaataaatatttcactcgcattatccaaacttgaatccctattgttttcaatatccctactgactgtaccacagaggatttaaagagattcataattatgactgtcatattatatctgctaaaacataattatctggtcctgcttcccagtagaagaggccagtgtactctctactgatgtcataccaaggaagcacttatggctacaatcactgatgtcaattaacataagaaaccagtacattcagtactctagtaggttgttgcaaagcagattaagttttcctacaaagagaaactaggcccaaaaccagacaaagtatgttcaacttcttcttataacccactatcattcaatgttagagaaaatctaggcactaagtaaaagcatttcagatcatcactttgtaaacagccagagtagttcttctaatttctgaaacaatcacctgtaattcagcaccaaaaaaacacacaaaggaataaaaggtaaggaaaaaccatatgaacataaggtgcccttgaaaagtactggcatggaaaagacttgaagattatataacaagactaatccatattagagaatcaaaaggagattaaactcccaaagatacgttcagaagaaaaactactatgaactaaattatccttcctttccatattgttcatgcaatatacacacatgcacaactttcccccactttcacctagttgggatgagatgttaatttaggctgaaggactattatttctctttactcctgttatgccagagaggatccaagaggaaaaaagatatacagtaaaataaaaagattaggaatcagagccccaaggaaaataaaagactgtattaaacatcactgcaaatcaatgtctctgaaccgaattttttaaatattttgcaacgtctcagatcaccatacgtagtgcaggagcaggggaagagtcttcaagagtcatgctagccacactgtcattagaggtggcctagagatgctctggggttacctgaaacaagccaaaaagcccagtgtctatatcaatggctttcctacataaaggcaaatctagggtaagatacctcactttgatgtatatgttactatgttttctgttgctacaccatagactgggtaacttataagccatcaaagttcatttagctcagggttctgcaggcttagagtccaagaacacaaaactggtgtctggtaaggaccatcttgctgtgtcataacatggagaagggcatcacatagtgagacagtaagagcctgccagctcaggtctctcttcttaggaagccaccagtcccatcatggggtccacacctgatgaaattatctaaatctaattacctcccaaagactccacctccaaacatataaaatttgggagtcacattcaaatcatagcaatggagcaccaaaatcccacagggtctttccaggaagaactcttgacatgtccctcatcactcctgtctatgtcaaccagcttggacacagatctacacatgcatggatcaatgactagcatttctgaggtggaagccagggcccacagcacactatataaaaataagactaggaggcacacctaaccattccaacgtccatgttcttccccactgtgcagccctcacatctacattctctcctttagctccctcacctcattatatgaccttaacaatcctgctggtaaaggcagtccccaacccacaagcatataatcttccaaagtttgcctggagatttatttaacttaaagctcgttttcctagataaacgctactaacagcatttctctcttaatagcattctgttaagaagctcccaggctggcctccaatctgaaacccatttaaaccacaatgcagctactactagtttgggaaaacactagcccttcacatctgcataaacgccaaacagctgaacaccagttaggactttgtttccatgtgtctaaaagaaacaaaggtgttgcttttcctacttgattctggctagtaccacctcagtctcaaatcagaagaggataaggactggggaagaaaatgaaagtaagtttacccctttctaaaatgtgaagaaaaggaagcggaggtgatgccaccaggcattggggtgaatctcatgagaagatgctcaacatcattagtctttagcgagatgcaaatcaaaaccacaatcagataccacttcatactcgttaggacacctatgatcaaaatgctggtgaggatatggagaaattggaacccccttgcgttgctggtggaaatgtcaagtggtgcagcagctatggaaaacaattctgtggttcctccaagagataaacatagaattgccatatgatcaagcattccactcttatacccccaaaagcagaaaatagagactccaagaaatctgtacatccatgttcacagcagcagtatttacaataaccaaaaagtggacaccatcaaaggtgtcagtggccaccactgacagatgagtggataaacaaaatgtgatctatacatacagtggaatattattcagccataaaaaagaatgaaattctgttacatgctgcaacatggctgaaccctgaaaatattataagtaaaaaaaaaaaaaaaaaaaaaaccagaaaaggacaaatattggatgattccacttacataaagcacctggagtagtcaaatgaatagagacagaaagtcaattcgaggttaccaggggctggggcaggggaacatggggagctattgttaaatgggtacagtttctgtgtgggatgatgaacaagttctgaaaatactggtgatagttacacaactttgtgaatgtactttatgccactgaaccgtacactcaaaaatggttgaaaacgtaaatttcatgttatatatattttaccataattttttttttaaagcaacaccacaaattagaagagtcagagctaatggcttcacctttggatacctcaaccttcccaatctacagaataggagaaaaataccgtaccacctccgggatcctgaaacttcaggctgcatcatgagtatctgagacctcaaatgctaaatcctcaaatgtaaagggtctacacgacagcatgcatcacgccctacacacctgccaggtggaagcttttctaagctagatggtcgcacagaaagcagccatgtgtacatatgaacaagtttcctaagtttgcaagttctttgttaaaatcttcaatgaaattctcactctattaacttaactatcataaaagagacattatatcatagaagagtaaaattatcatagtaaccacagcaagtatgctgacaaagatgttttcgatgtagctgtttagaataaattactaggacaaacatctggacccatggccaccaggcactgggcaaacagagctcaggtacagtctcctggtgaggcagcctggccaacctgggttaccccagtgggggcctaaaaataaaagtgacaagacacacagcccgatactgagtcgcatgactacgcaggcatttcagagtgaagtcaaggtgcttaggttcctactgggccgccaagccattcagcatcagcgccggtcccatctgcaggcaaagaatgacacaactacctcttcatggaatattcccagtcaaagcccacttaataacgaggtccttctgcagggttaaacaaacctcagttagaatgcagcatggtgctgagtggtctttcaaacttgcttgtatttacagtcagccaactgcagattgaacatagtcgggagaaaaaaaaacaacaatacaaaatacactataacataactagtataaatgtatttacatagcacttacattaggtattaaaagtaacctagagatggtttacagtctatggaaggatgtgtttttatatgcaaagactacaatattttatataacgaacttaggcattctcagattttggtattgacggtgggggcgggggtgatcctggtaacaatccctgcagagacctacagacaatacacagaagtctcacatacgaggcccagtgcagtcaggcctgtaatcccagcattttgggatgccaaggtgggcggatcacctgagctcaggagttcaccagcctggccaacgtggtgaaaccccgtctctaccaaaaatacaaaaatgagctgggcattgtggcacatgtctgtagtcccagctacttgggaggctgaggcagcagaatcacttgaactcgggaggtggaggttgtagtgaggtgagactgcaccacggcactccagcctgggtgactgagtgagactctgtctcaaaaaaaaaaaaaaaaaaaaaaaaaaaaatctcagatacaaggcttacataaagaaagcattcaataaatgttgactgtaaattagattttccttgctattaaacattactcataggtgacgatgagtgatatttaatcactattaacaactgttttcctatctaaatacaaatttaaggaaatatatgcgtaatactccctgggctctctcctcttttaagacctaattgtaattgcgctttcggagagcaatttcaacagctgtaagacttgatttcatgatatcttacttaaaatggaaaacctgggtgtgggcttagtccacaacaaccccctttctctgaacacagcccctcctactcactgaggtgggttccactaaatgaactagtgaattagccctcgtgcagacacttaagtctaacagtatgcaattttcccacccccagcatttggatttgaaacaggtggctatggccgggcactgtggctcatgcttgtaaccccagcactttgggaggtcaaggtggttggatcacctgaggtcatgagttcgagaccagcctggccaacgtggcaaaactccatctctactaaaagtacaaaaaaaattagccagacatggtggcgcacaccggtaatcccagctacttggaggctgaggcaagagaatcgcttgaacccaggaggcagaggctgcagtgagttgagatcacaccactgtactccagcttgggtgacagagggagacactgtctcaaaaaaagaaaaagaaaaaaaaaaaaaaagatgtcaggcacagtgtgtccctggaactaaataacataaatccaggcgctgtgcatcagccaccttctccacacacccaaaagcagagaaagcaaatctctacagagacgtggatgggaccaacataccaaggggagcagaaatgaaaaacagtgaaggttagattgcctcactgacttggttcctgagaacctgccagacactaagttcttagaaggactccatatccttatcacacccatccagtttttgtccctatttgcttgaatttttatgactttccattaagagtctcaagaaaactatcgtcagaaatttattataggaaatatttcagcagattttcagtatattttccacatctgtgaagacttagaaatgatgaaaatgttgacaagaaggaattagaaaaccacagtacagtgattcaataaaatgcaactatttataaattatgcagtttacaaaactaggaaaaatatttttgtgttttatgattcctgctatgtaaaatatgtagaaaaagcaacacaggaaaacaaaaacagatgtgggtgggggtatggagctgtgggtcactgatgccattttattatcttgcctgtgttattaaactaggaagaaaaatctaattgccaaaaacttgaaataacccaaatgtccatcacgggtagattatttttttttaattgtggtacattcatctgatgaaataccactccacaacagaaaggtaaaccattgatacacaaaccacacagatgtatctcaaacacatacgctaagcaaaagacgtcacacacaaaagtctccatactctataactccatttatataatattctggaaaggcaaatctaagggaacaggattggtgtttgtctaagaatgggcaaagactgaaaggggcacaaggaaactttgaaataatgaaaatctattttgctgagtgtggttggtggttgcacagctacaggtgtttgtcaaaattcattgtactatacacccgaaaagtgcaaattctgctatatgtaaattatacctcaataaaccagacttaaagaggagggcaggtgtggtggctcacgcctgtaatcccagcactttggagggaggaggcaggcggatcccttgagcccaggagttctagagctgcacggtgaaaccctgtctctaccaaaaaatccaaaaattagccaggtgtggtggtgggtgcctgtagtcccagctacttgggaggctgaagtgggaggatcgtttgggccctggagggggaggttgcagtgagctgagatagcaccactgcattccagcctgggtggccgagtaagactctatctccaaaaatatataaaaataaaaataaagaagacactgagctcagacaccaaaccaaagctactgaggcacctgtaaggtgtctgttttataatattggatgacattcatcattcatcaaatgtactgagtgcccatctaatgccaaatgctctgctatgagctagtacagagtgaacaaaatagacaaaaaaatagacacaactatacaaacaaactacaggtcacataggaaagcatggatgctctgattgctattacgggattaggggtcaaggaaggcctctctgaacaagtcacacaagcttagaccccaggaataagtagtaggtaaggaggcagagactggaaaggtttctaaatgtgtcattacagcagtagttaacagcaactcaactgtttcaacatgtgacgggtggttacagtttactattttgctgtgataaggattatggcctcctacataagaagccctagtaaatgaaggttttaaaacagcctaaagacagtgaccaggagacgtaatgatgtgttttggatttcagggaccatcaaggagtacgttcctccaatccttgtcaatatttcaaaaatgatcaacacatgtatgtatttccctgaaatgaggttgcctatgggtaaactaaaacccatgttctggtgtttaaaagatttgttgtatttgttcttacttctggctgaatttgccattatttatttaacaaggtttcctgaagcttatcaacgtttctaaatgataatgacactcactcactctctctctcaccaaaaattggaaaaaatggtcccagtttgacaaatcgaaacctcttcacaatacgggaatcaaccttaaagaaggcccccttcacttggcttcagaggccctactctatcttggttttcctcctaaactcacagacttctctttggcaaatgcctctaagagattcttctttgatcaacatccaagtgttggagggggggcgggggcagccccttattccttctcttccttcactcactcttgtttcaaatacactccgataacaattcccacatactcatctctagcactgatctttccccaaagctccaggtttgaattctcaactgtcaatgtgacatctccacttacatgtttaacaggaatctctgacatgggttggatgtgtgtcccctccaaatctcatgttgaaatgtgatccccagtggttgaggtggggcctggtgggagatgactgggttatgggggtggatccctcatgaatggcttggggctgtccacaagagggagtcagttcttgcaacatctggttgttgaaactgtgtggcagcggactctgggcacacttcctatggctttgccctgctccacaagggacagccaaaaaaaaaagtgtggtacctcccccgtccccttgctcttgctctcaccatgtgacatgacagattcctgctgccttctgccatgattggaagctgcctgcggcctcatcagaagcacatgccagcaacatgcttcctgcacaaccatgagccaattaaacctcttttctttatacattacccagcctcgggtatttcaatctagcaatgcaagaacagtctgatacaatctcaagcttcaagtctaaaagggaactctgggcttccagacccctgcccatttccttcttgtcctagtgttcctggttttcaacaaaagacaccatgaatatacctcaagccaaaaacctaggagtcagcaataatctgcctctttccctctctccccagtagcaactccgacaggcactgccttcaaaatacatttcaaaagcaagcattcctcaccttcactattatcccaggtccaagccaccactgtctctctctgggactactaactggtcaaatcatgagcctctgcctccttacaatatattctcaaaacagcaaccagagtcatccttctgaattgtactcagttcctgccattcctcagtccaagccttctaatggcctcctatcacatctaatacaaaaaagggacccagtgacctaagacaataattagcaacagactaacctttatgcaaaaggtgacgtgaggcatcatcgaaggtaagggagtgctcactgccatgacaaatcagatgacacagcttacacttcatagtcaatcctgaggggctgtggaagaatctaggaaactcaatgacatttcacccctaaatcaacaggtgtgcaaacagaattatcctcttatctaatcagatctccataagtaccctgaaggcttcaaggaataagagtgtgcctgtttttgaccacggattatttacttgcacaacttctcaagtgatctgtttccacctaaaatggaacaaaggagtctctaaaagaaatactacgtttcaaatatctcatagccaatcagcaaacaactaccattctgaaaagattttgtctgaatttccaatcaaagtttcttccagcccatatgacttcaacatacaatttgtaccacattgtaaccaaagagttattagtaagaatgttaaataatcctcccctaaatttcaacttaaaatgtgtagtctttgtttaaatggcctgttgtctgcaagttttgaaacaaggcttcactttgtgttcaaaggcagtataaggaaacaagacatgttactgtttcgattcctctgaatgacagtgattaatattaaacacaagagtttcttacaaattagaattatccagaaacatatcccagtaagcctagcctcataaaatgactaacttcaatatttactttcatttctaaaattttttaaatcaaccactaagactttaacctccccctacacacgccaagaagaaatgctggctctcccctgcactggccacacctgtctttagacagcacccctttcctgctcgacggcctcctgcccccatcatgtgatcaacctctggcatcaggaaggcagtggtggctctgtgccatgaggtccctctttgtaggctgtggctatttttgggctggcagcccctctgattcctgacttggccctagataatcatgaggccgcctttagagagaaacccttcagaagccaggcaggtccctgtgggattagcaacactccactgctaacacagcaagtctcaggtcctaagtgctataaaggccctccaaggacagcgccctctaacctgatggccctcggttggccagacccaaggctgggctcccatttcaaatgggcaagtccgtggttttatggggctaacaaatcaaagctgacacagatatactactcatacatggattttagccaggaaatttcaaacaactcaatgatgggatttttttccccccttaaatgtcatgtccattcataacagtgagatttcagatgtgtgtaacagctttgggaaaaggtattgataaaaatattcaaagaaaatgttagtcacttttcaaaaaaagcacagcataccaagatgatgtagtaagttaaatattcccttgtgctatttatagacataaccatatactgtatcatttctaattggaaaaggtctaccagagatactatacacctgatcctaaaactatacattatcttctgctacgcctctaggaaacaagactataataacttgaattttaagaactacaaattcaagataaatatttgattggtttttccatctcactattaaaatgaagcataagaccctcaaattaggtttaaatgttttaacagtgaagttttatgggagagtacatccaaaaatacagagaaaatacatttatgtatttcatatcacacctttcctccaaggccatcatgacatcaaaactgatcccttttctttatccctaacttggattttgtaaagaattgtaacatcttttctgaaaccacaagtctacagtgtaaaaaatgtttcattcccaggtttctactggcaacattaaatgaagaccttatgaaacctggccgggcatggtagctcacacctataatcccagcactttgggagacagaggtgggtggatcacctgaagtcaggagttcgggaccagcctggccaacatggtgaaaccccacctttactaaaaatacaaaaattagccgggtgtggtagtgggcgcctgtaatcccagctactcaggaggctgaggcaggagaatcgcttaaacctgggaggcggagtttgcagtgagccaagatcgtgccattgcactccaacctgggcgaagagagtgaaattctgtctcaaaacaaacaaacaaacacacacacgcccttaagaacgcaatgaggataacatgttggcccttgtatttgagaaggcaacctggcttgactctgagctacagctccaagaaataaagacgatttgctcactggtcctagctctgacaataagcacctgcccagtgaagtctctggctgtgaaggtgagtgaggtgttctctccattccatccattctggagttggaattttccaaacactgctaaaggtgggggtgtgccaggaaaacaaaggaacacaacatggaccagccaagttccctctcttgccctcataagcagaacaaagtctcagcactccaggactggccgctatttgcctttcttagatgggagtgtaggaagagggagcataccaggccttagaatctgtcctcactagacatggaggaggagatgatgtaattttttttttaaataaaaagatatgcaatgcgcatgctgttgtgctatgagaagaatgtggaaattcacaagttgggcattgtttagctttgtatccctgtggctactgtgttcaactcagcctgaggctccatgaagacggtccttgagtctgacttccaagggcctgacagcctattggtgacagcctttacaatcactggtatctgaagctcaagcaagacagacaccaactaagtacccccagcagtaatttctcaaaaaacaattcagtaacatgcagactccatccttaacggcaatctgaggctctgctgtggtcaacaaataccactgacagtggcccggaccaccactccaattcccaaagacctatgggccccgatgacatgaaggtcactcagagcttaaaggcagagatgaatgcaatgaagatttccactgaaagatggcagagaaatgttctacccacactcacccaattgagatttgtggaattcaacagcccccaaacgttttaaaagcaaataattcagtatccattcatgcctttctccaaatgatttcaactcttcataaagtaatcataagttaaataaaataacatctctccttttgatactaacttcctatagcttagccgttataggcaaaatggcagtgtggtttaactgaatccacatttacagttgagaatactcctactccctgctgttacatcagtgtaagatgttttagttggcaatctaaaccctgctaattttcttacaactgtttttttttttttttttgagatggaatttcactcttgttgcccaggctagagtgcaatgtcgccatctcggctcactgcaacctccacctcccacattgaagtgattctccagcctcagcctctcaggtagctgggattacaggtgcgcaccaccatgcccggctaattctgtatttttagtggagatgaagtatcaccatattggccaggctggttttgaactcctaatctcaggtgatctgcctgcctcggcctcccaaagtattgggattacaggcatgagccaccatattaagagactttcaagaatgaaatgatccctgtgtaatttttacgattgagttccaactggctacaaagagaggaatgtatacaatagcatgcagaacagtctccgagaagttccgtggctacagaatgggggcatttctcacaccactctgtcagcttccttatccctgttacagagtgacctttttataacaagaagaactttttttttttttgacacagaggcttgctctatcacccaggctggagtacagtggtgcaatcttggctcactgcaacctccgcctcccggcttcaagtgattctcgggcctcagctgcctgagtagctgggattataagtgtgcaccaccatgtccggctaatttttgtattttttgtagaaacggggtttcaccatgttggccaggctggtcttgaactcctggcctcaagtgatccacctgcctcggcctcccaaagtgctgggattacaggtgtgatccactgcgccccacctataacaagaacttttattcatgcaacaaacattcctaggtcctctatcacatgcagcttctttgctaggtgatggggacacaatgctgaacaagatggtcccagccttcaaagagcctccaaagagcctccagttcagccaggaagacaaaaatgtacaagtaaataattacaaaaactgcaaaggtagaagcgactggaggctaaagggacccagagaataggctccactgttacagatatggagaaaacagtgaaatgtcacttccagaagaagataaagcttgagctgagactaaggcataggcaggtgagtgcttctcagcctttcagattttatggacctgtgacatccacactccaaaactctgcagagacagcatggggatgtcagctttaattttgccaagaggggcacttcagacaaaatttgtacgactgccaacacatcataaaaggacattattttaatacaaaaagtgaaaggggtacaaaactgcagcataaagaacattcctttagtttacgtaatatacatttagccttatgaaaatcttggtacactgtatttttattccatctcaccgtgttcaagtcaacattctgtcaccaggtaccccagggtcacagatgcacatttggaacctctgatctagatgacaaaggcagatctggagggcagtttctcacctctgcaaagatcaaagcaacagaccaggagagaaagaaatacaccaagggaagtactgagagggccgatggatcagcaaaggcctaaggccaggtaccatgggtcatgcctgtaatcacggcactttgggaggccaaaacaagagaatctattgaacccagttcaagaccagcccgggcgacacagtgagactctgtccctaaaaaatttaaaaattagccagccatggtggcacatgcccatagtcccagctactcaggaggctgacaccagaggatcacttcagcccagaagttagaggctgccgtgagccaagactgtgccaaagcactccagcctgggtgacagagcgagaccccatctctggaaaaaacaaacaaaaaaaagcagcttagaacacgtcaaggaaggtcagtgtattctgacccttcttgcaatggaagccacatcaccaacacacgcacgagcctaggacagaggcacccaaagaccaagcccgatgagttacttccgtagagaccagagaggtctggaaggcagtgcctggcagcagacagtcctcacccgctgccatgatgctaaaacctcctccaggacccaggcaccatctcagataaaagctcttcaaggacccaggcaccatctcagaagtgggtgagccgctgaggaaggaggaaatccatccttcagaggagagaagagcctcagataggaagcgtgaactgaccacacttaaaatcctcaaggagatatttatctgcaagcgactctttgaaaccaaaaaacactgagttatcttgaggttgccacattatatgttctctacaagtgaggtgaaatgaggatgtgtgaggcagttgggttataaagaaataaagttccatttggggtcacaatgtgaatgtgtaagtgtcccacctgcttccgtagttgagagactggctggggctggaagaaatggatccacccgagcggtatgaaggagctgggtttcatatgtgatattaagagttaaggtgctacgttaacaaccaacatttaacactgcaggggtagcgctttatcacaagagactttcgctcaggccacagtacatcagttcttcggatcccttatgaactcttccacctcaaaccagcatatactgttttgtatcacagctatacatttcagaaagaaaataaaagttgaatttttaaaaaagactctttcctagtacacttgacaagcattgtggagtgaggctgacctcattgctgaaaagcgatcggaagcttcaggacatcataagggctggtgagagaaagcgctgtgtaaacacagtgtttggcaaatccaaggactgccaaggaggggccaccgctccctgacaccctgtcaattccactgctccacgccaggccagcacagtttgtgaggccaggatgaggaacaggccacagcctccagcatgggtaaagataacgacatcagtgcacagctcttcaaagtccacagtgttcccacagtcatcctcccagtagacagtcccatgtgacagacaggtcacatgacagtcacattcccccatccctcctcctctgagatgctaaacctgatgtttccagaagttgagtaccttgctcaaaacacagagttaataaatagcagcaatggacattaaactctactccaatgtgtaatcttgatctatttccaccttccttctcacaataacgaaatcacctaaacacctggtaggtctgcacagctatggaccttatagccacctgatatgagaagcatacgtttatcaaggagctcctaaactgactcaggaactgggttacctgttacaagccaaaaatattcttcgcctcattttcctcatggacaaaaactgattcaacaatccatctcatagggtcgttttagagttaaataaaatttttggaaactttctaatacacaattgtacattgctactgttatgccaacaaccttgtaaaacaagccttattatcatcctcacttttctgatgaccaaagctcaatagtttattcatccagtcacgaagactttctggctgggcacagtggctcacactgtaatcccagcacttcgggaggccgaggcaggcggatcacctgagtaaggagttcaagaccagcctggccaacatggtgaaaccccacctgcactaaaaatacaaaaaattagctgggcgtggtggtgggtgcctgtaatcccagctactccggaggctgaagtaggagaatggctggaacccaggaggcagaggttgcagtgagccgagatcgtgcccttgcactccagcctgggcaacaagagcaaaactccatctcaaaaaaaaaaagacattctaaggtgatggacacattctgtatcttgattggtgtgatcgttacaccaatatgtatttgtcaaaactcatataattgcacacttaagccaggtgcactgcatttcatcacacttaatgttatctcaaaaattgtttcaaagatcatgtggtagtgaacagcagtgtgtattctgagacatattcatgaattcttattggaatctacagattttttccgcattctttttctgtaatctgcttgccaactaatccttcctacccaacagaaacccttaaatgttgacgatagctactagttaccgtttctgtctctttactcagaatttcatgttttactgttacatcctgaacatattcatctagaaccttccactgaagtaggtctctgtccacaacccagtagggtacgacagccacagactaaaccaccaccttgaaaagcaggctaggaaggatcatgtgccagctgcctgcagtcctaactcagccgacttctgagaatctcaactatatttctcaatctaagtcaacattccttcaacagtttattgaacaaaaataaaaagcacaattctaaatactcctcccagaggaaggaacaaaataaagcccttgctctcttagatatcacatcatattgtagatgattttcaaaattccatcagaaagtaacctttgtcatgaaaatcagtaaaaaagaacaagaggcaaaacagtaagtttcaggatagtactgggtccaaagtatttacttttatacaatgagctgtttgtatagaagtaaataattaaaagcaccatctacccccagggcttatcaaaggcactctcaaagactgtacagttatgctaaagaaatgatttgatgtacagactgtgcatgcttttagttgtctttttttttttttgagacggagtttcactcttattgcccaggctggaatgcaatggcacgatctcagctcaccacaacctccgcctcccaggttcaagcgattctcctgcctcagcctgaccagtagctaggattacaggaatgagccacctcacctggctacttttgtaattttagtagatacagggtttctccatttggtcaggctggtctccaactcccaatctcaggtgatctgcccgccttggcctcccaaagtgctgggattacaggtgtcagccactgcccccggccacttttagtttttaaattatatgcagttagtttttaaaaactacctaaaaggtagctcagactgtttgagggacgtgggggtagatcgcgtgggcagggcagagtttacagctgaaatataaaatctttaccccaaagtgttaaatgaccatgaacatttccttgtttagaaacttcagagttgtcctctctctccaaagtccacttggtgaaaaggaaataattttccatttgaatcacgccaacaccaaatggaaaatgtctttatgtgtgtgtagttacgcaagttggcacctcaccttatacctcccaacctttattaaacatcgacttcctgcacccttttcttgaaaatgattacctatgttaggctttctgctagcaagagttctttaacagaaggtgactgtatatacacatttaactcacagcagcagcccaacgatagccaacctccaaccagggcctatttatacagtcctaaccctatatattccttagaagacaatttggaaatagagaactgatgacttttagggctaaaaatcatgactgatattcagctgaaactgtggttttgtgagggcattcgtctcttcccagttctgacactggcctcacctcctacttcagtttccatctgggattacctccatttcctccactaattacctgccgctcagtagcttacaataaggaaacagaattcaagatttctacttttaaaaaaagtttcaactgggcacggtggctcacacctgtaatcccagcactttgggaggttgaggcaggtggatcacaagatcaggaaatcaagaccatcctggctaacatggtgaagccccacctctaataaaaatacaaaaaattagccagacatgatggcacacacctgtagtcccagctactcgggaggctgaggtaggagaactgcttgaacccgggaggcagaggttgccatgagccgagatgaagccattgcactccagcctgggtgacagagcaagattccctttcaaaaaaaaaaaaaaagtttcaggaaaaaaaatagtagttgctatccagcatataagaccacagactgctaatctatgaagtgagatacaaaaaatctaattattcaaatgattgtttctatacagttctattaggacttattgcaaaaagcagtctgaaagctataaagtcctatgtaagtggaattcatgattgtaatgatctctaactgtcaatttttcacttgtgctactaatctgaatggcttacaacatttaacattcggctttacgttctgtgattagaaaatgtgaaaataaaccgtaattctcagctatgtcatttgaaattttacatatcataactactgcatgacttggcctggcacagtggcttactcctataatcccagcacttcgggaggccaaggcaggtggatcacttgaggtcaagagttcgagaccagcgtggcctacatggtgaaactccatctctatcaaaaatacaaaaattagccgggcatgatggcaggcacctgtaatcccagctacccaggaagctgaggcaggagaatcgcttgaatccgggaggtggaggttgcagtcagccggatcgtaccactgcactccaacctgggtgacaaagcaaactatcggtgggggcggggagaagttttatcccatttcagcaccaatgtatagaaaatcctggcaacagaaacttattacttccactcgcattaaaactagtcaaataacagcatcatactgggtgtgggaaatggaccggtacaagtccagtcccagttccataacttactcgccataagacaaaacatttatccaaatagttctggtccccagtctccttcagtataaaagaaagcactcatgacctgctctgcccaaccgcagggctgatgtgatcagttcttaatatcatatttacaatgtgcttgccacaaacatagggaattaatatttcactatgcttaaaagatgaaaatacaaaattgcttttatatttaaatactgtatattaatagtaacattttacaattgaaactctaaaatacaaatattctggactatgttacaggtgaaaaatcagaacagggaaccttagtactgtaatatccacaagtccaagattagttcaaagtgatgactcaattgtctttcgaatgtgctgactgatagcaaagaggcaacataatttacagactttaccaaagataaaagtatctacattgattttttgaaaacacagttcaaatggagtatcagcagctcactagacttaaactttcaagaaaaacaagaggtgacaaagctggagtctgagaataaacaatctccaatgtttgctacaaatcaattcctcctaaggaagagggaaagttatcagcctcctgagcctagaatttaactcccaaccgacagcaccagcagatccaagcaacacctccaaggctaagcagcagaaattaaatgaaacacctatctatgaatcagaagatttaatttaaaactagagactaaggaaggttattagcacccattgatcattttctatatacctggcacctgtgtcagaataaccccaggagacaaggtactacccccaccttccagcgtcctgatgagccaactggggagcaaaggtaatgaaatttcactcaaggtcacatggctaataggaaaatctcagacatgaacccaattttgcctgttaagtctgtgcactctctatgacattactgcaccaaatgtcctggatacccattacatttttccaattctataataaagtatgtccccagggtttcataatggatgtcatggtgggcaaaatctagctaaatggtgaaatacctctatttattatttgaaattcaataaaaacaggaggaaggagagaagaaaagcagtccctagcactgaaggatggagggctaatcattcaagatcaaaacaactcacaccatataaggagaaaatagttttcatttgattatatatctacaaggttatacatttttaaatgttcagcctaataagctgtaaccagaactttccaacaaaatagtcttatctgcaatataaaatggtttaggttttctcatagaaacagaaatgtaggatttttcttacctcccttttcattaactgaccctactcttttaaattcaaattaagagtaagtaaatccctttgcagaggtgccatcaaaaacactataaagcaacatcagaaggctgggcatggtggcttacgcctgtaatcccagcactttggaaggacaaggtggacagatcgcctgaggccaggagattgccaccagcctggccaacatggggaaattctgtctctaccaaaaatacaaaaattatccaggcgcggtggcgcatacctgtagtgccaggtactcagaaggctatggcatgagaatcacttaaacctgggaggcggaggttgcagtgagccgagatcacaccactgtcctccagcctgtgacacagcaagactctgtctcaaaaaaaatctgaaagcaaaacaattttttaacccttaaacagaaaatacttcttcacagcattaaatcaagttcaataaccagcaagtctagagaactattgaaaagttttacataaatgcaaaactactctgaaacacaaatcttattagatgtaatgagaaaaaagaatcctagactgcaaagttatctgaattcctaagttgtacatacatttttctctaaacagaaaacagcccaagtccctagtcaaaagaaattgtcaacttgcgattgtctgcacgaatagggaatgtcataaatcatgagtggaatcaattacgtacatgtatttgcacatgggtatgccagatgttctcaaactgactcttcataataaaacagtaactcagaagcatcaggaaacttggcaccttccagctctgatgctctgctcccaaagccatggccgttcagtcggacacaagactgagggtaaactaccttccctctgcttgctgagtatgaaacaatggatgagggggtgagggcaagaggagagggcaaggagcaaggcacagaaaagcaataaggaaattaatacctgtggtttaaaagaccttccagtagctgtgactatctgacaaaagaatttcaaattcccatgccatcagagctctagatgatttattccagaccacatctgggagaaataattataaaagtaaaaatgtacccagcatccgaacatttagaccctatccttaaggagcttacaagatgtagcaaaaatatactggaaaaggtaactaaagattctcattgagagaaattaagagacgccaaagagtacagtgctaagtattttccttcttaatccttttggtgagaaggaaaagggtaagcatgattaatgacaaggatgctttatataaccaagaatgtcaatacaacctacgtgaccaaactttggtcaagtcagcaggtggaatttttaatgcaaagcccaacgttaacaacctgggagaatatttcgaacaacacaaacacttactaacatctccaaaactgcacttttcacaatgattggggtttctctgactcctccaagaaaagaggtcaaattcttttttttctcttctacctcagtgtttggcccatagaaagtgctcaaaaatggctgaggctgaggaaaaccaaacacaggccgggcacagtggctcacgtctgtagtcccagcactttgggaggccaaggccggtggatcacctgaggtcaggagttcgagaccagcctgatcaacatggtgaaaccctgtctctactaaaaataaaaaatgaagacgggcgtggtggtgcatgcctgtaatcccagctactcagaaagctgaggcaggagaatcgcttgaacccaggaggcggacactgcagtgagccaagatcacgccactgcactccagcctgggcaacaagagcaaaactctgtctcaaaaaaaaagataaaagaaaaaaaaatcaaacataatattctaacagcaaggatttttactcatgctttttatttatcattttacatgaaatataagcctaactatacactacgtataaatgacttggttctgtatgtggggcctagattggggatctaatacaacacgtgaatttttcttggtagctaggtcttggcatggctcagcccttttaaatccatttctcattctccaatatccttctaccctatcctgacccaccagcaaggaggacttctgcaatcctcacttcaattaaagcctgttggcttagggtcacagtaataagcaaatatggttcaattctgtaatttgattaacaacgaaatgattaacagtatagcagtttacagtataataaaaaataagattttaacagtgcaaggtgacttaatcagaattctgggaaatatgactcaaccaccttgacacagaggtcaggggaagggggtaggtctatgtttcaatgtcatctcagaaactgctcatatctatgctggcttctattttcattccgtaaagctagccaagggagctatgttttacgaggacatgcagtttcaacttcgtatcattcatagctaacaatcatgcaaaaatctacaaaataaacattaaggaaaataaatttcttatttgtcactgaacactgctgaatacctcctatgaactgcttatctgaaataaggtgaagaaatattgattcttttcatccagattggtatatgtgtaaataacacctgagttaaatattaccatgtttccaatgtacaaaaagcataaaagataagctaactacccaacagtcaagacttaatgaacactgtcacaaacattatttacacaagaatgtatgttacgcctcttcttcctagtctcctgataagtatgagtctttcccaagattcccttttcaatgtcattttaggacacaaaatgtccttaaatgttttagttaacagtagaagatcagaataattatatttgattagtcctcaaatttaaatactaattttcttttcttctgcatcatgcttaagacacaatttacttataaggtacacatttatgcatttaaaagaataaggtcatttaatggtttaaaaacctcttccaatacatcttacctgaaagactgatccattcctagtctgttcttccctttagatgagttcacactgtgtcctagcaataaagcttctaggttagaatgagggtaaaatgtgtgtttttcttacttttatttatgtagctaatgtgtatacaagaatattccttttattcctttttagacagagtcttactctgtcacccaggctagagggcagtgatgcgatctcggctcactgcaacctccgcctcccgggttcaagtgattctcctgcctcagcctcccacgtagcggggatataagcacccaccaccacaccagctacttttgtatttttagtagagtcgggtttcaccatgttagccaagctggtctcaaactcctgacctcaggtgatccacctgccttggcctcccaaattgctgggattacaggtgtgagccactgagccaggcccaagaacattctttttttctgtttttcttttggagacaaagtctcactctgttggccaggctggagggcagtggagcgatctcagctcactgcaacctccgcctcctggattcaaggaattctcctgcctcagcctcctgagtagctgggattacaggcgcccaccaccacacccagctaattttttgtatttttagtagagatggggtttcactatgttggccagggtagtctagaactcctgacctgaagtgatccgcttggcttggcctcccaaagtgctgggattacaatgagccaccacgcccagccccaagaacattcttactttagatatgggcctgctagcaagatttaaatgcagtttatctttgaataaatacatttttattactttacaatatacagcttgaagtctaaactttaatgaacaaagttattttgtaatcaagatttatatgcaaatacgtacttctaaagtacctgaaagctatttacttaagtgaagcacttccaagttcgaccttgttcacactctaaacttgttgagaaaacccaccctttcttccttgattgtgtaacatttatatatcagagcaatcacaagttgccaatctgcttctagggtatgaaaaggaagttttatcttatgtatccacatggcaaagagcccccaaatctgtcacctccaaaatggaagtctcttttaccatttctaaggccaagtgagcaagaaaaagtcatgattaatgtcatcatggaaaattgccccatatccaagagtaaattcaaagattactgagggatttttctctaagaaaataaataaataaccatcatcagggcaatcatctacaaaacttggtttagaaataaatttttaggccggacttttaggccagacacagcggctcacgcttgtaatcccagcatttgggaggctgacgtaggcaatcacttgaggtcaggaattcgagaccaagttggccaacatggtgaaaccctgtctccactaaaaatacaaaaattagccaggcatggtggcgcacacctgtaatcccagctactcaggaggctgaggcaggagaatcacttgaacctgagaggtgggggttgcagtgagctgagatcgcacgcaccactgcactccaacctgggccacagagtgagactccatctcaaaataaatttttaggctgagggcggtggctcatgcctctaatcctagcactctgggaggctgaagtgggaggatttgcttgagcccagcagttcaaatccagcctgggcaacatggcaaaaccttgtctctacaaaaaatacaaaaattagccaggcatggcggcacatgactgtagtcccagatactcaggaggctgaggcgggaggatagcttgagcctgggacgtgaaggctgcagtaagctatgatcatgctactgtattccagcctgggtgacacagcaatatcccgtctcaaaaaataaaataaaataaaataaaataaaaagttagaagaaattacaagtcaaattcaactcctggttatactggaccatccaaaaccaggtataaagtctccctggtcaaagtaggcttttcggggccagatttcaagctagctgagttcataccatcccatctagtccttcatttcctgtgggtgggatcgctcatcctccttctcaggaggccacagtcaccactgtatccgctgctaagtggtcacctccctccggggcctgccttcttccagagaaagtctgaggccatttttaagtgcccctaagcacgcagatcctgaactccaatttcatccttatggctcaaatatggtcctatcgcttactcttacgctctaagcttggggaataaaagggactcaggctctcatggagaacacacttcctttagtgaggactttcagggtatattcaagctttcacaacacagagaaagaacccaactttgagatatcaggaagacgtgttcccccgcccccccaaataaatactttgctgagtagcagtattggaaattaatccaggaaattttttaactacgtatgcagtacatttgtctggacatcaacaagtccgtatgaaaccacaataatgactataaaaagaagaatctggcaaaatgatactacaaatagattactgacaataaatggagtgtgagcctactttgtataatcacagaataacagatctgaaaaacattcagtcttagggatttaaaactttctgctctgatttcaaaggatgttgttcctaatagtatataccaggcccagtggcttctcatcaacaaatgcaattagttttgcaacagtctctaacccaagatatggaagttcttgcaatgaatttgaaaagattctaatttagaatttggggaattttttttttttaagatggagttttgccctgttgcccaggctggagtgcactggagtgatctcggctcactgcaacctccacctcccgggttcaagcgcttctcctgcctcagcgtcccaagtagctgagattacagatccatgccaacacaattgactaattttttgtatctttagtagagacggggtttcaccatgttgcccaggctggtctcgaacccctgacctcctgatccgcccgccttggcttcccaaagtgctgggattagaggcgtgagccaccgcacccggctggaaaattttttttaaatcttctaccacagtcacatatagttctgaagctacgatttagaagtgttaaaaattctgttttgagaaagtcaacagatttatcaacattaaagaaatttgtgtatgtcaaaactactgtaaatatataaagcaaagataaaatgggaaaagtatctgcaatatgaatggcaaagatttactatcaatccataaaaggctcttatgaattaatggaaaaatactaatatcccaggagaaaaatctggcactacatcaaatttcaaaatggaaaacaactagatttctttggtgttcaaatcatctgtaatcaaagaaattgaagtttaaatatagagaaagcactgttcacctataaacctgggaagaattttttttttttccctttaaggatgattctacatgttgacaagaatacggtaacaccagtattctcacagagagctggtgggaacataatttggttaaacattttttggaaagcaaatggtcaatatgtatgaggagatcttccaaccatcaactgtatttcaagggcactaaggatattaaccctgcacataaagttttaaaaacgtatttgttgcaaaagtatatttagtaagtggaaataaatgaaaaccagtttgatacatctatgtaatgtaatattaagtagccactaagatttctgaagatttcatgacatggaaaatttttcatgatacattaatcaggaaaaaacctccacgcaatagtatatttagataaactatataactataaaaaatttttctatatattaacaagtattttcttaaatattaactgtgattatctttgctgaaattgcttaactcacttttctcaatctacctatttttatacagcaagcacggattacttttgaaatcaaaacaaacagggttaacagaacagggctattaagtaacaggctttttaaatgcttgagtgtaataactgcaggttagtttccaaaaaatataagatattatctagaatcttataatcctattatactccaaaatgtaaccttgacttattgacataattaaaaggtcttgttccaagcatgattttctaccaagcagatttaccaagaattattttctcttcataaacctgattttaaaaagaacaggtgaaaaaacgtggtgcaagttacataaataactacatattattttaaactaaattccacttctaaggttttttagctttggttttaaggataagcatgtagttctaatcttttctttgtatagctttcctaatggaatatattgcctatgaaaaaaaaaaaatctgtaacagcactttctacactgtaaagcactgtactaacaggacatcaccattttaagttgtgtatcatttcctgccctaaccatccctgaaaaagcaaactgtctacagaattgcaattccgtttatgcaattccttttaaagttgtccatgcactgttatcttgtatataccctccttaaagaggtcactggttcccaggaagcaatgactctcttttttaatcccctccctcctgcattgcctcccttcctcctgaaattcactggtaacacccctactcccaccctccagccccagcgctgtgatttagtgatgattgactttcgatcacctgcacctggcaaaacttgaaagcttccacgcaccgttttgcctaagactttggtttcattgaaacaaacaaaacacactggatttcctttcttagaacactgactacttcaaacaaacagtatttaacagagtatgtgtaactacgcaggctaaatgaattaacctcttccttcctagtcccaaattactccaagtcaaaaatcaacaaacaacttggtagaaaggagtacgtcttcaaaaaagaacaaaaacgttcctcagtgaacacctaagtccactaagcactatagagtagtcaataaggtcaccttaattaagatgagatttttctagagcgtgaaaaagtgcaaacaagctgcagaaagtagcgaggcgccacgaggggtctttgggacctgcagcaaccctattccacccgctttctcggccccgcttgcttctgctgagaaggggccctgcgagaaggctgggaccgccgggcccgggtgggcggcgtaaggagtccacagtcaagcccctcggtcactttcaaggtgacagcgacgagatccgcatccgtcccttccgcaggctctgcgctggcccacgtgagacccgcctccgctccgccggcgctgccgcccccttt

SEQ ID NO: 1623 - DNA, 157124 bp, Homo sapiens; identical to SEQ ID NO: 1622

SEQ ID NO: 1624 - DNA, 78428 bp, Homo sapiens
tgcaattcttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaacaacacaagatttaccatgcctaggggatgaatggcaaacccaactttggctaatgtcattgagaacaacttggaagcgtgagcagagatatctcatgaagtggcagtgaacctacatttccatttatcagaagcaaacatggaaggttacatacatgatgaagtattggaagttaaagacttaagacacaaaatcactaatttaaaagaacatgcaacatgagtatcaacttgctatgtagtgtacatgtaaatgacccaaatattcacctctagcatcctgaatctcttcttactacagctgttatttgtacagccactgaatgtagattagtaaatactgacatcacaatgttgacacatgcagggagggggagataaagcaacagttcttccttccaccttttccaaagtctcaggattaggggaggtaataagttttggaaagaaactgaaatgcaacctggaggagagttggacaagccacattttccactcatgggaaagaagcggaccattctgctactttcccaaagacaaagggactccttaaagggtaactgaaaaatgagcgctatcctcccagactgttttcttctatcaagtactgcatcatcggtaagcactgaatcctacctttcttaattatactagccaatgacttccttgttctcgttctttattctaagatttcccaaaatttgtaatatcaaatccaggctttagtttatttggaaagtggtttcagcacctggaagatgagctggctctggggctctggaaaatcatattcctttatccttgtcccagagaaaagtaggtaggaggtagaaggtttgcttttgtggctctggatggtggagaaaggtaaaaggaaaatgagaataatgggagggaagaagacaggttaaatctgcaagggtagatcaaaggtaaaaataaggtggaaaaacccattggtacttccctttttctttctttacacagttagttagttagtttgtttttttatagaaaaattagggttctacatttacacatagcctgagaaaatgaattacaggatagtgttaggctcacatgggtaagtaaaaaatctacagaaaaatctagtttcaactgacatggctgaacactgaaaaactgccaagaagttacccccaaaagatacagagaatgtatagacagggacaagtcaaagctcttcctgttataccctctccctaccctgttacagggctgagcagagttggtggtagatgatcataattcaagcaactattgctttttcttctatggctttggctgaaatgtatatgctgattgattgattattatttgattagtacatatccagatatattcagattttgacatttaatacacagcagaggaggctgcatcagacacatgacactctgtgacatccatttcattcacaccccccacccccacagtcagactgaaaactcacaagaaggtgtctgtggtgaagaacattacaaaggttataaatcttaatagggccctgagagtttttccccctatgcttaggtgaaaaaggcaatgaacaagatgctctcgttctttaagtgctttgtgcaacaacgtccgtgtcgatgccgaaatctttttttaaatctttttttggaggaatcttttggacggaggcaaaagtcttcctccagagttccagtctcagaagctgcgattccgccggtggtgacgctccagttaccctacggtgatcacacgtgtgctgatatacctcttgtgcccacgttcctccttggggtcagtcctgcagacctgcatcaaaatgctttcagagagtctgtggactttggggaggtgtcatctgggtgaaatgctggggctagggaaggagcccgaattccttggtgactgcaaagggatggcggaggatgtgggggatctcttggggctacacaggtccccattgtgcagtttccacagaagctcctcgttttccatagagagtcgcttgttgactttcgactccttctccagcgactcttgcagaacagcctgctccgtggaaagctgccttgaagaaaaaggccagaaaccatgagatctatgtaaaaaaaaaaaaaacttgaaaaatttttcttagcgtttgaaactttaaagtccaaaattattcctttgggataaaacagaatcctgcacaaggtcacaggtatttggctggctaagaaaacccaaacacaggccgggcgtggtggctcaagctcataatcctggcaccttgggaggccaaggtgggtggataacttgaggccaggagttcaagatcaacttgggcaacatggcgaaactctgtctctattaaaaatacaaaaattagtcacgcatggtgacatgtgcctgtagtcccagctactcaggaggctgaggtgggaggactgctcgagcctaggaggtggaggctgcagtaagctaagatcacaccactgtactccagcctgggcagaagagtgagacctcatctcaaaaaaatatataataataactgtactttttgggcaatttcatagtaggctgagagccacttttgcaaatattcgacatgttttatgactaccttatgttgcaggctgttttctatttggttttgtgttgctctttgtctgaaagcattctcagaggcagccagaggccgtgggagcaggcttgctggcctgggtctcagtgtacagttttcaggccgctttggtaaaagcatgaactactacaatcatattttccacagagaaatcaatgcccttttaaccatctgcttccatcatatttccaggaggtgcaggggtagagcgtgtccagaaagtacactggatgtccaagggagcggggagctcgggagaaacagcactgttttatttttaccttgagattgccatgtgcttgtccatccgagctttcaattcttcattctcctgctggaaacgcttcaatttgtcaaccaatgctgtgttgttgtccaccttggcataaacaagaattccaacatttatacaatattaaaaaaaaaacccctcatttcttaaggcacctcacgacacaagcacactttggagatttaattaaggaaaatgcaattccatattaaaatatttatacactaacaaacatactgaaaaagattttaaaacagcaaaacagagcggctgggtatttttaaaacatgtatgccaggacacttaaatattgatacgagtgggtaacagatttgttccaggtcatgttgttttggaattctctaagaattggtgcctctttctgtttcaatgtgaaataaaccctgcagacacactgcccacacttatcaaagcttatctatctccttacggtgaattttgctggaaaaaaaaaaaaaaagattcccacatctgatgaaaactcacaggccagcaattcacagtccctggcaacgtttactatggacttgaactcagtttcatggtaagttttcagcatttgcgtctgagtggccatacaaagcttcaattcgatagagctcttagagcatgccatcaaagaagtaacatgccacgagtctcctcaggtcagctgaagatagataggtctgttctcttgctgccctgtgcaggctgaactttcaaggcaaacaaactgatcagcggagagatgaaaggataagatgcctgaggacatttaatcacttaacatgatgaagacctgattccatcccccactcactttctaaaggtaaggctttatgaagaggcaatattatagctccgtcaggattaagtctaagtccttgtccttgtagcaggactaacgcgctttgagtatgttgcttagtttggaacctgattgttcttaagacatcctgttatccagaagcagctcaggacaacctgttcaggttaaatcactttccagaaaaggagtctacgttcagtaattatgaaggattcccagataaaacaacgtggaaaaaaacctggaatttgagattgggaggtattgtcctttaaatatctcatcctagggaaactagtcctaataatgtcacagagctgattatgggcagtgccggtttcatgggaaagctgtctttcttagaaaacttcctgtgcttctaagtctcttaatttcatcagaggcctgtaatttacaaatatgaagggaacagtgggtctccctctcattgtatcaactcattcttgcacacatacacaatgcaaggctgaaggatattatcaggatacctctggggcatggcaagaaacaaatagtagatcatcagaaattaaatgtgttggtaagtttacagcaaagtctgatttattgcacatgattttttgaaagttttgatgcatgaatggcatatggagcagtcctattaacaggatcatctgagtcatccctgactaccagattagaagataccagactcagtcgaacaggacgacctttggcaggaactggtatgtatactaggttggcccattaacaaccatgagttcctttccttcctttacaaaaatttcctgataattcaaaatgctggtatatccacacaggggcttggccgttatctccctcaacagaagtcatagtctccagaagaaaaccaaacgccaaaccaacacaaaccaagcagcagagaggtcccccatgtcccctactgtccagggctggtttgggtttgaatgaggcacttgtagaagcctgagtcactcatcactgtggggagaagaggccagtagcatgcggcagctggacagtcaacagcaaggcaccgcgagggcggggatcacttaagctgccttgccaaactctgccaacttggttagagtcctggctggcagcagctgtatttcagggccgggccaagactgacgctgaacactgaacatgccactcacactaacatcgttctctgttctagacactgcaaagtgaatgttaattcatatttttggtaacacctgctacttgtccaaatggattaatcttattatagcacaattttttttttgagatggagtcttgctatgtcgcccaggctggaatgcactggtgccatctcacctcaatggaacctccaccttcccagtacttgggattacaggcacccaccaccacacccggctaagttttatatttttagtagagacagggtttcaccatgttggccaggctggtctcgaactcctgacctcaagtgacccacccatctcaacctccctaaactgctggcattagaggaatgagccactgcgcccagcccacgattcttttatcacatgctaattcacaagaagcaagatgaagaattttgataaatagtattgctattcatttctattaaattcatttctattcatttctattaaacgtatccaactgttttggatctaagaaacctgtccagggtggctggtatattaaagtactgattttacatagatatttaaacatttttcttatgcaggtgaagatccaaaataccactgaaatataagcctgatttgtttgtagtttttccaaggactgggtgctgttttacatgttccttgaaaaagaaaacattctaggaggcagcaatgaataaatatggaacaaacttggaaagaaaatgtgaactttatcttttgtataatttctaaatatctttaggagcagttaacccaactccacagttctaaaatgcagggctcaatttcacacatattaccccatttgtaagatcctctttcattctgaaggaaacataccagtttctccattttcattaacttgatgtcctgttgatgcagtttctcattcttgatctctaacacagctttcaggctttctaactcctgttctagatacatgatctgaggatttttctggaaaggacacagcaagatactgctcttattccacatagttcaaattcttaacagaaagaatctttgattagattgagacattagacaagtagcaagcgacagatgttcatcatcttagagcaatttcaaagaaagaggtgaaaaacaagagcaccttaatgtcgaagactggtcctaatactgaaagcaaacatttcacttatttatcagtaacttaatatgcaaaaatgtgagttgcatcaaacatgttattgtatcaagagaaaaactttgcttacatacaaaacagaatcttggctggagatgaggcaatctgtgagtcagttattggcattttctgggagaacagggaacaacagttctctcctaccaaacaaactgatcaggaaagaaaaagcagtgcattatacggctctctggaaaacaacagggataacaatgtcctgagtgtttggatttttgttatgatggggctacgttgactgggccatacttctagggcagacataatactatcattttctattgtgacaccccagtacctacacggcatggagtacacagcctatttaaatttctctccaaaaattacaagtttgccaggcatagtggcatatgcctacagtcccagctactcaggaggctgaggcgggaggatcaactgagccaggaggtcaaggctgcagtgaactgtgaatgcaccactgcattctaacctggtggcagaacaagatcctgtctcaaaaacacaaaactctccaaaataaatgctacatcaggggaggcgtcctctgagagcacaccatcagtgtggatttcccaccaccgcccacccactccttgctttattcggaaattcaactaaaccattcaaaatttatgctacagaagaacagcatatggtccactgatcagatatgtttaatgaagcaacgtcttaggtaagagtcggtggtgtggtcatcaagcttatcttccggggcattggtttctgctctggaccaatccttagggagaatccaggaaggggcctcggggattacttaatccaaaccccttacttcacacagaaagaggaaacgtgttccacgggttaagcgccctactcaggaaagatcaggaaagcttccagagctggaaagggtcagggcagggactaatacatctttaattctaggttctttagatagttccctgaggctaggagaggtatgcgtgtgtatggtgggaggtggggtggggtgggatgaggagaggttggttaatgcatacaaacatacagttagacagaaggaataggttctagtgttcaagaacatagtagggtgactatagttaataataatatattgcgtacttcaaaatagctacaagagaagatataaaatgttccaaacacaaagaaatgataatgatgacggataccctaaataccctgacttgggcattacacagtctatgattgtctcaacacatcacacgtaccccataagtacatgcaaatactaagtatcaatttttaaatttcatacattttatacagtgttacccttgtacgcaggatttttttttttttttttaccttgaaaatagcgaatcctacctcatttttgttagagggaaatggcataacttaccgtcagttttaaaattagagcatttacaagacttgtaccctctgcattttctcctcctcctctgccagcccatccctttctcccggactacagtcagacgcactctttttccgcagcctcagcatgcttacgtgacagaagcggttggatgcttctgtgttcctcactctgactctgccttagcttttcaaaagcggctgcagtagaagaatcccctttgtgtaccggaagctctttcaaacctgtttcctgagccatcaataaagtttataccctgcatatccctgcatgtaagtctagatttcttttgaaatcactgactcttcctaagaatcttctagaataaatagctttgaagtttctttgaatataagctcatctaatgttatcaaatagctagagggtctcccaatgacattatttgcagaaggtctcactgagagatccacacatgtactttctagagctggccagagatttgaagtggagaaaagctttgcttctgcagtctcagagtataaacatgaaatgaaaacagtggtactaaaggcagaagcagcaaggaaacaaatttttttcaaaaagacaaaggttggggtaaggctggggaaaaaggacaaatgtgccacaagaaatttcagcttccaagagatttgtacttttcagaattgacatttatccatacggcgaaatattattcatccataaaaagaaatgaaatactaacataggctacaccacggatgaaccttggaaactttatactaagtaaacgacgccagtcttaaaaggaccacatgttctacaatcaaccttttctattcattcctcagaataagtaaatccatagagatagaaagtagacgggggagagcctggtgctggggaatttgggggaatggggagtgactgctaatgggtccagggttccttttgggggtgataaaaatgttctagaaagaggtactggtgaccaatggacaactttatgaatatactaaaagccactgaattttacatgttaaaagagtgaacttttcctgggcaacatggtaaaatcccatctctactaaaaatacaaaaattagctggccatggtgatgcgtgcctgtaatcccagctactcgggagggtgaggcaggagactcgcttgaacccaggaggtggacgttgcagtgagccgagatcacgccactacactccagcctgagtgacagagtgagactccctctcaaaaaaaaaaaaagaaagagtgaactttgtagtttgttttatctcaatacagtgattttttttttaaataaagtcttcacataaaactctaatcctaattggtagtttccttctttttagcttagaccaccagaaacatcctggacttcatccgtatgtcagattttaggatggtaaaacaagacgccagtaagcaaagcagttgttttacacaccttagaaagcacattgccagacatgagaaggattcccaacctgtgttatttctctggctgctgagtacttgaatgactctaaaaggcaactgagaagaaaaattccatactgataaaggagcacacacaacttaccaaatttgctttttctcttgctcttcttttttgttcttctgatttcaatttttcatttaaagcatcattttcactcttcagatcattgatttgcttctaaaacacaatgaaatgtggaacttaagttaacaagaaaaccccagaaactcagcatacgtacacagaaacattaaaaccaaacaaaatcaaaaatgatatttttttttgtgggggatactgggatattgacattcacccacctctagcgattcctgcttctcagaaagtaaatcttcaagcgatttcttttctatttcatggcctttcttaatttctgggaaaataaacggatatttttgaggcaataacattctatgagatcaatgtactctaaaacagttaaagcatatagatgtaggggttgatgatgaagccgtatgacgttactttacatctatagtatgcttttatgtaaattggccatctgttctcaaaatggccttgagaggtggttagggtagacattcccattttatgactgagagccctgaggcccactgaagcccaccatggcccacagaggccatgcgaccttaggacaacactgagtgccatttcagggcaggctctcataaatgccactccagactcctggtctggaaaccctgtgctcttttcaatttgctcttcataacctaaacataagtctaaaattatactcatttctagcaggaaggaagaaaaacaatgttcactacaagtctgcctggagccagtcacttttacacattatcacctctgcctgactttgggcaactctatttttgtggtgagaaagtccttgctgaaggtcacacagccggttcttagcactcatccacgctgctctgtaagatgcaactggtttagtagaaagactgtgagcgacactgccgattctgttctgaaagcaatggcttacaccctcccactgatgacagatgaaaaatagaaaagactatttttctattcaataagtggcatcgacatttcacagcaacactgctgtgcaggagcacttggggtggatcctttactgtggattacaagatagaaacttgtacttgccacttcccagggacctaagctggcaaccaccaccgccaaaatggcctttacagtcttccaaagcccatcctatttaacacaaggctggcatttgtaactattatttgcatccttagtgggaaaaggcatctgttaacaataaaccacgcaaaaaggaaccaagaacaccccagcctgaaggccacagggcattcgctgaagcaggaagttatgaatcatttccatcttaaaacatcatgtggttccttcagattttattctgtttaaagaggaaaaaaagcatccttgcctgaaagggaggcttcataggccttctttagcaattcaagtttctctgagtggctagcttcaatttccaacttagaggtttcatgcgcagcatttaagttgtcaaactgtaagcaacaaacaaaaccgtggtttaacagtaaaaccaaatgtcctaagttgaatacgcaaagcaaccacattaggagacgtcacagcttcacaggtaagcgtgggctctagtttaaaggctcctcaacacatacaaaggtcagggcagtggttcacacttgtaacctcagcactctgggaggcagaggtggaggatcacttggagcccagcagttcaagtccagcctgggcaatgtcgcgagactctgtccccacatgtgcacacacaaagaatgcatgaagagcaacgcaactgggattcaccgctcaactctcctctgtctccttccctaccctcaggaacacagacacagaggctctccagggtgacagatggaaatggctgcatcagtcacaaggaatgaccaggaacgaggatatgtttcacagtgacagggccacatgctctgcgcctgtcacttgaccactcaggccctagcatgtgcctggcctggagtaggcactctgtagatatttactaaatgaaaaactgagttaaaaagggagctacaaaattaaaaaggtttgatattttattcagtgaaaaaaaaaatgggatatttaaacagatgccactaaaaaaaaaaaaaagaaagaaatgcaaaacaatagtttggcaacacaccaccaggatgtttacaagggattatttctgggtagaaagaaagggttgttttttcaattttatcttttcctcctccttttcttcccttctttcacttaacataatacattcctttggtcataagaaaactattcaattaaaaagatactgtttccaaggcaggcggatcacctgaggttgggagtttgagaccagcctggccaacatggtgaaaccccgtctctactaaaaatacaaaaattagctgggcatggtgatgggtgcctatagtcccagctactcaggaggttgaggaaggagaatcacttgaacccgggaggcagaggctgcagtgagccaagatcaagccactgtactccagcctccagcctgggagacagagtgggactctgtcttaaataaacaacaacaacatgctttttatacctattagactaaaaaagagaagctcatcaagatgtgaagagcaaccaggattcaagtaagcagcagaggcctcagacaagctctggctgcaaaagcacagacctgctcttgcaattgcattttgtacttctctgcttcttcaatgtaagtgtcccgaagcttttcatactccctggtgtaaaactctttaagccgattctctcgttctgttttttcagcctggtgctgctggacgaatgcttcatacactgtttgtaactcattcctggctttttctaatttctcacaggtggttgaagcagtgactgaaaacagaggagaaagaagagggaagaggtcattttatttgtgaaatgtcctatattcattacagtcacacacagctgtgatgacacctgaagcatacacccatgatgtcttgggtctctagtgaccatgtcttcaaatataacagtatggaagtgaactgtaaaaaggaacacgagggcagggcgcagtggctcacacctgtaatcccagcactttgggaggctgaggtgggggaatcacctgaggtcaggagttcaagaccggcctggtcaacatggtaaaaccctgtctatcttaaaaatacaaaaattagccgggcatggtagcaggtgcctgtaatcccagctactcgggagggtgaggcaggagaattgcttgaacccgggaggcggaggttgtagtgagccaagatcacgccactgcactatagccggggtgacagactgagactccatctcaaaaacaaacaaacaaaacccccccccaccccacattcaaaaaactgactcccaagcagtaagagaagtacttcagaagacccaggtttctaagagaagatcccctctcatgtggtgaccagtcaatgcagtggtcaagaaaagagccttggccaggcagagacatttcttaggacaagcgactcctccctctcccagccagccagtgtggtagaagctcacacaagagcaggaaagacgagggataagaaacaagtggaccggccgggcgcggtggctcacgcctgtaatcccagcactttgggaggccgaggcaggtggatcatgaggtcaggagatcgagaccacggtgaaaccctgtctctactaaaaatacaaaaaattagccgggtgtggtggtgggcgcctgtagtcccagctactcgggaagttgaggcaggagaatggcgtgaacccaggaggcggagcttccagtgagccgagattgcgccactgcactccagcctgggcgacagagtgagattctgtctcaaaaaaaaaaaaaaaaaaaaaaagaaacaagtggaccttaaacttgtagttaatttgagttgattataatttgttatttcaaaactaataaaaataaaatattagcctctattaaacgcaaatcaccagagcacaaatatcttagggaaaaaaaaacacatcttaaaagcacccacataggccaggcacggtggtttgtgctataattcaagtattttaagaagctgagaccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagagagactccgtctcaaaaaaaaaaagaagctgatgcaggagaatcatttgcacctaggagttcatgaccagcctggacaacatagggaaacccatctcttaaaattaaaaaaaaaaaaaaaaaattatccaggcatgatggtgtgggcctgtagtccctgctactgaggaggctgaggtgggaggatcacttgagctcaggagattgaggctgcaactgttgggcaacagagcaagaccctatctcaaaaaaaaaaaaaaaaaaagcaatataaaatgaaaggttaaaaaaatttatatatgtatacataggtacatatgtgcacgtatatatgcatacatatgtatgcatgcatatatgtatatatctatgtgtacatgtgtatatatgtacatatatgtatgcatatatacatgcatatacatatacatatataatacatatatacacatatatacactatatatatagacacacacacacacacacacacacacacacacacacagagtcttgctgtattgcccaggctgaagtgcaatgacacaatcttggctcactgcaacctccaactcccaggttcaagcgattctcctgcctcagcctcctcagtagctgggattacggcacatgccaccacgaccagctaatttttgtattttagtagacacatggttttaccatgttggtcaggctgttctctaactcctgacctcgtgatgcgcctgcctcggcctcccagttaatatattttaaaagggcaaagtaatctgatacacataattgaaaatcagaacatcttagctcttccctacaactaccaaaaatagaatgactaacaatataatacatggcagaacacaaccaaagatatatgtacacacactacaataaatcctagaaaatcttgaattccttaggaagcctgactttggacattcccagtcttctgtcaccgatgtgtaaatacaggcagacagggtactactgtaactgtcagggatacacatgctgtccacatccccagagtactcgtggattaatacgacagggttgctggcaaatctgttaaattaacccttacctctctttggaaaggaataacatatcaggagttgaaggaagaagattattttagggcacagaaaaggacaatttagatcaataattatttggcctaaggaacgtgaaaatggcaggttcttaggaagatttcctacaatggtgtcaacttgttatctcaggaacctgccatgtggtggtagaaatacccaagtcacttgcccccagtcagtattctttcagaggaaaaggaggccacattgaaataatggcaggaatagtgtctgccaaagagaacccttaaaaattaaatcaatctacaaatgtttattgaagggcaaagatttaacattaaaaaaaaatccccaaaacaaaaactatttctcgttgcctggcacagaatggggctctttatcttgtttaaccctcacagaggaccctcctaaacatatagataaggaaaccgccacagagaggctaaatcatctgcccaggggcacagagctggcaagcgtgagaggatgggtttcggtgagcagtctgaattctgattctgcctgcacccaaagcccgtgccccttcttttctaccaagctgtttcttgtgctggggctggcaaggcgcatgatggggcctctactggaagagacaacagacagaggagaagtggcaggaccaggccagaccttggggcccagggagtggcactcaggatagtttacgtccagtcagggtggaccaaaggtttggtcagatttttaaaacaattaaaaaataaataaataaaaactgtgatgagggctgggcacagtggctcacgcctgtaatcccagcactttggaaggccgaagcgtgcagatcatgaggtcaaaatatccagaccatcctggccaacatggtgaaaccccatctctactaaaaatacaaaattagctgggcgtggtggtgtgtgcctgtagtcccagctactcagcaggctgagtgaggcaggagaatcgcttgaacccgggaggcagaggttacagtgagccaagatcgcactaccgcactccagcctggcgacagggaaagacttcatctcaaaaacaaaaacaaaaaaactgtgatgaagcagataccaaattaaccattttaattatttttaggtgtatgattcagtggcattgaatacacttacatcgttgtgtaagctttgtcatcatccattctccagaacgtttccccccaacctgaaacttcgtaccaattaaacagtaacaacccatcccctccccttccccaaggccctggcagcgaccattttactttctttctctatgaatctgaccattcagtacctcatatacctggactcaaatagtacttgtcctgttgtgactgtttatttcatttagcgtatgtcctcaaggctcatccaagctgtgggatgtgtcacaatttccttccttttgaaggctcaatattattccattgttggccgggtgcagtggctcacgcctgtaatcccagcattttgggaggccaaggcaagcagatcgcttgagttcaggagttcgagaccagcctggccaacatggtgaaaccccatctctagtaaaaatacaaaaattagcggggcatgatggcgcacgtctgtagtcccagctactcgggaggctgaggcaggagaatcgcttgaacccaagcagtgcaggttgcagtgagccaagataacgccactgcactccagcctgggtgacagagcaagactccgtgtcaaataataataatgataatattccattgcacgtacagatgacatttgtgtatccacttaccatccacggacacttgggttgcctccacctttggctactgtgaataatgctgctatgaacaccgggggacaaatacatgcccgagtccctgctttcaattctttggtgtatatacccagaaggaattgctgactcatatggcaattctattattaattatttgaaggactatggtactcttttccatagtggttgaaccattctacattcccatcagcagtactacacacaagggttccaatttctccacatgctcaccagaacctatttgattttttcaaatatatgtaacagccatcctaatgagtacatcactgtggttatgatttggtcagtagattttcaaattaagccatatgatagaaataaaattgaggcatcaaggatgaaaatcctatcccagcatgagcaatgatgggcgacagaacggtgagccttggtgattaagaaactcacaaagcagagaagatagaacccaaaaagacagacggaggccagattacaggggccatcgcacgcaactcaagcctttgggactgaatattaaaagtttcttttctcctttaaaagaatttagtgaaagatagtgatggtcttgactgctggagaacattctctgcacattcacttttccttctattacactagtaaccacagaagaaaaaatgactcaagaagtccaatgttagtcaaacgagtaaacactgcattagcttctgccaagtaactttccgactctgaaggctcctcgtgtgaatctcgtattagaactttctatgaaaacctacaacagaaacatactttgcaagccgttggtgaaggtatcaaatagcttctagtcagagaaattctagtttcacgcaggcttttcacttgcttctcttaaaatttccggtatttccaaagttaaaaaataaaaaagcaggaacaagatctgaacccatctggaagctcatatctgggacagaaacatctaagtgaactcagggactcagcaataaacaagagactgcctccaagccctgggctagaagagcttcgaagctgacgttaatagcagactaccctggctgattttaacacatctgtttatgataaaaatactgtcgctttgaatatgtaattgtggcacatcagcctttaaaaccaaataggatacacagaagtcctttcctattagccatgggacagggctgtttccctctattcaccaaaaaaaaaaaaggcagctctgacgttttgataagtgaggtgaagagaggacacatgggaagaaacgggaaagagaaagggagaaaatgggtcagatgggggaacaggaggttcactgctgttattgtaatagtccaaagcagcaggcccagccccagacagtgacatcagcctgcagctgtgcacagacctttgctctgtttactggcccggtgtgctgctggggaacagctgggctgcagtaatcgctcacactaatggctttcgtttgaaggaagtggcctgggctgcgaaggaaacatttatttggcataaagactcatgaagtattttttaaaggatgcacatgtaaacgctgtattaaaggttctcagagtgctcctcggcagctgtgacataaacgtgtgtgtgtggcggtggggggcgtgcataaccccgattttaggccatggactttcctgtgcactgactacagcttaggagagatttatggtgccacctgtgtgtgctctcactcctatcctcagcctagtctcttcttgctcattctccagaattccactcactttcaattaatcagacaccccacaaagccaaaaccaaacataaaattgtttcgaatttgcaacaagcaagcatggacatgcgaatgtttgaaagaaggtattagacaaacacaaagtcaaagtagtctttttgtccctattttttttttttttttttttttttgagatagagtctcgcactgtcacctgggctagaatgcagtggcacgatctcggctcactgcaacctccacctcccgggttcatgcgattctcttgccacagcctcccgagtagctgggactacaggtgcacaccaccacacttggctaattttttgttttttagtagagatggggtttcactatgtgggtaagactggtctcgaacttctggcctcatgatccgcccacctcagcatcccaaagtgctggaattacaggtgtgagccactgtgcctggcctctgttgttttaatcattccattagtctattttttaaaaaagcacatatatgattaggaacaccaacagaccaccatctgtaggagaactgctgggcaacttttgtatacatgtttgtaaaccatgaaagctatctccagcaatctagcttaaaagaggaaatacagttctcaggatttaaggaaaaagagaaaaaaaaaaaaagaaaaaggaagaaaggaggaagggagggaaggggaggaaggagaagaaggaaaggaaggcaaactcatgtacaaaaacatctctaaaatgtaaggccacattgagattagaagtcagtattttcactctgcaatgaatcacccaagaagaattctaggccagtgaccctccctgacagtttaaatcatggatatctcagcaagaaaaaaaaatcgtaatcagtgaaatgctttaagttttgcttttcaagtaattatcaagatgatatgtggaaaatgcccagtgccacagtcaaacataatctctggaaaacagagctggagtcctcccaggtccttcattacttagccctgcagaactggagtggagccattacttaattagtcctcatggctttttctcagaggggaaggtcagacttttattatttccatctcacagagactcatttccctttgttgattgataaatgtactgtttacagagaaaagcattacacagccatggcccgacattgttaatattcttttgaaatgatacagtgctttcctagtttttatatctgagtagcatggttcattatgagacgaccaaaaatattttaatgctcaagaacataaataaatgtcctaataggatagagccaaaattacttgggttcaaatctcagtcacaccactcagctgctacatcacttgagcaaattacttaaactttctaagcctactttttgttttgttttgttttgttttttttgagacagaggcttcctctatcacccaggctggagtgtagtggcacaatctcagctcactgcaacctcggcctcccaggtttaagcgattctcctgcctcagccccctgagtagctgggattacaggcatgcaccaccatacccggctaatttttgtatttttagtggagacagggtttcactacgttggccaggctggtctcgaactcctgacctcaaatgatctgcctgcctcggcctcccaaagtgctgggattacaggcatgagccaccgcacctggcctaagcctacatttcttcatttttaaagtggagatattattagtcccttctctagaagatgaaatagcacaggtgaagcactcaccccagtgcctgaccacagtaactttgcagataaattgtataactgttacggcttgcaagagtccattgattccagtgtgtttgaagactcctggaagacaggcttagggttccataacagaaatataacagttaaaaagcagcattgctggcctcgtattcaaatttgatgcatatgaacacacagacgtagctattatggtggagtgtacactcacttcaagtctttcccttccgctactattgttcttgacattatacgcaatagaattttcctaatttggaggagattttatgtaaatcagaactaaaatataaaaaagaaaagtgccaggcaaattttcatagcgccacataagagaataccatagaaagaagagacgaacaggaaaaagagatgattccattcccaaactgcacacatactcctttcccagacgctctggccagcctgctgtgggtggcgactctcccccaccccaccccgaaatccccctctctgcaccatctaggatggagaagagcagcctgcctccagctctgcctgcagtgggcccctcactctctcttggccgcctgggaaaccggcctcctcctctcagttctgggctccttcacttctttcttcaacagtacatacccattacacttctcggggtaaacagaactgtcacttctcttgtgccccacccccagaagcaggaggggacactacattctaccgtaggagtgtgatgatgtcataacattctactaagggaaatccgaggaaatccgatcctgacacacgtccatggcaagcgactatgtaggtgacccccttaagccaaggtctgatctggtttgaaactggaggtagtaacatcactgaacaagtaaccaagaagtcatttttaaacatcaaattgatgctttgtggacaggcagtggcctaaagaagaaaaaaaaggtgggacccagactatcccacaaataggcatgtccagtttcctgggcctccgtgtcctgatatggaaggtaggaacaaataccacctgttctgccaacagtatagattggtgatagtaaagtgaaacagagttactcttatgctttgtagaaagtcttcccagcctgtggaataatcccctactcacatagtgccagggtttgcctctctaaagatactttgtcaaatgaccaagaaattttgcagacaagtggtagaccaggttctttttctacatttccaaattatctccaaatgcctttctgattactcctgggcattaaatcaacaaatcactaagagctcatttcaaagtcttccataaatcataaattattaggaacttgctttttacaaaaggcctgcacaatcaaatcaatcctcccataaatgccacttcacctttaaaactcagttcatactttacaaggtgctctcacatttgtttcatttaatgtaacaatgctctgaacgaataaaataggtattatcagacatctcattttaccaaagaagaatggaaataacggagctggatctacaactccagcctctttgttgttgttgtgttttgagtagatatggggtttcaccatgttggcaaggctggtctcaaactccgggcatcaagcgatctgtccacctcagcctcccaaagtgctggaattactggcttgagccactatgcccggccctagaactccagcctctttgagagcctaaccacagaacacccagcgggatctgactggctatttttcccagcctgagatgtagaagacaaagttaattcacacgtaccatggatgcctcagggtagtagggcttaattctcttgtggaagcactgctgaaaagattccaagataaggcaggtaaaaaaatgacctttccccccctatactgggtagtgctgacaaagtgtgactcacaggtgggaagacaattccacccagccagcctgtcttccatctccatcttggtgcctaggtaccagccgggcctcccctaaggttctagcctctccctgccagtgttcctcctcccacccttgaagagaagcctgcaaaggccatttgctgtttttcagctcattcactggccagcatgctgcagaacagatgcttttttttttttttttttttttttaaatcacaacagcaaacactccgtgtataaacgaacacatttaggaataaaagtgggttggaggcgagagcacagctgaatatctgacaatatgttctaagattcaggcctgagaaaaagtgaggctgactttaaaggaatcctgtttcaatcaagagtttcaatgtaaaaaaaaaaaaaaggatgattttaagtcagggactattcattctgcctcttctcctcactgacggatcatttttagagcacgagggtcaaaaaggctgctaaaagtccttggcatgtgtaaaatttaaaagcttatttataagaatggactcaattcactcggagttacttcatattattcttactatgcttgagatatgtatgtatttttttacataaaagaaacaacattctaggcagctagagcagtgtcaaagggtagtcctggggcacctacatgagaaccacctggatgatcattaaaagtgcagattcctcctcaatttccattaagggaaaggttttgctttatttttctttgcaggtagccaaagctgtactcagatattgctaataaggaagaaaaactggtctcctgttaacctgaggacactagggccagaggtcaggaagagggatcaccttccccatcaacacaacatctttttagaagtgctgcctctccttctgtaattgggaagcacctattactattccttaaagcccaaagaggggttagtaggatgatgggtataggagacgttggggtttaaaaaaaacaaagtgcagattcctggacttcatccccagccaaccaagtcagaagcaatgggcatgagaactgaggatctgcatttcaaccaggtctattttcgtacacaataaagtttgggagccactattctacacaataaggtattaaattaggaaaatcccaagttgagagactggagttaggacaaggaacaggacaaggaggaacagtcagtgggtttcaaacacaggtaccactggtaaaactgcatatctgcaggtgaaagaacatggccttttacttataaatacagccaaccaaagtccaaattgagggcagatgtggataggaagagaatgagctaagtctgaggtggctatcaactcagtcttcaaacaagtcagggagataaacagccctgttttggtgtacagttggttttcagtatattaatagatttttcattaaagcctacttcaagaaaagtcacttctggaattttacaactcaaaagtgacttacctgtaaagagtttaaaaattattttaaatacatagccttgttaaaccaaaattgtagataaaaacggaacagtgaatgaatcaacacattccatatggcgtgaggcaatgtgaagttcatagacactgggttaagtgttgattaggcaatgtgtatactgcttttggcaatgtactgttttttgcaagttactttcctcagtaagatacattttaacaatatttcttaaactcttgattagaagaaaaatattccaaaagtagctatcaatgcaaacgagcgtttatttcaaatagttttccaatcttttaaatcatttcatcaaactttccctgtggtgactaccagaagattggtggtctagccatcttgggttcttatgcaagctctttgctttccagcttcccttgggaagttacttaacctctgagccacaatttattttttataaatacaatgcagagaagtagactgagagctgaacattgtttgttagggatgagtaggcaccaaacacacgatgttgttatacctagctcataattttcatgcacaaaaatcaactggtctttttacactattataggaagggcaagcatttttagtgaattaaggattaaaatcttgtttcacaaaatagaaataatcaggactaatgtataaaaagatgagagttagctgttaattgtgatggctcaaaaataattttgaaatacaaaataatcttcattaatttagatcaagcttgtccaactcacagcctgcacgtggcccaggacagctttgaatgcggcccaacacaaatttgtaaactttcttagaacattatgagatgtgtgaatttttttcttttcgtcatcagctatttgctagtgttagtgcattttatgtgtggcactagacaattcttcttccaacgtggcccggggaagccaaaagattggacacccctgatttagatgaaaagtctgattccaaggattaacattaatgaaaagcaaaaagaactctaaagatcataatcatggccctctattgcaccagctgttattcaacatgactctggaaagaatcttatcctagaggcaaaatgtctgctgcagatgtagaccatttaactgtaatctatttccaaggctgacactttcaaaatgatctgattaactgggattgtcggacataatataaaatgtatccaagagagttacagctctcctttatgactatgcattcctaaaggacaattatcttttcttttcaagatgtggatttcattttttaattattctgactctgctttaaacttttattttaggttcaggggcacatgtgcaggtttgttatttgggtcaacttgaatcacaggggcttgttgtacagaatatttcatcaccccggtactaagcccagtacccgatagttattttttctgctcctctccctcctcccgccctccaccctcaggcaggccccagtgtctgctgttcccctctttgtgtccatatgtgtttgtcatagaaatgttaaacggtttatagaaaaacatttgtgcataaaaaacactgagtattagcatattttaagaagaaaactacctttccctagctaccactgttggtaataaaatcattcattgattgaagtctaagcacctgctaagtgccaagcacaaggtgggagaactacaaaaattaaggagctattggccttgcccttgaagagttcctaattctagatggcaagaagaggtctataaacaaatctctgtaagaacaaaatcttaaatgtgtacagggtgctttgaaaagcacactagaaggcacagttaacttacttgaaagatttgggtgaaattcaattgaagatattttagctaagacttaaaaactgagtaaaagagaaggagcatgaggggtccgcgacgggaggggagtggaaagaggagagtgcactccaggcagagaggataccgtgcaaaagatgtggacaagaggtgcaaatgaacccatggccggggcctgggaggggaaaggaggtctgaacaaaggggaaagagtgcctagacgtgaatttggactggaagatttcaatcagtcaaatcataaatggtgtgcttagtatgtctggattttttcccccaaggccaaaatagagtcttttgtgtttgttaaaaatgtccagtacaggccaggagtggtggctcaagcctataatcccaacactttgggaggccgcagcaggtggatcacctgaggtcaggagttcgagaccagcctggccaacatggtgaaacctcgtctctactaaaatacaaaaattagccggccgtggtggtgcgcacctgtattcccagctactcgggacgctgaggcaggacagtcacatgaatccaggaggtggaggttgcagtgacccaagatcatgccactgcactccagcatgggtgacagggtagaaaactccttctaaaaaacaaaaaaaacaaaatgtccagtagagacacatgtcagcctgactctaagtacagatcctggccgcaagtggagttgggggcgcaggcctggaggcaaggtgacccattgggtagctgttgcagtatcttccaggtgagaaattgtgggacttaaaacagcagcagccagaatgctgagcagggatggatccaagtggcatttaggacacagactgacatgcacgtggaggatgggggaacaggagtatgatttcagttgttagcttgggtggtaagtgaatcatatcgaccctgccaaagctgaggaacaggggtgaatgaggagacgctgcatggcgctcaggaaggaaggggctggaccatcaggaaggtctgattatactggactggctcacctgggggcagcccctcactgggaagcatctgcagcttgggaaggagagaactagaaaaataaatctgtgtcactgttgtataggtagtagcggaaaccatgggaatggatgagaaaacagctggcaatgaaacccttgctatatactatgacactatttaaggggtaagtgaacgtatgggacagccacttgacagactttcccccagcccattaaaggtgatcataatgaacactatgaggcaatgtggaaaagtgcttgacctatccagtgaaaaagatcacagcagacatctgaccaggtgccatggctcacatctgtaatcccagcactttgggaggccgagacgggcggatcacttgaggcaagtgttagagaccagcctgaccaatatggtgaatccctgtctctactaaaaatacaaaaattagcccagcatggtggtatgcacctataatcccagctattcgggaggctgaggcaggagaactgcttgaacccggaaggcagaggtcacagtgagccgagatagtgccagtgcactccagcctggcaacagagcaagaccctgtctttaaaaaaaaaagattggagcagacacttaacatacacaaatctcaaaagtattatgaaacaagccagagacaaaaaacagcatactatatctttccatttaaatgagaatctagttcagacaaaacctttgataataaaggttaaatcagtgtttgcttctagggggaggggtgttccactgtgaaatggcatgagggaatttactggattgacagaaatagtctatgcttgataaggatgtaggttttaggagtatatgtctgtcaaactgatggaataattagcattccgctgtatgaaaattacaccttaatttaaaaaatcgtagtatgaagttgtatatattcatataaactaagaaaagggaatatgcaaataaagttatgtcagggcagtggagctgccggctgttttcttttcacttaaaaatcttaattttcatacattgttctaaaaaaaaaaaaaactttaaaacttaaaatacccaaaaatatttatcgagtacccaagaaaacagaaagcatattatattatttttccataggaaacagaaaagaatccctacaattatggactttatacctgaaggtaacaagaaaacacgagacagtaaagacatcaacgtagagtatcaaaaaatcactggaccaaagggacacttttaagagtttctgcagaagcaaagaaccagtgcttccatgaagggagtgtggctcagacagtggaaacacacaggctgctttggacactgccacagtgagactgagggaacaacgggaaagtcagtggatgctgggacagctggaggctgttagatgcggaaggtggaaagcacagactctacctgggtttcagtgctcctgagtttatgaactgtcctttttctttgcagttcttagtagtttgggtaccttgtctcaactttcattgagaaggtgaagaaaaattacccaatgggagagtgacaccaactcccatcgccccacccccattattttggagggaagaagtgggtgctttgatgacggcgatagtggcagctctcttttcttgagttgctgtgatgggccaggcactacaccactgctttatatgcattactattttattcaagctccacaataacgcagcaaaatacatactgatttcatatcaccagcgaaaaaaccatactcaaagaagttaggtaacatccaactaggagtggatggacaaaaacctaggctttgactccacacaccacactctactggatcaggagaatactctgatgaggtctcatttccacttgagtttgaagagcctgtcgtttgggatttctaggaatatttagtctaatgattattcctttctgtagcatagatgatgccctcacaaaacagccagtgtggttaattactacacagctgtcaagctgcatacatcctaatacctattatttaatagcagttaacacttggtgctagatgctttacaatgcattacctcatgtaatcctcacacccacccttggggcagacaattagcatcgccatttttaccgaggatgaaattgggacagaagagatacaaagtgacttgtcctaagtcactcagttaccacaaatgtggccccggacagtgtgacaacatcagcctaaccactttactgcctcaaaatttaaaactgggttcccaactttgctatgtcaatgtcaaagttagtttcatgctgaaactaacaatcccactggcagccttgagagtgttcttcctggaccgcttcatcacaagtgtttacaggtttcgcttccctccacttacagaaccaaaacccttctccaaacggagaacggttaccatcagatgtatgcctgctgcaacagcagcaatgacacattccctaagaagccagcactgggtgactggggatctggataggccacccactgtaccaacactcgggaggcaggagaagcagtgcaccaggacagcttccttatcaaggataggaaggtgacagtgggcacagactgttacagctatttcctgtcaggctacctgactcactggaggtgctgaatccctgggccccaactgcggttgcttaattgtgctgtccactaaaatgtaaaaagagcatccttcattgaagcagagcgaatgggcacagtgttccattctcattgctgccttgtcttcggagagaggctgaaatgtgaacctctaggtaggctcacctccacttccactgggttataatgaactctgaaacacacacaaaaaggcctctttcctgatcttctaactctgttaattatgttatttaaggcatggacaaaagcaagttgggttggtcatttaggtaatcataagggctgctgtcaagttaagtaacatggcagaaagcctgcaaagtctgagagctgggctgtctctcagctgggatttccttgaactgtttcaccagaactctcaagtctttgggattctgaagtttccatctgtcttaaaattacttttccataaagaggccttcatttccacagcctaaaataaagtgaggactgatgtcttggctaggtattaagaatctggacggttagtcagggatttggcctcacctcccactggaaggggaaaagggaagatgaatgcagagaagtcttttacagagtcttgctctgttggccagactggagggcagcagcacaatgacagctcactgcagtctcgaactcctgggctcaagcaatcttcccacctcacactccagagtagctgggacaacaggcacacaccaccatgcttggctgatttttaaattattttttgtagagtcagggtcttgctatattgctcaagctggtctcaaactgctggcctcaagtgatcctcccacctcagcctcccaaagcgctgggattacaggtgtgagctaccacacccagcccagacaaagtcttgaccccacgttcactgccgtttgatttctgctgtggtgaaggtgggagaattaagagtgttcaaatccagcaaatcaggttggcagtgtggtcttgtccaaaagaaaaaagggcagtttctcctagagttgggtgaacacaatttgcttctctggatgttaccttgcattattcatacaacatacctgggcatattttggtggagactgtaacacacacagaaaactgcaaagggcaaggaaataagccctagaatggtcagctccagatctggctgaagctgaagcaggaagttgattctctaggttgaggagcccagggcagagagaagaaccccaaagcggtcagatcactccaagatacgagttgacgtagaaaagggagtgtcggctgggtgcggtggctcacacctataatcccagtactttgggaggccaaggtcaagagatggagaccctcctggccaacatggcgaaaccccatctctactaaaaatacaaaaattagctgggtgtggtggtgtgctcctgttgtcccagctactcggaaggctgaggcaggagaattgcttgaacccgggaggcggaggttgcagtgagtcgagatcgcaccactgcactccagtctggtgacagagcaagattccgtctcaaaaaaaaaagaaaaagaaacagaaaagagaaaagcaaaacaaagcaaaggcagtgtcgtgtctgttccatgaaccctaagggcttccaggagagaatggaactaaaataacagcgtagcctggaaactggagggctgggtggtgggtgttgagacctggaaactgcagggctgggtggtgggtgttgagacatgtaaactgcagggctgggtggtaggtgttgagacgtggggctccctgtggagcggggaggtggtgaaccatcagcccccctccaaatagtaagattagcatagaacgtgcctttttcagccaagttgccttcatggacagcatcctttcaacttcatactcactactcacaaaccaacccttggaagtacaacggatttactgtttatcaagaggggaaactttcactattctcatatgaaaagtgcttcagaaaaaaaaatgacaacattatttaacaggaattcacacaattacaaaaataactctgtccctctcttcagcaagagaaatattttgctcatcagaagttctgctaggcttagtcagatcagtgccaggaattctgtgaactgaaggtcaagctgccaagattcaaaagaaatgtcgatagtaagtgtttgcccagatactagacagggagtgccaacagctcccagcatgcaactccagccacaacgcagacaggacaaccacattttccagtgttccccttgtcccataaaatttaacaacaacaacaaaaagctcttacctagctctccccggaggttaacaagttcttgagatagggttttgtgttgtttcagtgcttcctcccgctgcggaaaacacacatcaagttactcatgctttcaagagggtccctttcagtaaggtacacatttgttatcactaggaaaatgagacccagtattgggaagccaagatatgaatcatttaggctaacaatttgtgttgttaaaagaaacacagttgtcccttagctgttaaggaaattcgtaattcaaaaatctgtatttttgcaggtcccagtgaaactttggtttgacgcagtgaatggcccatttagaaatatttactttgagccagtgcttcactgctgatccatagaacctttcggctaatgcatactgtacttaagatgtaatgcgttctcctcctccaagggcaataaacatctaatcagtttaagataaatatttaatgttctaaacataagcacatatatgcactttgtcctatatttgcacataaaaaagtttcgttacaatgccaatccttctaaaagaaagacaaaaagtttgttagaaagctatagcagaaagataatcctttaaagacaaaattaaattaatttttttcagctacataccattttctaaggattatgatattttggatcagtgataattctaaatcgatgttagagaaacaaaccaaagaaaaccggatggctgtttttagtatcagagaagcaagtatcaaccttgagctgaagaataatgttcaagttaccagcaactcccggcaatcacacatacacacatacttacacaaatacagtaattacatacagttccttaaaaggtagattccctagcaccagggagtaactaaaaaaaaaatgaagaatttcaaagctcgctgaaaaatgccctcacgaggatcacccaagacggagctcccaccacatcctgatcacagcgttgcagagatcatgagacccggcctttgcaggcaagagttgcttgtcattcaaagcattttccctgaattccagacagcctctgcagtagtcctgacattcttccagaaaagcactataaacaaatactaattacccttgttgctgcacatggagaatagaggcacagtttgctgctggggcagcccattttccagcttctgtctccaagtccccccacccctcgcactgtgcaagaagcatacaggtggccgcgccacccaccagtcgggtctgtctacattcaaagctctagcaggaggcgcgccattggccctcgggcgtcttacttcatgtcctgcaggttaccgtgtgcctcggattcctcactcacagaagctgatactgcagcttctgcctttggcacaggcagcctgtgattacttaaagccacagcctttcatttatgaaaaacgagaggcaggcattagactgatcgattgccatttagttaaatatcagctgcaacggaggaaagaaaaaactgaccccctctgcatggataatggagttatttttagacttgtgagcctttttcttcccctctctaattgtggtcattatttgatcacacttactaatagaaaagggaaacttgttcttcgaagcccatatactaaatgaggttatgaactaggtgaagagcaaggaaaggggcatgctgtcgtttacaaatttaaatgacattatgaaatgagaggtgtttcaaaataagtctgaagtgctgatctgagagttggagatcccatatatttttaacttttactttgttctcacctctcagtaagagctacggaagtcaagtctaaacgccagcactgaaacgtggtcagcagggactgggatttaagacccacttttcactgagtacctttctggcttcaatggtattctaaatgcttggtttttaaaaatatggcattaagttgttctgaaatcaccagtgagtcagagtttcttaaaataataagtaattggttttctaatgtagaaattaaagcctgaggaaaatcagcccgcataataatggaagaaaaacataaaaatatgtatcataaatacttctcgtaatatcaaatttaagcctgaattttgtttagtaatctacttcaagtaaacaccaggaagctttaccactcaagtaacaggaaaaacaagacagctttactaaatgcccacaaacaatcctgaaactcatttggtgaacttgcttaaaattcacttttcagtagtaaccaagttactaacagaaggaagagatggcaagaaaattcaatcatttttcaaatttatggaaactaatgggaggatgaaagaaattaaaaattacagttagtataactgcaaagaaaaattgtgtgaaatcattatgttctactgcaaaaatacaccaggtgatatttttgcttattaagggaggttttgggaaagggagtttcaccaagcatgtcgacatttccccaaacttcaactccactgcactccacgttcctgtccttaatgcctcagaaactactgacatcttccaacctctgtcaggcacagtaacagtaacaggaaaaccttgaggtcatctttcactctttgtctaaatgggttgtgcaaaagtcagttggttcttcccttgtaatgtgacaccattcccctcctccaaatgcatagaccatttacccttctaaattggttggtaacttattacttcaaactaattaactaagcatttttcatagcagatgctgtgaaaatataaaagaaatttaagacatggtccctgccttcaagaagcatggggcctacctagaactagaacatccaggctcaattcttttggtcatctatcaaggcagatgacctcatcggatgggaagcagtaatgaaaaaaaccaagggctttaaataccatccatagatgaaatgctgaccccagtgcccatactgtaaaagacacatactaagggttagtttctgcctgactctccctggtagcttggcctttacatgtacttaccctttacttgtagatgataaaatgcattatgtcctttagatactgatttactgtttctttttactcagctgctcctagatcagtgtttctctcttagatgataaactcttaaccgtctagataacaggttgattcaattctctttgtattgtaacatgcagaattacacacaatgtgaaaaaagagaaaggtggaaatctggatataaagatgcctttatgctcaggcattaaatatatgaaatgctcaagaaaaaaaaaatggattcaccataattgaattaggagtccctgggacacaggcacttagtctctggctgtggtcccatcggtgtgcctgcatttttgctagccactgagtagcatcaacagcatagagcatcttgcagagaatagccacatcagatggctcagacgtgtgctgcatctgacctcctccccatcacccacacagtgaatttgctcaatgcatctatgtttttttgttccaagtcaactttactgctagtgccattcaaaattcacctttgttcaggtgctactttaggttaaattccacttgcaaaaaaaaaaaaaaaagatgtggaggcattttgaagaattagaggtttggggagggtgacctcagccctgttcaagtttacctagaaagccacccaatagacccttttaggaagaagcttaattactaccatcaatactgttgttcactttggctgtctgtgcagaataccgtctaactaagcaaggataaaccaagaattagaaaaaaactaaaataactttagtgtgtcttctgcgaaacagagtgtgacattagttctcagattcatgagatataagaatgtctgatatgtaatgaaatatgtctgccactacagtgggaaacttatagttactaagtagacttgcaacaaaagcatggtagttgcaagattctcttaaccattttcacccataatcgaaggctctaaagccatttagaaaaggttagcaataacaaaaaatatatatacacacacacacacaaatacctatatattatacatatataaaaatacatagacatacaatgtataggtatatcatgtatataaaaaacatacataatgtatatgtatacaatgtgtatctgtatctattttatatacatatgcatgtgtgcgcgcgcgtgtgtgtgtgtgtgtgtgtgtataaacacagtatatatacttctgtaatgggaatgggaactaaaaggttaagggagtttttaaaattgtttaactttacccatgattttttttctccaactatttttattttatttatttatttatttatttatttattttttgagacagggtctcactgtcacccaggctggagtgcggtggtgcgatcttggctcactgcaacctccacctattgggttcaagcgattcgtatgcctcagtctcttgagtagctgggactacaggcacatgccaccatgcctggctaatttttgtattttttggtagagacagggtttcgccatgttggccagactggtctcaaactctggacctcaagcgatccacccgcctcagcctcccaaagtgctgggattacaggtgtgagccaccatgcctagcctccaactgttttataatagtgctcagtatacattacacaatcagtaaatatttgctgattataaaataaagagagcaaagaacatttacataagactttatgctcatcctacatctggaattccatcctctccgttcatatgttcactcacatatatactgtgttgactattaaagctgctggggtggtttcataagaaagaactagatgcagatcctgccttcagtaaatttcctgtcttaaaaagcaaaaacaagcattaaaccggtatctctaatataacacagacaatgaaagagaagcatatatgctcctggaatccagacgggaacagaacgtagatctagaaggccaggaaatcattcctgagtgggttctggactgggagtggtggatcatgcctgtaatcccagcactttggaaggccgaggcaggtggatcacttgaggtgaggactttaagaccagcctggccaacatggtgaaacctcatctctactaaaaatacaaaaattatctgggtatggtggtgggcatccgtaatcccagctactcaggaggctgagtcaggagaactggttgaacccaggtggcggaggttgcagtgagctgagattgcgccactgcactccagactgggtgacagagcaaggccactgtcgcaaaaaaaaaaaaaaaaaaaaaaaaaaaaaaaagcgggttctggagctgtattcagtgcagtcacaattccttggctgtcaggacctaaatttaagtataaggtgaaattcacacacagtacaattgtctgggaaattcactaggagcttgccatgtttgtggacaatgcatctctctgtagatccaacccagtgaatttttttcctctagcgttggatcaactctctctataactgagcacctgataaaggcctcggcttgtgtttagaggccaggttgcatgagggaaaagtatctttaaacactaagatagcagagagtatagaatgctcacgccacaagaggtgttcggggactgagcagacacatgaaggaagggtggactcctgaccttcatctcaaattgactcccgggccttcgttcactggggggaatacaaggtggacttgtgttcttcatttaatttgctttttttcttttttttttaagttggaatctcgctctgttgcccaggatggagtgtagtggtgcgatcttggctcactgccacctccacctctcaaagtaaagtgattcttctaccttagcctcccgagtagctgggactacaggcacatgccaccacacatggctaatttttgtagttttaggggagatggggttttaccatattggtcaggctggtctcgaacttctgacctcaggtgatccacccgccttggcctccccaagtgctgggattacaggtgtgagccacagcgcccggcctgcatttttcttccttcagttgtttgtgtactgaatctatgtaaattaaatgcaagtggtgatgtgatgctgctgtaaaaccgacctgaacatgtaggtattgtgggcaaggacagcaacccagtaatgatacgtgaacaatggatgacgtacaggaagtttacaggacatttttagttgatagcttcctagacctaggtttacgtcctggttctcctcttgctagctgtctgatagcaggcaaattacctaactctatgcctcaattttcatatttgtaaattccaactcgtgtctttggtgaggatttaaataaggtaagtaagaatatctggcacttagtaaatattaggctggtgcaaaagtaactgtagcttttggcatgatggcaaaaccgcaattacttttgctcaaacctagtattcaataaatccctcttgcttctcctccatctctttatgtacggctacagcatctgggcatgataataacattaaaaggggcagttgttgccaaatgataaagagccttatagtaccagttgaaaaccagactccccaaaacaaaataacatgagttacgtaattataaatttcctagtagccacgctgagaaaagttgaaaaagatgaagctaattttaataacgtattttatttaacccaaatatatatataaaataatatttcaatatattcaatataaaagttgttaatgagatattttacatcctttgttttcattctaagtttttggaatccaagtgtattgtacacttaccacacatctcaattcaacggatttacatttcgaatgctcagtctcatatggctagtggctaccacactggacacatcagctgtagataagggagaaccactggaagatttaatcagcagcgtgggatgctttggtaagaggacgctgtcagcagtgcttgggatggattataggtgagaaacagtacaagcctaatgattggttaaaaaggtgctatcacaggttgggcgcagtggctcacgcctgtaattgcagcactttgggaggccgaggtgagcggatcacctgaggtcaggagttcaagaccagcctggcccacatggtgaaaccctgtctctactagaaaattacaaaaactagtcgggcatggtggcgggtgcctgtaatcccagctattcgggaggctgaggaaggagaatcacttgaacccgggaggtggaggttgcagtgagcccagatcacgccattgcataccagtctgagtgacagagcaagactccatcccaaaaaaaaaaaaaaaaaaaaaagttgctatcatgatctagtggaagctatccagggtctgagcaaggatggcatgaatggggacagcaaagacataggaaggggaaaagcactgtgaaatgagagttcacaggacttgactgacgtcatgaggaggatgaaaggagagaaaacagttgaggatgggggctattaggctagatataataaaataaaataattggtttatttctaaacataaaaactaattgttccccacatttgatagtatacagtttctagttagcttacttggttatataaacacactcttgattcctttcttacaaatgaaagagaaacaaaaataccatatactattaccgttactaaaaccctaagtagtctccaacttcccctcaaaaaaaacaaaaacaaaaacaaaaacaaaaaaatctggagaaagctgtaaaatactcatcaagaaatcattaaggctgggcgcagtggcgcatgcctgtaatcccaggactttgggaggccgaggcagacagatcacagggtcaggagatcgagaccatcctgcctaacacagtgaaaccccgtctctactaaaaatacaaaaaactagccgggcgtggtggcgggtgcctgcagtcccagctactcgggaggctgaggcaggagaatggcatgaacccgggagatagagcttgtagtgagctgagatggcgccactgcactccagcctgggcgacagagtgagagtctgtctcaaaaaaaaagagaattcattgaaactgtctactagtctggtagtttctccaaggcacagaccaagtctcatccacttctctctctccccactccctaaaaaggcagccatattacaggggcctctgtatgaaaccaggacaggtttgttgatctgaacaaaactacagaacaaccaaactgaacagttttctttttgcttttaatttttattttttccctatgttgctcaggctggtcttgaactcctgaccacaagcgatcctccctcctcgtcttcccaaaatgctgggattccaggcatgagccacagtactgagccagtctttttttttcccctttgcattatcatgtatagccatctttaaaactgtgatttaaaaaatgtctgaagagctcaagttgtattcttatcagttgccccctgagataattacagcttttattgctatgtcagtaacatgttgatataaacttggttttctcaatgaattttagccagttcctgaaataacatccctgaagaatattagggaaaagtaacaacacggcaaatctgctttgcttttgttgcaccacagagattgttttaggaataaacagaactttcagaaagaatccccagatatgattcagggagttaactcaaaagtgctctttaatccataaatataactaacgtcatttttcaaagcattaaactaagtgtgatatgaaaagctacacacagacaaacacacaaattaagtgaaaaaaatgctaatgctagtttaggtctagaggcatacaccggcgtaagaggcaattatgttttttgctgttgccattctaaccaacagactctaggggaaaaaaaggaagtgagaaaatgtttccatcccaaattgctagagaccgactcaagtatctggtgaagtgacaaaaatgtaatgggatgaatgacacctgatctttcccatcatttacctagatattcccaaggccagcgtgtgagcaagtcctccccgtgctcccccgacctcaagtagaaaggctctttctaggatgcacctccttacctcagacagcaggtgctgaatcacaactgtcaatgcctcaaacttggtattaccacaggcaagaagctgcttgagctgcaggataaatccactttggttttcacattttgttttatattgcgtcaattcaagtgttttctcagggggcagcgcatcgggagctgtctgtggctggatacataagcttcgaggattcttttgcctgctcttttcaactgcaaaacgaattaacataggtacaaagataggtgaggttaatttttaaaatcaccaccacaaggattcaaaaacaaccagataagccacagaaatccatttaagttatgttgctgtaaggaatgcatatggatgagaactggaatgaatcggagatctagacggttggaattcatgaacagggaccgtggcttcatttatgactttaaaagatttatggggaacagagaattaggaacatgacacaaatggatttggcaacccagaaacacaaaaactgggtgcaaaatgttgttctcctcgtttctcattttccagttaaattggtagagaaaccttgactgaagagaagcctgacttttctgatctcatatgctgaaaggaacacacaaatcactggactttaaattaaatgcctttctctcctcccatacattttctacaaatcttttaccttttccctgatgatggcctagccattacacagatttataccgcagatgagtcatttcctaatctctaataaatcataacatacatcgaaaatatactcagattttgcctctttaagttcactgttaggagtactatactgttgactatactattccattttctatcgaacacaagctttgttggtcttttttcccaagtagtaataacggcttacacagtttttttttaaagcacatgctaacactccaaatccacccaaaatgccacgctaagtgattattcccttcctgtgcaatggtgccctgggtattactctgttttaaataaaaaactgttcagtcttggaaccattccaaatgtgtcattttgaatatcaaacagaattggaaaaacaggacatcaattgcttaggttcttgaaataaacaagccaagtaatccaaacaaatgtaaatctggaaaaaagacacaagaaactaaaaaaaaaaaaaagtttccttattctaacagtctttcattacagcatccacgttctgtggtagcaaatctgaaacaacttttaaagaaatttagtaattactgtctctaatttttcaggaaaaggcaagctactacagtgattgcttaaagaaacatcagtactcactttctaagaacaaatggctaaatatattgaataaactaagttaaaaacagggaaaaaaaggctcttattttctatggctgcattacatggttaaataagtcatatttgtattaatacttgataattctcagttctaaaatcactaaaatatccattgtcccactgtgtctctgtaatacttgatgagaggaagtatttatccattactctttattattagcaattattagtagtagcttatgaataattgtcacttgcatagatgtagaaaatagccaagttaatatcgtaatattacagccctgaaggaagaacaaattattagttacatactaatgaaaaataatctaaatatttgaccatgagattagcattctttcatgtcatttcctaaatgtttttagaaattgtcacataacacataacaattccacagtgtttcgctcatcacagtgtgctctcactttccctttcttttcatcctcccaataaccccagatagggaagagaaggctcacaggtgtgaatgtcttccctggatgtagacaacttctatgggaatccagattcaaagtcagaacccaggcctctgatgctaagcctcttctgttcccacacattttggaaagcggattaggtggtgatgtaatatatgacatacataaaaataaatatttatgcaacaaatgtaataatatcttgctataatacatataagcccattatctgataactcattttaacaaacctacatataaacatctatgtgttatataactttataaacaaaaatgttcaaattctttcactatctagaatttactgtaacaaatatagacacagttcattctcctgatatcatttgtatatgtcctaccgaaacttacttaaaaattcatttattgataactcctttatcatttcctgagtcctgagtaacatttgcctctctttctagaatttctatgctaatcaacgctatttttaacacaatttcagagctttaaaactgttggtttataattatttacaaaatctgagaggtgagtcttttatattaatattttggagaaaatattcttcaagattcttgctttttgcttataaatccgtaacaaaaatatcacagaatacatgtaattgtactaacaatgtttacttttgaagggaaggtaataggaatcagacagctaaaaagtatcctgaagcattttttatactttttaaccatggggtaaatatattacctattcaaaagttaaatataagaagtaaataaaatcacttttaacagacagttaaagtgaaattcgaggacatacattttttatataatacttagctatgaaggaaatagtctatgcagaatttttccttggggaaactacacaggaatctaaacattacgcagggtttgtaagtgattactcaggatagctttatgattaaggaggaaagaacacattgatgtattcgtctaagagtacgtgtcttcaaattttaaaatgagagcaaatgagccaacagactgccctctccgtggcgctggaaactcgtgctgtgcagtcaccatcttccgctccatatactgtgctccctaaggatgaagtgtgaccgcatggcagccgatgacccagtttccacatgcttcccactctcagcactcctggctcagctgaagatcagagatgatgcaaaaatctccaatgacgctcaaaaccccaaggctcatcaatacgtacttcacagtactgaaaagccaggggttcccttaaatcctgcaggattcattactaacgtgaaattagcatattatcagccaaactttgcccttacccttgcttattagcatgttactgttttgataacaaaggttttatacagaagtataaattattttgtttactgtacctattaacagaacatgttctgattttaaagggccaatttaatcagaaaccttaaaattaaacgtcaacttctatatcgattcagatttatctcaacaagataattaccaccatcagctgtgatccagccttactgggactcattctaatgaaatggcagcctccatcaggaaaacgaaggccagaaccaaagacatttgctcatttggaaagcagctggatgaccctgttggctatctttgttctttctattcagaaacctcaatttaataagatttaaaactagtgcaatgaagtcatgtatcatcttcttaaagaaagtagttggttaatgaggaagatgcccatttctcaggctcaaatcacttaggcaaatagacctccaaatcccaagaccaaaaacaattttgagagaaaaacctaaccattaagacatggactaaccgtaaccacatactagcagctgaggacacattcattctaggctgaagaagccacacatttcctcaatctgctggcttttccaattattaaaatcaagttagagaccagacctactgagggagtttgccttgggttccgtgaaacacaaactaaacacagaatttggaaacgaacgttgtccacttttgtgtatactcactgacctactcactcactcatgaaatatatttattaaaatctaccatgagggcactgctgtggtgggtgtgcacctgccctggtgctttgcggggacaggagaagtatcacataagagggtggtattgctcagagaggcacaaagacaccaaagatctctgctgactcatgtttccctagtgctcagctcttcaactccaaatctcaacctatctgtaaaaaggtgacagtcactgactggatggtaagtcctttctacaacatattgcattaaaaaccgatgtttgtgggttgacaaaacataggttatgaactcagaagctagtgagaggtctctctctgctagcggcatggacagacagaaaattcccttttttctgccttaatctaatcgtacacatctaaaagccctcacagggacactgacacagaagttctttcagtcagtttccccagcatctggtggcaggtgcttatcctgcctatgcaatcttacatacagttttttaaagttaccattcatgtcaattattagtttatgtttgtataaagttttctagtgttcattagctgtttactctaaaagagttaacagtaataatttaggagacatatatttttctatttacatataatatttttctatttctaggtagacatggcatttactgaaaatggaaaattttaagctcagcaaagcacagtgtttagacatttagaattacccaagccaggccgggtgcggtggctcacacctgtaatcccaacattttgggaggccaaggcgggcagatcacaaagtcacgtgattgagaccattctggctaacacagtgaaaccccatctcgactaaaaatacaaaaagttagctgggtgtggtggcacctgcctgtactcccagctactcgggaggctgaggcaggagaatcacttgaatccgggaggtggaagttccagtgagccgagatcacgccactgcactccagcctgggtgacagagcaagactccgttctcaaaaacaaacaaacaaacaaacaaaaaaccccaagccaagcccaattatttgtagggggagggaggaggatttaggatgcctcaccatttaaacttttcattactatattggtagaattcgttgcaatagctcatattatatcaaaaagggttctacttcttttcttcacattaaaagcagattagagaatagaaagcatattcgagaatagaaagcatattcatataaaaaattcctgtttgggttaattacgcttataaaatttttcctgaagcaacagtccaaacttgccctaaactattttccatatagctggcaggaaaaaaccaaatttctcatactcttatgtacctaaaatggactcctaactcaaagaagagttaatataaattcaccacattcagaagtacttttaagaaggcattgcctctctcctatagcaaccaaaaaagcatggcactggtctaaaaatagacacatagatcagtggaagagaacagagaacccagaaataaagccacatgcttacagctaattgatctttgacaaagtcagcaaaaatacatacaatggggaaaggacaccctattcaataaatggtgctgggaaaattggaacagagaaactggagacctatctcttatcatatgcaaaaattaagacagatttaagacttaaacgtaagacctgaaaaaataaaaattcctgggtggggggagggaactagaaaaaactcttcacaacattggccgacgcaaggaattcatgactaagatctcaaaagcaaatgcagcaaaaacaaaaatagacaaatgggacttaaactaaaaaggttctgcacagtaaaagaaacagtcaacagaggaaacagacaacctatagaatgggagaaaatatttgcaaactatgcatttgacaaagatctaatattcagaatttacaaggaacgctagcaactagcaagaaaaaatacaaccccaataaaaaatgggcaaaggacatgaacagatgtttctcaaaagaagacacagaagcagccaacatatggaaaaagtagaacatacgaaaaaatgctcaacatcactaatcatcagagaaatgcaaatgaaaaccacgatgagataccatttcctatcagccagaacggctattaccaaaaagtcaaaaaaccacagatgttggcaaagatgtggagagaaggcaatgcttatacactgttggtgggactgtgaattagtacaatctctatggaaaacagtatggagattcctcaaagaactaaaaatagaactaccattcacccagcaatcccactgctgggtatcttcccaaaggaaaagaaaaacacagactatcttataacagaaatgaaaattaaaatagccaattaaaacattaaacattagaaatatttacaatacaaacaataaataaaaagagaacatcattctcaaaatactaaactgtcgacaagcaatttggaagaaacgtgcctaggactcaggtcaccagggagaaaaaaggcaaatctctcaccccaaaagaaagctctattactcttaattttccacagagccacataattgctgatgtttataaaaaggaccctcgtgtactaaaatgacccaaagtattgcctaagataaatacagaaatatgatattcaatattagatacctctaaaatcacacctgttgtgtttctaagaaaataatatgcatatactattaataaaatattattcttagctctgaaagaggctttaaagctcataaaaagcatcattacattaatttatagggtaattatctattaattaaccagaataaattgttctaacaaaacaagtatttacttatatacagcttgccatattcctccagtgtctcttgatgaaaaacactgctatccttcccattctgaatgcaactctaaaccgtaatttattacttactttccatttttgtgtaaaagtagatactacattaaaacataatttagtgtagtaaaactctagttatctgaaacttgtcaaattaggacatactgtccctttcaacatctcacttttaaaaacttatcaaaatcttacctattgtgagcaaaacttgccattcaacactttattgtcttcttcaattgaaagctgtaactacaaaagggcagatattcatgtcacggcaaagctacagctctaaaaccgccacagctaccgaagcttggaatcaatccacgacaaaacgttttcagcatcatgccattcatcacaccagttcttagcaaatgcttgtctatgtggcaagaggccagcaaaatctttcatgactgctttcaaggaggctgaaaggaagaatctggattcacagtaagataactaaggggcagtgaaagactacatctctcgttcttcttcaccttggtccttttgatttcttctacattctacaaatccctgaattttaccttttcacacgcaaatgctaatatatgtgtttttttttaatggaagctttctaatatggcttcattgacgtctacattttgtagtacgaaaaacacaagagaaattgaagtttacttactgtcaccttaacagtacatgaataaatgccctcctaatccataacacatccataaatgcgctaataacatattaagcatacaaaagccacatttaaagttgaacacattcttcccaatgtattttataactgaaaattcattcaagagatcaaaaatcaaatgttaagacttacgtccaaacgacaaaataacttgaaagtttaatggaaccattacacacaggtaatcaatgcccctccaaaacgcatagaatagagaaaaaatagcaaggcctgttgcaagatccaacttgttaaataatacactcccctcatttataatcggccaacatccgcttgagaaatacctgttctgccttctctgtggcagatattccaatagagctcttataacattttatacctgtctgtgggacagagactagagaagtcacacgctctatttcccagcctcccttccaggtcgagtcatgtgactaagacccggccaatgagacggaagcttaagcgacctggcaccaccccttcctcatttctttttcttccttcctggagcagctactgtgagatcatgaggcaacaatcatgaggacacggctaagaagacagcagagatgaggattcctgacacggcagagccaccgaacaacctcaaagctgcttttcttcaggtgagacaagttgcttcttagtgaagctgttaattccatctaaaaagagtcaaaagtgaataccaaatgcgagaacataatttgatgaatttcatcctaattaaacaaacgcattcacattctgcctgcctgttactgaacacttctttaaaacggttctcttcacgaacacaaagaagggaaacaacagatgggggtctaattgagggtgcagggtaggaggagggagaggagcagaaaacaataacttgggtgctgggcttaatacttgggtgatgaaatcatctgtacaataaactatttattgtacaagaatctgtacaataaactctgtgacatgagtttacctatataacaaacctttacatgtacccctgaacctaaaagttcaaaataaaataaaatggcaaaagtaaatggaaatattttgttctgatactacctctgccatccctcgatacgtacgtacacatgttcctcccttgcgctgcagtaatcacttttaatgtcactagctcagcagaaagaattctgtctttagcgtactgaattgccttcactggagtcaagaaggaaattaacctgtgaggttcaaatggcactcttcatagcaattaatacaagaatttccagcttcatagaaaaactgaatgctaagtggcagggaatatttcttagcaaagtcttttccctccactaactcattataaaaatagaactaatatgttgaggtagaattccgaaatagaccgagtttaatactttggtaaaaagactattgctgacccttctccatgtcagtgacgtcatcactggacttcttagattttcatctgtgcctaatgtcctgcaacatcacgcacagttcctgacaaattcactcttttcctcctctcccctgtttaaagaggaaagataacctcgatccaacaacacgctttgccagtgatggataccacccagtaataatatatcagagtgcccagtgccctctgcgtgggatcaatgagaaagcttattctggccggatctctacaatgaccagcccccgtcccaccacattctatgctcagaaatactacaactcctttgtttccttgaaggagcccttcctcaagcccctcaaggtttttacatgctgttttctctgtcggaaacactttgtttcttagtaaattctccatttcctgaggacccaacttaaaaggcacttctactggaggacctggattaaaggtacctccacctgctgagagctgcttgggcacaagtccacaccctgcattattaactggtgctctgtctccttctgttaaacagtgggctgtgtgaaggcagggtccatgtgggacttagtcccagtcatactttcagcacctaccattatgcctggtacacagtactcatctaacgggtacttctttatgaaacgaatgaattaatctgtaatgtgaaagacagtctagaagcaagggaaaggctggaggcacagaccaaatactaagctcttcagaaagcccagtcaacatcttaggctggattatacaaaactgttcctatttggctacttttgacttattatacaaaagtgttcatatttggccactttttacctattaattttttgtgtgtggttttttaaatagagacagggtctcattaactctccagggctggtctcaaactcctagccttaagtgattctcttcccttggcctcccaaagtactgggattataggtgtgagccagtggcaccagccaggaagagcagtttcaatgcttcaacatgataatgcctggactagggtaatggcaggtggtaaaaacaaatcaagatttcaaatgatggagtcttagagttttcaaccaattgattgtggataaatcaggacaagtaatgattcaaaggtgaggtttggccagacgtggtagctcatgtctgtaatcccagcactttgggaggctgaggcaggcgaattgcctgaggtcaggagttccagaccagtatggccaacatggtgaaaccccatctctattaaaaatacaaagaaattagccgggtatggtggtgggcacctgtaatcccagctactcgggaggctgaggcagcagaattgcttgaacctgggaggcggaggttgcagtgggcccagacagcaccagtgcactccagcctaggcaacagagcgagactccatctaaaacaaagcaacaaaaaaacaacaaaaaccaaaggtggggtttgatgaccagacacatggtgtcatgaaaagaaacagataattcatgagtattaactgaatttaggaggtaaaaaaataaggagacaaatcatttagataagatgaatttccaagcagagtaatacactgagggttttcaaatcttcagccagaaattcacagatttggaggctaaggggaacctggaagtcatctcttgtggttcccttattttgtagccgtgtgaggttaggtgcacagggctattcacttggtcaccagcagaatcaaggctacaatccaggcctcttgggatccaggtcaacaccactgcactgaggcaaccaacaccacttccttcactaaggataccaacccaagttactgctgacagtccattcagataagagtcaccatgacggcatgaattacccacttgacggacgatttctcggacgttaaaatgacataacatggataagcccatcaaagactgatattgggagtaagcagaattatattccttacatgattttaaaaagcctccaacacacaaaacgcttcctccatccctgctattccttggatctaacaaaattacagcaaaatttgcagctggaaaatatgtacgccaaaaattctaaatagaagtcccaggttttagtcctatctctggcacttactgtgtgcctctgggcaagcgaattcacttctctgggcctcagacttcctggtataagacagattagatcacctctatgtgaactctagctcaaaaaattatgactgcaaataaacagaaaatagttttacgtaagtttagaaaataaaatgtgtccaatacatcactatcaactaaaccctggtaatagaagccttgtgtcgtttgcttacgctgtcttggaaagctatctgcttcacaacaacactacagacaacttagaatgtctactactagagcactggttaagtaaatcatgacttacccaataatggaatgttacagaactattttttttaatgaggtagataaacatgtgatcacatgcaaatctaaaacacattaactttaaaaaggtatagaatatatagtacgcttttatttctgtataacaaaaaagaataaaaaagacctgcatagatttacatgtgactggaaacgtgcaagaacactatgcaagcagctgagagcggctgtctccacggagagcagacagggactctgggtaagagagaggcttgcctaggactgcacaaccttccatactgtttgatttttaacttggagcgtggattacagtatttttaaaagaactctttaaaattaaaagctatttggagctactttagatcagacaaattattgcaaatatagggcaccctttgttatttttcccccctattaatttgttcagttggaagggctgcagcggccctgagctgggagaggagggccactgctgacctcctcctcgctgcctccccccatttaccgtcagctcagactgaaagggagaggctggcaaaatcaaatgacaggtcaaggggagttatgaaacacgagagagaggtgctggaaaaaatgagaattctcccacagagaagggagatgcctctgggaaaactaaaaatagtcagctgaaaacaaatcaccagggacagagatgagccacgtggaaaataagaaacacgaggggtcacgtgcacatgaagcagaaacaaaaatctatttacatcctcatcaaacattcctgtgacacctaacgctattcagcccaaaacaaatataaaaacaccccagctaacatattttacagaataaaactgatttaatttactgtagctgtaaaatcatctaggacaaaagtagcaacataggccaacccaatgccctaaaagtgagcagacaggtcaccacgtgcctaaaatatatactaaatttattttcatcttaggcaccgaaaataataagcagatacaaacataaacctcaggggaagtattttgagactgcacacacttttattatgaagattggaaaactagatttgtgattcacttactacttccccataaccattaggatgttttctgtcagaagtgtttagtatacagaaatcttttagcatattaaaattaactgtcaaatctgactgagaaactatccaatgaaaaacgatgggaaccttctcatctacacaggcgaacaggaaatattcttctaaatttacctgtgtcctatttcccaaacactggaactaaaatataatttaacaggtgctgattttcacacatttggctggtgatggagaaaagagctagggaacaccaaggcaacaattctgccttccatcaacacaaacaacacaatctgctgccaaaagtaaaagtactatgcacttgtgctgaagcaacagaaaacaatttttaaattaagcctcatctctcattagagagagcttttttcctccaattatctgtctccttggaaaaacctctgataaacatctgcaaattaatgaagacatcccccgtgcaacactaaacagagatctatgcgagacagacctgtgtggaaaacaacagtgcttctcctaaaccctgaaggaagtcgaaggtttcgaagcaatcctttggccgtcagtcgtatgtgaatggtggataaggagaatttgggagacaacaacatgtcttcggagcaggtggcgagatttcacagaagaggcaatttccatggactgtcacatactgtctttttaaactcagtactcttcaaggccaagaaatacagtcagaggaaagatgcctacacagcaaatgtcattccaccagagaggcatagaagaaaaaaatcccccagggctggccaagtgtttctggcttccgttttcactttcagatgttgccaaaatgatgctcttcctctgaatacaatctccctcctgcaggtctagaagctgcctctgaaccacatcacactgtgcatgcttgtggagttgttatggttttcatccgagatggtaaaggggaggagaaagtgggtggtctcaggagctttacagaacaaccaataatgtcacagatcctgtaaccacttgaaagatcgctaggggaaattaactacttcaagtgcctaatgtttctttcataattagaaaaaaattaggatttcctgaaagtaaactgtgtcctgattttaacatttttcactccttatattcacaatgataacatgagcattttttctctagatattttacatgtaaactacatttaaacctggtattttggaaaagttttttttttaaagacttcaggcaataaatgttctcaactacaatatttaagaaaatttctattctaatatattaatgacagattgtcaaaaggttaaagttcaactttaattcccacatgctgaggacctcacaaataatcaacagtaaaagattaatacggtttctctatcagatgtaatatcagagttccagaagaatagtccatcagataggcatattctaaagactacatttattgcatgagtaattgcatttatagaacatcatgtggtctcttatagtggtctttcaagactaggagtgtgaggagggcacagttatgaatatcttttgccagttatctactaatttttatttcagtagagtggcttgtaaaagtatgttaaaacatgatagcaaaaccaaaagaacttgaaaaacaaagatatggttataagaattaacaacaacaatatgcccacttaagctaattccattaaaccacgaatagcctgagctcttaacatttttaaaaatgttataaacaaaacaatgttttaaaaatgtcctatgcctgtttccaagatttcctagaaaataagactcagaaataaatgcagaattgttaccataaataacactattaagtgctattaaaactagcaggaagcagttcttttagaaattctatagagtagggtatgaagcagggaagagagagggaggaagagaaaatttaaataagttctcttccctcaagccccctccctcttcactcaagcccccaacttgccattttagaggttgtcagcaagagagacagacccaataacctgtccagggttcctgtgagaaagatacacctagttcatacactgacgaaaaacctgctacatacattgcaccacagcaactgaagctaaatgatcaaggaattaaaatcaaggccagctgcttctaggtgttgccttttacttcatcccagtttattattaaaaaacctgaacaccttttccttccagattctacatactaaaaatataccagaaccttttcctctacctcccaaaaccttgtaaaaaccaagaaaccaatcagcattaaaaacaaacagaagaacagagtcaaattttgccatgattaaaaacagacatgccaccactccatatagtaggaggtggtttttctttcttttggttgtgtttgttgtttcttcagtaacagcaaattctaaattatccttttttgtttgtttttgtttgttttttgagatggagtttcactcttgttgcccaggctggagtgtaatggcgcagtctctgctcactgcaatctctgcctcccgggttcaagtgattctcctgcctcagcctccgtagatgggattacaggtgcccgccaccatgcctggctaatttttgtatttttagtagagatgagttttcaccatgttggccaggctcgtctcgaactcctgacctcaggtgatccacacacctcggcctcccaagtgctgggattacaggggtgagccaccacgcccagccttaaattatccttgttaaaagggaagttctttagactccctaaaagaagaaattaccatctaatcatcgattaatcagattcattaacatttttacttgaattacattaagctataaccacacatattgaaaataaacattgttaatgatatctcttaacagcagagcaagaagctgcaggaataaactaaattcagttctttcccaaacatagtctgcctcctggtggccgtgcagcacaagtgcaccaaagcaagggagctgccttggcagtccataaacaaatggccatcgcttacaatctactgctccaagcactctcttacacactttacgtttgctcatttaaataactggataagcaattactttcaggtcacaactatttttatactatatatgcctctggggggagccaagataaaaaattggttccaaaaaattctttgattatttgatcatctgttaccagttaggaactccatattttctgaaattgaacgaatgtgagaagtacctaaaaaaagcatctttgttatttttaaaagtcttaatttaagaggaaaagataggcatcaccaaggacagtagaggaaaaaataaggaaattttagtgcctaaagtacaacagtttgtagttgtaaaagttagctatgagtctttatgggccgggcgcggtggtgagattacatgcctgtaatctcagcactttgggaggccaaggcaggtgggatcacctgaggtcagaagttcaagaccagcctggccaacatggtgaaaccccgtctctactaaaaacacaaaaaattagctgggcatggtgacaggggcctgtaatcccagctactcaggaagctgaggcaggagaaccgcttgaatctgggagatggaggttgcaatcagcagagattgtgccattgcactccagcctgggcaataagagcaaaactcctcaaaaaaaaaaaaaagatgagtctttatgaagcagagcctgtgttaggatgtcagtggaaaacaaaaacatgatttaaaattttatgcaatgtaggatctcaacattaaacaaaaacgattaagtatattggagcaaacatgccagaatgtcaccaatgctctgggaggtagaagagggaggatttctattttttctttattatatgtttttgtattttcctaattttttttttcaaaaatcatgcagccagaaaaaaattaaaaagtttaagtgttagaataattttatagaaagcctacaaaatgagccgagttttcataatgacacaaagaaaaataaacgatgtgtaaagtctatactaaggcttaaataacaaaagaggatgatacagaatgtttcataagtcagtatgttgtaatatcacagtatattcaaacaaacagaaattccactggtctgcatagaaatgtgtttttttaaatcagtgatttagaaaacaatgatgtcatgattctagacaagaatctagcataatctgtatggggtgcttagatgctacaaaatgccttcaatttatctgttattgtttgttgttgttaatgatcataaagaatgaggaagaagattaaaatttaaaccaagtgacttgtgtggagattcaagcatctctatccaaccaatcttccttagcctaatatggaatattaatctttatatttatctccttactttccctaacacagcattaattgcaacattttcttcattttactcctcacagtctttaatgtagtaagttcaattctctattccagttgtagaaacttcaacttaaggcccaatttttccacactatcctcttcctcagtacgaagataaattgtaattatcaaaaaattaacacaaagcaattagaaaaacaatcaacttccacccacctgtaagatgataagctctcaaagaacagtgacattgccttttattttgcaataagcaaaataagagtttaaattaaaagcagtaatgcttttaattcatgtacaatgtttgtttttaaaaaacaaaacctcatatgttcatcgtagaattttttttttgagacggaacctcggtctgtcgccaaggctggagtgcagtggcgtgatctcggctcactgcaagctccacctctcgggttcaagtgattctcctgcctcagcctcctgagtagctgggactacaggcgcccgccaccacgcctgactaattttttttgtatttttagtagagacagggtttcaccgtgttagccaggatggtctcaatctcctgaccttgtgatccacctgctttggcctcccaaagtgctgggattacaagcgtgagccaccgcacccggccagaattttcttttcaatttaaattacttacacatcagactgctctccaatttgtttttaaacttaacataagcttaataaacttattaaacttaaaaatttcacacttatctttccatgggattaaataagcatttatattgttattttaatggcttcaaaaatgtctttaaaatgtcaacgaacttaattcctgtaaggtatataggttgtttccaattttcccccattgtaaacaattctgaaaagcagtcaataagtaaataaattactttcctaggaccaattctgaaaaacagaattcccgggtggaaggtgtttgctctctgctacagctgctgtaatttaccaaggagctgtacatatgagtgctgtttcttattcttcgccagtaccaggtgctaacattaagaaataagcaagaactgagagcacattattttaactcatatttggtaaacatttttcatatattccttagtccttcatatatttcttttctgtccatccacttatttttccctttctttttgtttagtttttttaattgtggcaagaacacttaatgagatctaccttctcaacaaaattttaaaagaacaatataatattgttaactgtaggcacaatgctgtaacaaacatctcgaaaaccttttcgcccttgcataacaaaccttgtaccattgaacatcaagttcccattccctggcaaccaccactctactctgtttctgactttgactatgttagatgcctcctataagtggaatcatacagtatttgccccatgactggtttatttcacttagcatagtgtcctccagctttatctgtatcacagcatatggcaggactttcttctttttaaaggctgcataatactccagtgcacatatatgccatatttgctttatcctatggacacatttaggttgttcccacatcctggctatcataatgtggcaatgaccattgttgcagggagtcagggaccccgaatggagggaccggctggagccacggcagaggaaacataaattgtgacgatttcatggacatttatcacttctctaaaaatactcttataatttcttacgcctgtcctactttaatctcttaatcctgttatctttgtaagctgaggatgtacgtcacctcaggaccctgtgatgattgcattaactgaacaatctgattgcaaaatgtttatttgaacaatatgaaatcagtgcaccttgaaaatgaacacaataacagtgattttagggaacaagggaagacaaccataaggtctgactgcctgcgcggtcgggcagaatacagccatatttttcttcttgcagagagcctataaatggacgtgcgagtaggagagatatcgttaaattcttttcctagcaaggaatataatattaagaccctaggaaaagaattgcattcctgggggtaggtctataaacggccgctctgggagtgtctgtcctatgcggtggagatagcttggccgggtgcggtggctcacgcctgtgatcgcagcactttgggaggctgtggcgggcagatcacgaggtcaggagatcgagaccatcctggttaacatggtgaaaccccgtctctactagaaatgtaaaaactttgcctagcgtggtggtgcgcacctgtagtcccagttagtagtcccaggcaggagaatggcgtgaacctgggaggcagagcttgcagtgagccgagatcgcgccactgcaccgcagcctgggtgacagagccagactctgtctcaaaaaaaaaaaaaaaaggactgagagagatacgccctggtctcctagtctcctgcagtaccctcaggcttactaggattgggaaacaccaaccctggtaaatttgaggtcagaccggttctctgctctcaaatcctgttttctgtaaagatatttatcaagacaatacgtgcactgctgaacatagacccttatcaggagtttctgattttgctctggtcctgtttcctcagaagcatgtaatctttgctctgcctttttccctttgaggcatgtgatctttgtgacgtactccctgttcatacaccctctccccttttcaaatccctaataaaatcttgctggtttcgcggcttaggtggacatcacggacctaccaatatgatgtcacccctggaggcccagctgtaaaattcctctctttgtactctttctctttatttctcagaccggccaacacttacaggaaacaaaaataacctacattgaaatattgggggcgacagaccatgggaatgcaagtatctcttcaacatcctgatttcaattattttggtaaataacgccttatcagacgtatggtttgcaaatgttttctcctatctcataggctgccttttcatgctattaaatgactgctttgctctgcagatttttaatctgatgtactccaacctgtctatttttgcttttgttacctgggcttttggtgtcataccaagaaaaatgacatgaagttttgccccatgttttgtttgaggtgttttatagtttcagatcttatatttaagtctttaatccatctcgagttgatttttgtgtactgtgtgagataagggtccaatttcattattttgcttgtggatgtccagttttcccagtactatctacaaaaagactatcctttccctattgtgtattcttggcacacttgctgaagattagctaaccgtatatgcacggatttatttctagactattttattccatcggtctatgtttctatatttgtgccagtaccatactcttttaattactgtgtgttgtaatatactttaaaatcaggaactgtgatgcctccagctttgttctttgtcaagattgttttggctatttgcagtcctctgtcattctatatgacttttgggattgttttttctatttctttaaaaaaatgacactgggattttgatagggattgcactgaatctgtagatctctttgggtggtatgtccatttagcttctattatagagttgtctttatcttgctgatttgacagagctctacacagagtatgtgctaatataacctcagtttgttctttgcttataaatactgtttctaatgatttttattctttttattttttttgagacggagtcttgctctgtcacccaggctggagtgcggtggtgcaatctcagctcactgcaacctctgcctcctgggttcaacgattcttctgcctcagcctcatgagtgctgggactacaagtgtgcacaaccacgtgcagctaatttttttgtatttttggtagagatggggtctcagtacgttgcccaagctggtcttgaactcctggcctcaagcaatccacctgtcttggccccccaaagtgttgggattacaggcgtgagccaccatgcacagcctgtttctaaggttttttaaagcttttgttgtcctaattattaatcgtttctattatactagtgttcctggaaagatcttttctacttaagtctatattcttagtgttttaattactttgtgtgtttaaaactaatttatctgaaatactttgtatatatgtgaaaaagatctagctcctgctaaaaaggtagtcactgtctcaagaagatttactaaatgatccactcctcacaacccccaacaccaatttgaaacaaaaatgtatcccatatgaaaagagcatctgtgttttaagtatagggggaaagttatgttaatcataaaacaacagtgaaaaaacagccttctctctactctcaccagaagaaaccctggcagcctcggcatcacctcatcagcaggtttgcaacttgcaaccacttcccagcacttggcaaaagaaggcaagaaagccgccctgttctcctgtgatgtctttactaagtaactgcggaaggaccagtgcattttctaccttccaaggcagacactctggcacctgagagtgatgatcttgtgtaaaccaatcagggtactggataaatacagctctgatgcctctggtatgccagtggctttagtgtatggtagaaccaaggtaataatagtattctgtggtatgtgtgacatcttccttatcagcagtaagccaagattttttttagagtcaatatcaactacaatcttgcagcgtcataacgtttaaataaattacaacagttagaccccaagaggttggttcttgactttaagcagtctttcctgcttgctttagagatttaaaataattcaacttcctggaaaagaaccctaaaaataagcccctagaattataaaaacaatgtaaaagatcgccatcattaccgttcctagcagctgacttaactattatttgagaaccttttataaaacaattctatgatgtcatattattgcctttctgggaattatttccccaatattcccatgtctccaaacgagaaatttgagacttggagaggcttagcaactagcccaaggtcaggacacaaatagaaagcagcaggacgaaggtttaaaccaacatcccgtgccttaaaagttcgttctcctcctgcttttctacattgtcttatgagataatgtaatttctttaattgataaaggtcaagctaaaacaatgatgtaacattttaaactattatgttagtcaaaaaaatttaaaaataatatccaatgttgacccaaggtatgatgaagccaggtgtcttttatgtcaaccacggtataaaatgatatgaagcttttggaaaacaatttggctatttgagtgaagtgactgtaaatgggtacatattgtgatttcctgatactacttttaataatctatcacaagaaattgaaagttgaaagtgctaattgtatagatgttcatcatagaatcatttatgaatgtgatacagaagcaccctaaatattcaaaagtagttaaatgttactgtatctgctaaatgtaaaagtgattactatatgttaaatgacaaagcaggatatacacttatctaaatttcatttaaaacgacaaattttaaaaagctgaagggtgatttctaaactacatgctaaactttttgaagtttggcaaactgctataattaaaagtgattattttactagaactaaggaatatgaagttggtcaactcaactgtaatctccaccactacttacagctttaaaataaaaatatctcaaagccatagtacaacgattaaaaatttacactcagaggaacatgtttatgtgtggaggcaatgtcttctgtatcagctaaaatatgactcatttccagcagaatatgaaaaaagtcaaggtgattttcagtcacagaatatcacagtagggagaaatctagaaatccaccctttcagttacatagaaaactattatcaaagaggttcaatgatccacccaaagtcactggcttttcagcatcatttttcagcatcaaagtcgtctttccaaagcaaacacactttgttgtggtcctctgtccacacagtaacttttcctcactaggctcctcataataccaggttagtcttaagtcatgataataactaaccatcgagaagaacctgggaaagtcatgcttatggtttcgggaaaatacagaggcctaccacacaatctagattaagctgcaatgttgaccccttagaatacattctatatatacagagtcatctatagattcaatgtaacagaaattattagaattggaattattagattacattcctaaaacctcacctgacttcattacagagattgacaagctgatcctaaaattcatacagaaaatcaagggacccagaatagccataactatcttgaaaaagaaagacgttgaatgactcacatcctgatttcaaaacttactaatcaagacagtgtagcactggcaaaggtaacatataaatgcaaagaacacaatttagaaatcagaaataaaccctcacattcttaaccaattatttttaacaaaggtgccaaggcatttaaatgggggaaatacatgtcttcaacacctggatgtccatgtgcaaaaaagaattagaccttctatctcataccatataaaaatgtaactcaaaatgaatcagaaacctaactataacagctagaatagcaaaaaaaacttaaatgaaaacacaggcttaaatcttcacaaccttggattaggcaactgtttctgagatacaataccaaaagcagaagcaacaaaagaaaaaaagttgataaagtggaccttgtcaaaatttaaaacgtttatgtttccaaggacattatcaagaaagtgaaaacacacccaagaattgggagaaaatatttgcaaatgataactctgacaagggtctaatatcagactatacaagaactcctacaattcaacaataaaaatgacccagtttaaaactggcaaatgatttgaatagacacttctccaaagaagatatacaaatggccagtaagcacacgaaatgacactcaatgtcactggctgtcagaatgcaaattgaaacaacaatgaggtatcacttcatacccagtagggatagctataataaaaaagacagacaaagccaagtgttgacaaggctgtggagaaacaggattcttcatacactcctggtgaggatataaagtggtccagccactttggaaaacagcctggaggtttcttaaactgttaaacacagagctaccaattgagccagttttctgataatggttaactaatttttaaacaaagccattccatagaatattagctatcttttttccccagatattaggatgtaccagaaacttaaaaggaaataaaagcctaaatgtgtacagcagagtttcttctgcatttttaccctataaaggctttagtaaccacatatattcacactcagcatcctggggatctttagaacttagatcattctgcatggctgtcttcctagctttaagagcctacaaaaggttacgaattctgagatagctgggcgcagtgactcacgcctgtaatcccagcactttcggaggccgaggcgggcggatcacgaggtcagaagatcgagaccatcctggctaacacggtgaaaccccatctctagtaaaaatacaaaaaattagccgggcatggtggcaggcgtctgtagtcccagctacgcgggaggctaaggcaggagaacggcgtgaaccagggaggcagagcttgcagtgagcagacatcgcgccactgcactccagcctgggcgacagagcaagactctgcctcaaaaaaaaaaaaagaaaaagaattctgagataatttccccacacttccctgcttattacactgaggaaactgaatacacctgatggggcatcaaggatatttgttattcatgttattcatgatgtaatgttatcccaccctgttttctttacacaacaggctcagaaatttatacctcttgcccaggtttccctcacatgacagccttcaatccggacctctcttctaggacaagacaaccctccttcctagaactcagtgcatttgtgattcatgtctatttgagcaggttttttattttatttttttaactatcctattagctctccagagacaaggcccctgctcattcttcgctcaggactgcatccttaacacctgacactcacaatgtgtgaacaaactgtagtcaacattctgtaacattacatgcatacctgggagatatatatcaccccataagacacatgacataataaggcaaatcacaaaaattgtctggtttctcagtgcatataaaacttatattaacactacactatagtctagtgtgcaacagcattatgtctaaaaaaatatataccttaatttgccaggcgtggtggctcacacctgtaatcccatcagtttgggaggccgaggcaggtggatcatgaagtcaggagatggagaccatctggctaacacggtgaaaccccgtctctactaaaaatacaaaaaattagccgggcatggtggcgagcacctgtagtcccagctactcgggaggctgaggcaggagaatggcgtgaacccgggaggcagagcttgcagcgagcagagatcatgccactgcactccagcctgggcgacagagcaagactctgtctcaaaaaaaaaaaacaccttaatttaaaaatatttcattgctaaaaaatgctaaagatcatctgagccttcagtgagcaggaattattttgctggtggaacatcttgcctcaatgttggtggctgctgactgactgattagggtagtggttgctgaaggtttgggtggctgtggcaatttaaagtaagacagcaatgaagtttgcgacatcaattgactctttcatgaaagatttctttgtagcacgtgatgctgtttcatagcattttacccacagcagagagtctttcaaaattggagtcaatcctctcaaaccctgccactgctttaagtttatggaatattcggactcctttgtcatttcaacagtgttcacatcatctttaccaggagtagattccatctcaagaagatactttatttgcttattcataagaagcaactcctcatctgctcaaattttaccagagatcaacagcaatgcagtcacaccttaggcttcacttctcattctagttctcatcctatttctaccacatctgcagtgacttcctccactgaagcactgaacccctcaaagtcatccatgacggttaggtcagcttcttccaaactcctattcacgttggtgctctgacctcctcccatgaatcacgaatgttcttaatggcatctagaagagcaaacccttttcagaaggttttcaactgactttgccccgttccatcagaggaatcagtatctagggcagctacagtcttacacaatgtacttcttaaatagtaagacctgaaagtcaaaattactccttgatccatgggctgcaaagtggctgctatgttagcaggtgtgaaaacatccatcttcctgtactatactcttgtactatatattactatgtaatacactatactatactccatcagagttcttgggtgaccaggtgcactgtcagtcggcagtagtattttgaaagacatctcttgagttgtaggtcttaacaatgggcttaatattcagcaaaccatactgtaaacaaatacgctgtcatccaggctttgttgtttcatttatagagcacaggcagagtagatttaacgtaattcttaagggccctagaattttcagaatggtaagtgaacgtcagcttcaacttaaaattaccagaagtattagcttctaataagacagcttgtcatctgaagccaggcactgacttctcctgtttacctgtgcaagtcctaaacagcatcttctttcaatatgaggctgtttcacctacactgaatgtctgttgttttgtgtagccacctttatcaaatgatcccagctagatcttctggatgactcgctgtagcttctacatcagcacttgctgcttcgccctgtactttcatgttatgaagagttaccttaaacctcatgaaccaacctctgctagcttccagcttttttttttctgcagctccctcacctctctcagccttcatacaattaaagagagttagggtctcactctggattaggctttggccgaagtgaaagttgcagctggcttaatcttctggtcagaccactcagactttctctctgccgggagtctgttttgctttcttatttgagtgttcactagaggagcacttttaattttcttcaagaacttttcctttccatttacaacttggctaactgcttggcacaagagacctggcttctgaattatcctggctttcaatgtgccctcctcattaaactcaatcatttctatcttttgatttaaagtgagagacatgcaacttttctttcacttgaatattcagaggtcattatagggctattaattggttactttcaatattattgtgtctcagggaataaggaagaccaagaaaagggagagagatggaagagggaccagtcagtggagcacttgaaatgcaaacgtatcagctgtgttcactgtcttagatgagcatggtccatggtgtcccaaaacaatcacaacagtaacatggaagatcactgatcgcagatcaccgtaaaagatataataataatgaaaaagcttgaaatagtgtgagaattaccaaaatgtaacacacagacatgaagtgagcaactgctgttggaaaaatgatgctggtagagttgcaaaaagcacagtatttgcaaggctccagaaaatgagcgatgcttgtaccttcgtttcttctgatttgctcttctaatctgccatggatttagaaggcacataactgttttatcactgtatataaaataagacaatgtaggcagtgtacaggagaccttatctatctagagagatcaatccatctatctttttttttttgagacagggtctcactgtgtcacccaggctggagtgcagtggtgtaatctacgctcaatgccacctctgcctcccaggttcaagcaattatcctgcctcagcctcctgagtggctgggactccaggagcgtaccaccacgtccggcaaacttttttgtatttttagtagagatggggtttcaccatgttggccaggctggtcttgaactcctgacctcaagtgatccacccaccttggcctcccaaagtgctgggattacaggtgtgagccactgggcccagcctatctgtcggtctgtctgtctgtccatccatccatccatccaaagtataggaatcgcagtgaagatattttgtgaaatcttttatgggttcttgagagacataaagttttggattctcagctgtggttcaaatagtggaggctgcaggctatcttgggaatgttaagtccagtgaaagtgtgaaaaaaaaaacataaaaatataggctgctgaactgggaaaaggtgctaaaaccaaatattgagaccacttaaaaattaaggaatatccaatttcaaaatagcattgatcttgggggaagtacattttccatttcatttagaccacattaacaaaatcattttttaaaagactataactatctattagtaatacaatgtcctttcatgcattagatggccagtcatgcttaccgtattttaatgctatgcgacccgtcataaaaagttaggtttacacctcaaattggaaattctacttataagcacaccagtaaaaaatcactgtaaatacttgtagtaacataactttacaaaaagattctttttatcgccatccataaagtggtcactcacctgcattaagagctgtaaataaattttttctcgaaggacctaagatataaaagaaacatgtaaaatacatatgttttatttgacatatcacataaaaacaaaccatgttgataagaattattttcaaaaacaatcaatcgctacatttcaggttcccggtgggaaatatcaccgagattcaaccaacttttgtcaagtgcattttaaatataaggtgatatttcacataacatcaaaatgtttaagtatgatatgaagtcaccacaaattaaataggaccagttttaaaaggaaaagccgcagtattttttcagtcaagaacagctgaagttcaagttttaacagtactgaattcacagactgtgcacatatgccattctgctgccgggagagcagaggccagacttcacgaaggacagtcactcccgtgtgctttccgaaactacccgtttctattcagctatgaagaaaaatagaagtttttcctccaaactgataaaatataaaatcaggaggggtaataggtacacagctgtaagtcactaaaagaaatctatgatgcttctacttaacatgaaatagttgtttctaggacataatcatctgcagataccagttagaacagctaccatgttctatctgaaattttacagagatgatgatctcttaaaatacgtggctgttatcaatggaaagcactgattcccacacaggtaaaactgttgcgacataacctatccattcaatagtgaggcattttagaattctgagtctcctgttctacaaagctgtccatggaatctcattctctgcaagttattttagtatcaaagttcaacagcgttaacttcattattgctgtgtggatcatggggctttatcatcatcaataaaaaaccacagttttccaacctgatgtcaactcagcaagaggtcatttggtgcctccgaaatttgattaactccctaggcaaatgacaacctgctgcacactgaagaattcaacccactcctaaaattcatgcctattttctcttcaattcagtacaaagaaaaggtattgacatacattaaccagcctcaaggtaccatattatcctttaaacacacacacagagagagagagagacatgttaaggaggatgctgtgacagagtaacacctctgagaaagttactaatagatattaacaatccaaagagtttcatgcaggttaacccagtaattcctccttctgggatatccacaagtaaccagaatctgaaacaatgaatcttgactcacatttgaagaggttcatctcagtattaataaaccccaataaaagtcagaagttgcccactataaactgaagtggacaaccatagaatagccatttaaagtgaagaagctctcctgatacactactaacttaataaaaagcaagatacagaagagtatattcattattacctcagttttgctggaataaaaacaaaacaacatatacatacagaggaaaaaagtcacaaggaaatgtgacagcaattgctggttgacagaattaaggaagactctttgtttctgtgttttccaaattctctaacataaatgtgggtctcattttataggtcaagtttctcactcacaattattcgctcaggctttagttaagcttcagttcactaagcacaaataatgctttttttttttttttttttttttttttttgagacagagtctcactctgtcacccaggcgggagtgcagtggcgcgatctcggctcactgcaacctctgcctcctgggttcaagcaattctcatgcctcagcctcatgagtagctgggactacaggtacacacgaccatgcccagctaatttttgtatttttagtagagatggggttttgccatgtcggccaggctggtctcaaactcctgacctcaagcaatccacctgtcttggcctcccaaagtgctgggattacaggcgtgagccaccgcatgtggcacaaagaaggcttctgatgtgctttggccccactgagacaaagctgcatgaaaacattgcacattaagtgtataccacatattttgtaaacctgaaaattacttttcataatcacagcaaataaaaagtgagggatatgagaaggaacagagataaagaacatttagaggaagaacaatgtcttagaccaaagacatgaagacacaagtacagtaataaacataaaacatctaccctgatgaaaagtaatcatgcatttctactcctttctcactattctagagcactgttttagaataatttaactcctgaagttttgctgtttctaccttatacctttgttctgcctgctgacttacacgtaatgatttttaactatagaacctaccaactgtcagaaaaacaatttcctcagtgcaaaaatgtattatatctcctttctcaacatatttgtaatcattgttgactataccataaacctaattgtcaaaatttaactttctacaagccaaggactttaagcgtcttgccctccctcttcaaaccacaatgaggactgtaccttttggaggagttttcatcaagtgaacatgagccctggataccaaaggcttcaaataaaaggatcctgaggaaccattctgaaatgctggttttggaggtttctcctcatatttgatgacagcggcattaccagctgtaataaaacagaaaagtacattttattgtatagataaacacagtttcgaccttccacatttattcctttgtccttgaaccaacaaatgctcaataagcacctacgacatgccagtcattactgaacattgggaatacaacatggataacaggtagcttgtgtctcagggatgcgaaataaaggctataatcagagtgaccacacatcctggttagcctggcacagtccaagcttatgcatcttgtccagttcagctttcatcccagataagagttggggaagaaataatacagccacttcatgctatgtaacaagaatgccccaggtgcagctaggaagagcacccatctccatggggacaaggaagaattcgcacagtcagctagttaatgacacaagaacagtaacatacagactccttggtagctataaggacacgctctggttcaaatccttgctcctacagcaaggagttaaaatgctaacttctgccctgaacaaaggaagtttgttccaaagtaaactttatgttttagctccaaagcaaaaacataaaagggaatcttacctcaataacaaaaaccatctttttatattatgtgtaaaaatttcccctccaccaatccagactggattttctactgtttgtttgtttgtttgtttgttttgagacggagtctcactctgtcgtccaggctggagtgcagtggcatgatctcggctcgctgcaagctccgcctcccgggttcacgccattctcctgcctcagcctcttgagtagctgggactacaggcgcccgcggccacacccggctcattttttctatttttagtggagacggggtttcactgtgttaggcaggatggtctcgatctcctgacctcgtgatctgcccgcctcagcctcccaaagtgctgggattacaggcgtgagccaccgcacctagcctgtttgtttccaaataatgatcaatatccaattctaggcacccaattctattctactattcaacgcttataaatttctttattaccaactatgatcccttttctcacttcactcacttagcaaagggttaagatacctaccttgtttacaaatgcattataaatgtgaagacagctagaaatttttcactaggctaacctattccaactgctacaatagtgcttatacacatcacattcaaactttgtacaggcgtgctattattttcccctaatccacacccaggccctgtacaatgagccatctgttcattgttctcgtgcccaaataacattcctaatattaggtcaaatcaacacagagctttccctcctgctgagaaaattctgtcaatttcctgtccttttttccaattctcaccttccctagaacctagagacttggcttttccaaagttgacaggaagctaatgggagtgacagtattaaagacaccgccattacaacattcaacagaaccctttttagatgttcatagaaaatggatattgggtttcaattagcattttagcttttgctgaatcaaatccaacaaagaaaattagacagtcttaaccatggaattataacaatctggattttagtcttacttttcttgaagccgtatttgattatattcagcaacaaataagtcacttattcatattttaaaaaattaaactgagttcaatttacagacctaatatgcaattgtatgattctaaattcatgcttttcttttctaaaatttagagacacaaaggcccacggttcacaaagagatcagtaaaaagattttcactaaagtaaaggacaggttcttcatgagggatggtactcctgtgtcccttgcctctctgtcacatgcaaaataggaggtggtgtgctggaaatcagctgtctcactgccacttttcagactcaatacaacactagatcaacccggcaccacacccatcatcagcttcataacacgcaacatgaagtcagaattcatactgcaaggataaaatgtctgcgtttgactcaggtacaaacacacatgcatttatattttatacatatttacatgaaagctatatatacaagatacatattcatatactctatgatcaacgattgtacctgctttctgctttactaatggcaggcacaacctgtactgagctgaacataattttatgactaacaatatctttctctcaatttctacttactgtactctaggctggcccactgctttccagtaaaccccaacttgaaggatgtataccaccatgagtcataatgctcttcaaatatttcccctgccctctatttctgttcctaacatggcaactgactgagtatcctgatgctatctaaattttccctcagccagagtcattatatccaaacaataaagtcctcagcggcaacaattccaatataagagatgcataatagtttccagcaatggaacaggatgtaaaatatcctagttctggtgctgacttgaccactgcctagctgtgctgaatcacctatctatgaataacaagggtctgaatatcgggtatgggaatagacagtgcattcgcccatatcgggtatgggaatagacagtgcatttgccttcacaactcactgtggtattcagtcccactgaggctggatgcatcctcagaatcatcctaaagacagtgttctagagagccatggacactaaacactgctggcttgaagagacaatacataaaatttttcatgtggccacctacttctcaacctgatctaatatgtagtttaaaactgcccctttgtcatctttggtcccaactgtctcaattatgccagaataacagattctctggaatctttatcttcatttccccatggccaaagtgtggttcaagtgaaataaaggagctggtgagtctaaaaggaaaaactaagggatattctcaggaaagcccaagcagaagacatgattttcctattagaaaagggcttctcatgctgggcacagtggctcacaactgtaatcacagaactttgggaagacaaggtgggcagatcacttgaggccaggagtttgagaccagcctggccaatatggcaaaaccctgtctctactgaaaatacaaatattagctggacgtggtggtaggcacctgtaatcccagctactcaggaggctgaggtgggagaactgcttgaacccaggaggcggaggttgcagtgagccgagatcgtgccactgcactccagcctgggcaacagagtgagactctgtctcaaaaaaaaagaaaagggcttctcattgtttcagacttttatctgcaaactaacattcatactacattctaacacctagtgaaaattcgcttttattacattatgtatatacacacagagccaacattctgttcatttcttgaattttatgtgaatcagtttaacactccccactgtgccagatcatctgcccacttggcttaaaatcaaagtactactgaaatctaaacttttgaatttcaaaagcaatatcactcaactatataataacaagaatgtctcacatataccctagaaaaacgtgaacagagaaagaacgagaacaaagttaacagtggtctggataatatttcctttttaaatagtccattcagaagtgcgtaagtactaacatgttttgtgatgtggagcctaatgaatctaccgcctgttcctcatcttagcctcacccatgacagacatcacgacttgaacacaaaactttccctctgaacctggaggcaccctgagaaaccactgacaccatcctacaggcgaattcttatccactaaccagtgttggccactaaccagtgttggcaggtgagacaatattcacttcccattcctgttgtgagagaagaaaaaaaacaaaaaacaaaaaactaagggtaaataagatccaccctattctttatcagcttaatcacttgaacaactcaaaacaccatcctgccaaacaatgaggccctgtcttattgcagtgaaaagggtcagaaatgtttgttgctgcaaggactttgaagatgacccagtcctcccttgtcattgatcagaggagagtatggaggctggaggctaagaaaagacaaagatagtccaacttaacatgagttagtaggaaaactacggtgggaccgggcgtggtggctcatgcctgtaatcccagcactctgggaggcagacgcaggcatatcacttgtggttaggagttcgagaccatcctggccaacatggtgaaaccccatctctactaaaaatacaaaaattagccgggcatgatggggcatgcctataatcccagctacttgggaggttcagacaggagaattgcttgaacccgggaggcagaggttgcagtgagctgagatcatgccactgcactccagcctgggcgacaagagcgaaactccatctaaaaaaaaaaaaaacaaaaaacaaaaaacaaactaaggtgggtccaaggttagtgcccttttctgcatgttacaccccactcagccagggctgtcagtgaaggtgaagggaaagaacactccatttcttttattcagtctccttctgttccttccatttccaggagaatgcaaatagctttggtctgcacctcttacatttcccctaccatctggctctcaaatataaacatggttttgtggccaaagtggaagaggaagtaatgtctttggaccttactttcctgctaacatcgcaaagttatacactctcccaagacccccttctaaattgcacaatagtccccaaatcttcaactctgttcatgacatacaatatatcatttatttttacccagttactttaatgatcttaaaaactggatattaggtatctgagtgtgaaagaccttataatctttaacctctataaatgagcacatttggtatagaaaccattgtgaaatgttttacactaatatccaaaaggatcaagatcgtaactttgaaattttctacacttaaaagaacacacacaaagaacctgctaaaattcccaaataagaacaatttattgccttacgtattttgatttggtcatttaaaaaatttagtaacattatttctataggatcccaaagttccgagaacccagtgctaattttacaacagcactgtgttatatcagaagttcttaaatgatgccactaaagatatcacatcacaaagaaacaagcagacaaagcgagaaaccaatatttgttaaagggattcaaatacttaagccagtataaatcagaacactgatcaaaagaggaagttaattcttaacatgaccacccattatcagaaacaggaaattttcagcgcgagatgattttttcatgttttgaggtagcctttaaaagtatacatgtttaatactttcagttacaacttaggaaaataaagatgtgatgtttccattttaattttagaaaagtatttttctacacttgcacaactaccagctacatacacacaaaaactagttatttcataagaaattaaaccatcaaaaagtctttgataataggataatttcatgtgccagaacattaacgatgctgctgaattatattaagagtgcaaaacacataaaagagacaacaaaattggtcctacacagaagcattcacatcttaaatatacatacaaaatgcccccaaatactaccattaccataaattacaagttacaaaaacagaagtcaagagatcctaaatcaatttattgaataaaaatttaagcatgcttacaaagaaaagaaaccagaaatcgtcgacctactttttttcccagtaaacgtggctaacaaaggaattatacaaaggctgtacgatcccacgaccagcagtgtcaataaggtagcatcatagtgcctctctgaaccagccggtggggtgagtgtagaattgataaagatttttgaagaaatatcagtttctgtacaactgcgaaatcctcctggtacagtcatttaaaaggatcaaagcaagcttaagcaggaaaaactgcagccatgttcactctcatatccctcatgcttgctcttagtgaattcgaatggagggaaaaaaaaaaaaatgcgtaagctccaaggcactacacaaaacagattaaaccagctagcaaatcaaactaagaaagagactcactgatttgaatgcttaatccgcaacaggaacacatcgccactagacaggctctgtgggtgtatggtaaacccctttgttaaaagacaaaaaggaatggacaaaagcactttacagcctccttaggagcatcagacacagtact

SEQ ID NO: 1625 - DNA, 78782 bp, Homo sapiens
tgcaattcttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaacaacacaagatttaccatgcctaggggatgaatggcaaacccaactttggctaatgtcattgagaacaacttggaagcgtgagcagagatatctcatgaagtggcagtgaacctacatttccatttatcagaagcaaacatggaaggttacatacatgatgaagtattggaagttaaagacttaagacacaaaatcactaatttaaaagaacatgcaacatgagtatcaacttgctatgtagtgtacatgtaaatgacccaaatattcacctctagcatcctgaatctcttcttactacagctgttatttgtacagccactgaatgtagattagtaaatactgacatcacaatgttgacacatgcagggagggggagataaagcaacagttcttccttccaccttttccaaagtctcaggattaggggaggtaataagttttggaaagaaactgaaatgcaacctggaggagagttggacaagccacattttccactcatgggaaagaagcggaccattctgctactttcccaaagacaaagggactccttaaagggtaactgaaaaatgagcgctatcctcccagactgttttcttctatcaagtactgcatcatcggtaagcactgaatcctacctttcttaattatactagccaatgacttccttgttctcgttctttattctaagatttcccaaaatttgtaatatcaaatccaggctttagtttatttggaaagtggtttcagcacctggaagatgagctggctctggggctctggaaaatcatattcctttatccttgtcccagagaaaagtaggtaggaggtagaaggtttgcttttgtggctctggatggtggagaaaggtaaaaggaaaatgagaataatgggagggaagaagacaggttaaatctgcaagggtagatcaaaggtaaaaataaggtggaaaaacccattggtacttccctttttctttctttacacagttagttagttagtttgtttttttatagaaaaattagggttctacatttacacatagcctgagaaaatgaattacaggatagtgttaggctcacatgggtaagtaaaaaatctacagaaaaatctagtttcaactgacatggctgaacactgaaaaactgccaagaagttacccccaaaagatacagagaatgtatagacagggacaagtcaaagctcttcctgttataccctctccctaccctgttacagggctgagcagagttggtggtagatgatcataattcaagcaactattgctttttcttctatggctttggctgaaatgtatatgctgattgattgattattatttgattagtacatatccagatatattcagattttgacatttaatacacagcagaggaggctgcatcagacacatgacactctgtgacatccatttcattcacaccccccacccccacagtcagactgaaaactcacaagaaggtgtctgtggtgaagaacattacaaaggttataaatcttaatagggccctgagagtttttccccctatgcttaggtgaaaaaggcaatgaacaagatgctctcgttctttaagtgctttgtgcaacaacgtccgtgtcgatgccgaaatctttttttaaatctttttttggaggaatcttttggacggaggcaaaagtcttcctccagagttccagtctcagaagctgcgattccgccggtggtgacgctccagttaccctacggtgatcacacgtgtgctgatatacctcttgtgcccacgttcctccttggggtcagtcctgcagacctgcatcaaaatgctttcagagagtctgtggactttggggaggtgtcatctgggtgaaatgctggggctagggaaggagcccgaattccttggtgactgcaaagggatggcggaggatgtgggggatctcttggggctacacaggtccccattgtgcagtttccacagaagctcctcgttttccatagagagtcgcttgttgactttcgactccttctccagcgactcttgcagaacagcctgctccgtggaaagctgccttgaagaaaaaggccagaaaccatgagatctatgtaaaaaaaaaaaaaacttgaaaaatttttcttagcgtttgaaactttaaagtccaaaattattcctttgggataaaacagaatcctgcacaaggtcacaggtatttggctggctaagaaaacccaaacacaggccgggcgtggtggctcaagctcataatcctggcaccttgggaggccaaggtgggtggataacttgaggccaggagttcaagatcaacttgggcaacatggcgaaactctgtctctattaaaaatacaaaaattagtcacgcatggtgacatgtgcctgtagtcccagctactcaggaggctgaggtgggaggactgctcgagcctaggaggtggaggctgcagtaagctaagatcacaccactgtactccagcctgggcagaagagtgagacctcatctcaaaaaaatatataataataactgtactttttgggcaatttcatagtaggctgagagccacttttgcaaatattcgacatgttttatgactaccttatgttgcaggctgttttctatttggttttgtgttgctctttgtctgaaagcattctcagaggcagccagaggccgtgggagcaggcttgctggcctgggtctcagtgtacagttttcaggccgctttggtaaaagcatgaactactacaatcatattttccacagagaaatcaatgcccttttaaccatctgcttccatcatatttccaggaggtgcaggggtagagcgtgtccagaaagtacactggatgtccaagggagcggggagctcgggagaaacagcactgttttatttttaccttgagattgccatgtgcttgtccatccgagctttcaattcttcattctcctgctggaaacgcttcaatttgtcaaccaatgctgtgttgttgtccaccttggcataaacaagaattccaacatttatacaatattaaaaaaaaaacccctcatttcttaaggcacctcacgacacaagcacactttggagatttaattaaggaaaatgcaattccatattaaaatatttatacactaacaaacatactgaaaaagattttaaaacagcaaaacagagcggctgggtatttttaaaacatgtatgccaggacacttaaatattgatacgagtgggtaacagatttgttccaggtcatgttgttttggaattctctaagaattggtgcctctttctgtttcaatgtgaaataaaccctgcagacacactgcccacacttatcaaagcttatctatctccttacggtgaattttgctggaaaaaaaaaaaaaaagattcccacatctgatgaaaactcacaggccagcaattcacagtccctggcaacgtttactatggacttgaactcagtttcatggtaagttttcagcatttgcgtctgagtggccatacaaagcttcaattcgatagagctcttagagcatgccatcaaagaagtaacatgccacgagtctcctcaggtcagctgaagatagataggtctgttctcttgctgccctgtgcaggctgaactttcaaggcaaacaaactgatcagcggagagatgaaaggataagatgcctgaggacatttaatcacttaacatgatgaagacctgattccatcccccactcactttctaaaggtaaggctttatgaagaggcaatattatagctccgtcaggattaagtctaagtccttgtccttgtagcaggactaacgcgctttgagtatgttgcttagtttggaacctgattgttcttaagacatcctgttatccagaagcagctcaggacaacctgttcaggttaaatcactttccagaaaaggagtctacgttcagtaattatgaaggattcccagataaaacaacgtggaaaaaaacctggaatttgagattgggaggtattgtcctttaaatatctcatcctagggaaactagtcctaataatgtcacagagctgattatgggcagtgccggtttcatgggaaagctgtctttcttagaaaacttcctgtgcttctaagtctcttaatttcatcagaggcctgtaatttacaaatatgaagggaacagtgggtctccctctcattgtatcaactcattcttgcacacatacacaatgcaaggctgaaggatattatcaggatacctctggggcatggcaagaaacaaatagtagatcatcagaaattaaatgtgttggtaagtttacagcaaagtctgatttattgcacatgattttttgaaagttttgatgcatgaatggcatatggagcagtcctattaacaggatcatctgagtcatccctgactaccagattagaagataccagactcagtcgaacaggacgacctttggcaggaactggtatgtatactaggttggcccattaacaaccatgagttcctttccttcctttacaaaaatttcctgataattcaaaatgctggtatatccacacaggggcttggccgttatctccctcaacagaagtcatagtctccagaagaaaaccaaacgccaaaccaacacaaaccaagcagcagagaggtcccccatgtcccctactgtccagggctggtttgggtttgaatgaggcacttgtagaagcctgagtcactcatcactgtggggagaagaggccagtagcatgcggcagctggacagtcaacagcaaggcaccgcgagggcggggatcacttaagctgccttgccaaactctgccaacttggttagagtcctggctggcagcagctgtatttcagggccgggccaagactgacgctgaacactgaacatgccactcacactaacatcgttctctgttctagacactgcaaagtgaatgttaattcatatttttggtaacacctgctacttgtccaaatggattaatcttattatagcacaattttttttttgagatggagtcttgctatgtcgcccaggctggaatgcactggtgccatctcacctcaatggaacctccaccttcccagtacttgggattacaggcacccaccaccacacccggctaagttttatatttttagtagagacagggtttcaccatgttggccaggctggtctcgaactcctgacctcaagtgacccacccatctcaacctccctaaactgctggcattagaggaatgagccactgcgcccagcccacgattcttttatcacatgctaattcacaagaagcaagatgaagaattttgataaatagtattgctattcatttctattaaattcatttctattcatttctattaaacgtatccaactgttttggatctaagaaacctgtccagggtggctggtatattaaagtactgattttacatagatatttaaacatttttcttatgcaggtgaagatccaaaataccactgaaatataagcctgatttgtttgtagtttttccaaggactgggtgctgttttacatgttccttgaaaaagaaaacattctaggaggcagcaatgaataaatatggaacaaacttggaaagaaaatgtgaactttatcttttgtataatttctaaatatctttaggagcagttaacccaactccacagttctaaaatgcagggctcaatttcacacatattaccccatttgtaagatcctctttcattctgaaggaaacataccagtttctccattttcattaacttgatgtcctgttgatgcagtttctcattcttgatctctaacacagctttcaggctttctaactcctgttctagatacatgatctgaggatttttctggaaaggacacagcaagatactgctcttattccacatagttcaaattcttaacagaaagaatctttgattagattgagacattagacaagtagcaagcgacagatgttcatcatcttagagcaatttcaaagaaagaggtgaaaaacaagagcaccttaatgtcgaagactggtcctaatactgaaagcaaacatttcacttatttatcagtaacttaatatgcaaaaatgtgagttgcatcaaacatgttattgtatcaagagaaaaactttgcttacatacaaaacagaatcttggctggagatgaggcaatctgtgagtcagttattggcattttctgggagaacagggaacaacagttctctcctaccaaacaaactgatcaggaaagaaaaagcagtgcattatacggctctctggaaaacaacagggataacaatgtcctgagtgtttggatttttgttatgatggggctacgttgactgggccatacttctagggcagacataatactatcattttctattgtgacaccccagtacctacacggcatggagtacacagcctatttaaatttctctccaaaaattacaagtttgccaggcatagtggcatatgcctacagtcccagctactcaggaggctgaggcgggaggatcaactgagccaggaggtcaaggctgcagtgaactgtgaatgcaccactgcattctaacctggtggcagaacaagatcctgtctcaaaaacacaaaactctccaaaataaatgctacatcaggggaggcgtcctctgagagcacaccatcagtgtggatttcccaccaccgcccacccactccttgctttattcggaaattcaactaaaccattcaaaatttatgctacagaagaacagcatatggtccactgatcagatatgtttaatgaagcaacgtcttaggtaagagtcggtggtgtggtcatcaagcttatcttccggggcattggtttctgctctggaccaatccttagggagaatccaggaaggggcctcggggattacttaatccaaaccccttacttcacacagaaagaggaaacgtgttccacgggttaagcgccctactcaggaaagatcaggaaagcttccagagctggaaagggtcagggcagggactaatacatctttaattctaggttctttagatagttccctgaggctaggagaggtatgcgtgtgtatggtgggaggtggggtggggtgggatgaggagaggttggttaatgcatacaaacatacagttagacagaaggaataggttctagtgttcaagaacatagtagggtgactatagttaataataatatattgcgtacttcaaaatagctacaagagaagatataaaatgttccaaacacaaagaaatgataatgatgacggataccctaaataccctgacttgggcattacacagtctatgattgtctcaacacatcacacgtaccccataagtacatgcaaatactaagtatcaatttttaaatttcatacattttatacagtgttacccttgtacgcaggatttttttttttttttttaccttgaaaatagcgaatcctacctcatttttgttagagggaaatggcataacttaccgtcagttttaaaattagagcatttacaagacttgtaccctctgcattttctcctcctcctctgccagcccatccctttctcccggactacagtcagacgcactctttttccgcagcctcagcatgcttacgtgacagaagcggttggatgcttctgtgttcctcactctgactctgccttagcttttcaaaagcggctgcagtagaagaatcccctttgtgtaccggaagctctttcaaacctgtttcctgagccatcaataaagtttataccctgcatatccctgcatgtaagtctagatttcttttgaaatcactgactcttcctaagaatcttctagaataaatagctttgaagtttctttgaatataagctcatctaatgttatcaaatagctagagggtctcccaatgacattatttgcagaaggtctcactgagagatccacacatgtactttctagagctggccagagatttgaagtggagaaaagctttgcttctgcagtctcagagtataaacatgaaatgaaaacagtggtactaaaggcagaagcagcaaggaaacaaatttttttcaaaaagacaaaggttggggtaaggctggggaaaaaggacaaatgtgccacaagaaatttcagcttccaagagatttgtacttttcagaattgacatttatccatacggcgaaatattattcatccataaaaagaaatgaaatactaacataggctacaccacggatgaaccttggaaactttatactaagtaaacgacgccagtcttaaaaggaccacatgttctacaatcaaccttttctattcattcctcagaataagtaaatccatagagatagaaagtagacgggggagagcctggtgctggggaatttgggggaatggggagtgactgctaatgggtccagggttccttttgggggtgataaaaatgttctagaaagaggtactggtgaccaatggacaactttatgaatatactaaaagccactgaattttacatgttaaaagagtgaacttttcctgggcaacatggtaaaatcccatctctactaaaaatacaaaaattagctggccatggtgatgcgtgcctgtaatcccagctactcgggagggtgaggcaggagactcgcttgaacccaggaggtggacgttgcagtgagccgagatcacgccactacactccagcctgagtgacagagtgagactccctctcaaaaaaaaaaaaagaaagagtgaactttgtagtttgttttatctcaatacagtgattttttttttaaataaagtcttcacataaaactctaatcctaattggtagtttccttctttttagcttagaccaccagaaacatcctggacttcatccgtatgtcagattttaggatggtaaaacaagacgccagtaagcaaagcagttgttttacacaccttagaaagcacattgccagacatgagaaggattcccaacctgtgttatttctctggctgctgagtacttgaatgactctaaaaggcaactgagaagaaaaattccatactgataaaggagcacacacaacttaccaaatttgctttttctcttgctcttcttttttgttcttctgatttcaatttttcatttaaagcatcattttcactcttcagatcattgatttgcttctaaaacacaatgaaatgtggaacttaagttaacaagaaaaccccagaaactcagcatacgtacacagaaacattaaaaccaaacaaaatcaaaaatgatatttttttttgtgggggatactgggatattgacattcacccacctctagcgattcctgcttctcagaaagtaaatcttcaagcgatttcttttctatttcatggcctttcttaatttctgggaaaataaacggatatttttgaggcaataacattctatgagatcaatgtactctaaaacagttaaagcatatagatgtaggggttgatgatgaagccgtatgacgttactttacatctatagtatgcttttatgtaaattggccatctgttctcaaaatggccttgagaggtggttagggtagacattcccattttatgactgagagccctgaggcccactgaagcccaccatggcccacagaggccatgcgaccttaggacaacactgagtgccatttcagggcaggctctcataaatgccactccagactcctggtctggaaaccctgtgctcttttcaatttgctcttcataacctaaacataagtctaaaattatactcatttctagcaggaaggaagaaaaacaatgttcactacaagtctgcctggagccagtcacttttacacattatcacctctgcctgactttgggcaactctatttttgtggtgagaaagtccttgctgaaggtcacacagccggttcttagcactcatccacgctgctctgtaagatgcaactggtttagtagaaagactgtgagcgacactgccgattctgttctgaaagcaatggcttacaccctcccactgatgacagatgaaaaatagaaaagactatttttctattcaataagtggcatcgacatttcacagcaacactgctgtgcaggagcacttggggtggatcctttactgtggattacaagatagaaacttgtacttgccacttcccagggacctaagctggcaaccaccaccgccaaaatggcctttacagtcttccaaagcccatcctatttaacacaaggctggcatttgtaactattatttgcatccttagtgggaaaaggcatctgttaacaataaaccacgcaaaaaggaaccaagaacaccccagcctgaaggccacagggcattcgctgaagcaggaagttatgaatcatttccatcttaaaacatcatgtggttccttcagattttattctgtttaaagaggaaaaaaagcatccttgcctgaaagggaggcttcataggccttctttagcaattcaagtttctctgagtggctagcttcaatttccaacttagaggtttcatgcgcagcatttaagttgtcaaactgtaagcaacaaacaaaaccgtggtttaacagtaaaaccaaatgtcctaagttgaatacgcaaagcaaccacattaggagacgtcacagcttcacaggtaagcgtgggctctagtttaaaggctcctcaacacatacaaaggtcagggcagtggttcacacttgtaacctcagcactctgggaggcagaggtggaggatcacttggagcccagcagttcaagtccagcctgggcaatgtcgcgagactctgtccccacatgtgcacacacaaagaatgcatgaagagcaacgcaactgggattcaccgctcaactctcctctgtctccttccctaccctcaggaacacagacacagaggctctccagggtgacagatggaaatggctgcatcagtcacaaggaatgaccaggaacgaggatatgtttcacagtgacagggccacatgctctgcgcctgtcacttgaccactcaggccctagcatgtgcctggcctggagtaggcactctgtagatatttactaaatgaaaaactgagttaaaaagggagctacaaaattaaaaaggtttgatattttattcagtgaaaaaaaaaatgggatatttaaacagatgccactaaaaaaaaaaaaaagaaagaaatgcaaaacaatagtttggcaacacaccaccaggatgtttacaagggattatttctgggtagaaagaaagggttgttttttcaattttatcttttcctcctccttttcttcccttctttcacttaacataatacattcctttggtcataagaaaactattcaattaaaaagatactgtttccaaggcaggcggatcacctgaggttgggagtttgagaccagcctggccaacatggtgaaaccccgtctctactaaaaatacaaaaattagctgggcatggtgatgggtgcctatagtcccagctactcaggaggttgaggaaggagaatcacttgaacccgggaggcagaggctgcagtgagccaagatcaagccactgtactccagcctccagcctgggagacagagtgggactctgtcttaaataaacaacaacaacatgctttttatacctattagactaaaaaagagaagctcatcaagatgtgaagagcaaccaggattcaagtaagcagcagaggcctcagacaagctctggctgcaaaagcacagacctgctcttgcaattgcattttgtacttctctgcttcttcaatgtaagtgtcccgaagcttttcatactccctggtgtaaaactctttaagccgattctctcgttctgttttttcagcctggtgctgctggacgaatgcttcatacactgtttgtaactcattcctggctttttctaatttctcacaggtggttgaagcagtgactgaaaacagaggagaaagaagagggaagaggtcattttatttgtgaaatgtcctatattcattacagtcacacacagctgtgatgacacctgaagcatacacccatgatgtcttgggtctctagtgaccatgtcttcaaatataacagtatggaagtgaactgtaaaaaggaacacgagggcagggcgcagtggctcacacctgtaatcccagcactttgggaggctgaggtgggggaatcacctgaggtcaggagttcaagaccggcctggtcaacatggtaaaaccctgtctatcttaaaaatacaaaaattagccgggcatggtagcaggtgcctgtaatcccagctactcgggagggtgaggcaggagaattgcttgaacccgggaggcggaggttgtagtgagccaagatcacgccactgcactatagccggggtgacagactgagactccatctcaaaaacaaacaaacaaaacccccccccaccccacattcaaaaaactgactcccaagcagtaagagaagtacttcagaagacccaggtttctaagagaagatcccctctcatgtggtgaccagtcaatgcagtggtcaagaaaagagccttggccaggcagagacatttcttaggacaagcgactcctccctctcccagccagccagtgtggtagaagctcacacaagagcaggaaagacgagggataagaaacaagtggaccggccgggcgcggtggctcacgcctgtaatcccagcactttgggaggccgaggcaggtggatcatgaggtcaggagatcgagaccacggtgaaaccctgtctctactaaaaatacaaaaaattagccgggtgtggtggtgggcgcctgtagtcccagctactcgggaagttgaggcaggagaatggcgtgaacccaggaggcggagcttccagtgagccgagattgcgccactgcactccagcctgggcgacagagtgagattctgtctcaaaaaaaaaaaaaaaaaaaaaaagaaacaagtggaccttaaacttgtagttaatttgagttgattataatttgttatttcaaaactaataaaaataaaatattagcctctattaaacgcaaatcaccagagcacaaatatcttagggaaaaaaaaacacatcttaaaagcacccacataggccaggcacggtggtttgtgctataattcaagtattttaagaagctgagaccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagagagactccgtctcaaaaaaaaaaagaagctgatgcaggagaatcatttgcacctaggagttcatgaccagcctggacaacatagggaaacccatctcttaaaattaaaaaaaaaaaaaaaaaattatccaggcatgatggtgtgggcctgtagtccctgctactgaggaggctgaggtgggaggatcacttgagctcaggagattgaggctgcaactgttgggcaacagagcaagaccctatctcaaaaaaaaaaaaaaaaaaagcaatataaaatgaaaggttaaaaaaatttatatatgtatacataggtacatatgtgcacgtatatatgcatacatatgtatgcatgcatatatgtatatatctatgtgtacatgtgtatatatgtacatatatgtatgcatatatacatgcatatacatatacatatataatacatatatacacatatatacactatatatatagacacacacacacacacacacacacacacacacacacagagtcttgctgtattgcccaggctgaagtgcaatgacacaatcttggctcactgcaacctccaactcccaggttcaagcgattctcctgcctcagcctcctcagtagctgggattacggcacatgccaccacgaccagctaatttttgtattttagtagacacatggttttaccatgttggtcaggctgttctctaactcctgacctcgtgatgcgcctgcctcggcctcccagttaatatattttaaaagggcaaagtaatctgatacacataattgaaaatcagaacatcttagctcttccctacaactaccaaaaatagaatgactaacaatataatacatggcagaacacaaccaaagatatatgtacacacactacaataaatcctagaaaatcttgaattccttaggaagcctgactttggacattcccagtcttctgtcaccgatgtgtaaatacaggcagacagggtactactgtaactgtcagggatacacatgctgtccacatccccagagtactcgtggattaatacgacagggttgctggcaaatctgttaaattaacccttacctctctttggaaaggaataacatatcaggagttgaaggaagaagattattttagggcacagaaaaggacaatttagatcaataattatttggcctaaggaacgtgaaaatggcaggttcttaggaagatttcctacaatggtgtcaacttgttatctcaggaacctgccatgtggtggtagaaatacccaagtcacttgcccccagtcagtattctttcagaggaaaaggaggccacattgaaataatggcaggaatagtgtctgccaaagagaacccttaaaaattaaatcaatctacaaatgtttattgaagggcaaagatttaacattaaaaaaaaatccccaaaacaaaaactatttctcgttgcctggcacagaatggggctctttatcttgtttaaccctcacagaggaccctcctaaacatatagataaggaaaccgccacagagaggctaaatcatctgcccaggggcacagagctggcaagcgtgagaggatgggtttcggtgagcagtctgaattctgattctgcctgcacccaaagcccgtgccccttcttttctaccaagctgtttcttgtgctggggctggcaaggcgcatgatggggcctctactggaagagacaacagacagaggagaagtggcaggaccaggccagaccttggggcccagggagtggcactcaggatagtttacgtccagtcagggtggaccaaaggtttggtcagatttttaaaacaattaaaaaataaataaataaaaactgtgatgagggctgggcacagtggctcacgcctgtaatcccagcactttggaaggccgaagcgtgcagatcatgaggtcaaaatatccagaccatcctggccaacatggtgaaaccccatctctactaaaaatacaaaattagctgggcgtggtggtgtgtgcctgtagtcccagctactcagcaggctgagtgaggcaggagaatcgcttgaacccgggaggcagaggttacagtgagccaagatcgcactaccgcactccagcctggcgacagggaaagacttcatctcaaaaacaaaaacaaaaaaactgtgatgaagcagataccaaattaaccattttaattatttttaggtgtatgattcagtggcattgaatacacttacatcgttgtgtaagctttgtcatcatccattctccagaacgtttccccccaacctgaaacttcgtaccaattaaacagtaacaacccatcccctccccttccccaaggccctggcagcgaccattttactttctttctctatgaatctgaccattcagtacctcatatacctggactcaaatagtacttgtcctgttgtgactgtttatttcatttagcgtatgtcctcaaggctcatccaagctgtgggatgtgtcacaatttccttccttttgaaggctcaatattattccattgttggccgggtgcagtggctcacgcctgtaatcccagcattttgggaggccaaggcaagcagatcgcttgagttcaggagttcgagaccagcctggccaacatggtgaaaccccatctctagtaaaaatacaaaaattagcggggcatgatggcgcacgtctgtagtcccagctactcgggaggctgaggcaggagaatcgcttgaacccaagcagtgcaggttgcagtgagccaagataacgccactgcactccagcctgggtgacagagcaagactccgtgtcaaataataataatgataatattccattgcacgtacagatgacatttgtgtatccacttaccatccacggacacttgggttgcctccacctttggctactgtgaataatgctgctatgaacaccgggggacaaatacatgcccgagtccctgctttcaattctttggtgtatatacccagaaggaattgctgactcatatggcaattctattattaattatttgaaggactatggtactcttttccatagtggttgaaccattctacattcccatcagcagtactacacacaagggttccaatttctccacatgctcaccagaacctatttgattttttcaaatatatgtaacagccatcctaatgagtacatcactgtggttatgatttggtcagtagattttcaaattaagccatatgatagaaataaaattgaggcatcaaggatgaaaatcctatcccagcatgagcaatgatgggcgacagaacggtgagccttggtgattaagaaactcacaaagcagagaagatagaacccaaaaagacagacggaggccagattacaggggccatcgcacgcaactcaagcctttgggactgaatattaaaagtttcttttctcctttaaaagaatttagtgaaagatagtgatggtcttgactgctggagaacattctctgcacattcacttttccttctattacactagtaaccacagaagaaaaaatgactcaagaagtccaatgttagtcaaacgagtaaacactgcattagcttctgccaagtaactttccgactctgaaggctcctcgtgtgaatctcgtattagaactttctatgaaaacctacaacagaaacatactttgcaagccgttggtgaaggtatcaaatagcttctagtcagagaaattctagtttcacgcaggcttttcacttgcttctcttaaaatttccggtatttccaaagttaaaaaataaaaaagcaggaacaagatctgaacccatctggaagctcatatctgggacagaaacatctaagtgaactcagggactcagcaataaacaagagactgcctccaagccctgggctagaagagcttcgaagctgacgttaatagcagactaccctggctgattttaacacatctgtttatgataaaaatactgtcgctttgaatatgtaattgtggcacatcagcctttaaaaccaaataggatacacagaagtcctttcctattagccatgggacagggctgtttccctctattcaccaaaaaaaaaaaaggcagctctgacgttttgataagtgaggtgaagagaggacacatgggaagaaacgggaaagagaaagggagaaaatgggtcagatgggggaacaggaggttcactgctgttattgtaatagtccaaagcagcaggcccagccccagacagtgacatcagcctgcagctgtgcacagacctttgctctgtttactggcccggtgtgctgctggggaacagctgggctgcagtaatcgctcacactaatggctttcgtttgaaggaagtggcctgggctgcgaaggaaacatttatttggcataaagactcatgaagtattttttaaaggatgcacatgtaaacgctgtattaaaggttctcagagtgctcctcggcagctgtgacataaacgtgtgtgtgtggcggtggggggcgtgcataaccccgattttaggccatggactttcctgtgcactgactacagcttaggagagatttatggtgccacctgtgtgtgctctcactcctatcctcagcctagtctcttcttgctcattctccagaattccactcactttcaattaatcagacaccccacaaagccaaaaccaaacataaaattgtttcgaatttgcaacaagcaagcatggacatgcgaatgtttgaaagaaggtattagacaaacacaaagtcaaagtagtctttttgtccctattttttttttttttttttttttttgagatagagtctcgcactgtcacctgggctagaatgcagtggcacgatctcggctcactgcaacctccacctcccgggttcatgcgattctcttgccacagcctcccgagtagctgggactacaggtgcacaccaccacacttggctaattttttgttttttagtagagatggggtttcactatgtgggtaagactggtctcgaacttctggcctcatgatccgcccacctcagcatcccaaagtgctggaattacaggtgtgagccactgtgcctggcctctgttgttttaatcattccattagtctattttttaaaaaagcacatatatgattaggaacaccaacagaccaccatctgtaggagaactgctgggcaacttttgtatacatgtttgtaaaccatgaaagctatctccagcaatctagcttaaaagaggaaatacagttctcaggatttaaggaaaaagagaaaaaaaaaaaaagaaaaaggaagaaaggaggaagggagggaaggggaggaaggagaagaaggaaaggaaggcaaactcatgtacaaaaacatctctaaaatgtaaggccacattgagattagaagtcagtattttcactctgcaatgaatcacccaagaagaattctaggccagtgaccctccctgacagtttaaatcatggatatctcagcaagaaaaaaaaatcgtaatcagtgaaatgctttaagttttgcttttcaagtaattatcaagatgatatgtggaaaatgcccagtgccacagtcaaacataatctctggaaaacagagctggagtcctcccaggtccttcattacttagccctgcagaactggagtggagccattacttaattagtcctcatggctttttctcagaggggaaggtcagacttttattatttccatctcacagagactcatttccctttgttgattgataaatgtactgtttacagagaaaagcattacacagccatggcccgacattgttaatattcttttgaaatgatacagtgctttcctagtttttatatctgagtagcatggttcattatgagacgaccaaaaatattttaatgctcaagaacataaataaatgtcctaataggatagagccaaaattacttgggttcaaatctcagtcacaccactcagctgctacatcacttgagcaaattacttaaactttctaagcctactttttgttttgttttgttttgttttttttgagacagaggcttcctctatcacccaggctggagtgtagtggcacaatctcagctcactgcaacctcggcctcccaggtttaagcgattctcctgcctcagccccctgagtagctgggattacaggcatgcaccaccatacccggctaatttttgtatttttagtggagacagggtttcactacgttggccaggctggtctcgaactcctgacctcaaatgatctgcctgcctcggcctcccaaagtgctgggattacaggcatgagccaccgcacctggcctaagcctacatttcttcatttttaaagtggagatattattagtcccttctctagaagatgaaatagcacaggtgaagcactcaccccagtgcctgaccacagtaactttgcagataaattgtataactgttacggcttgcaagagtccattgattccagtgtgtttgaagactcctggaagacaggcttagggttccataacagaaatataacagttaaaaagcagcattgctggcctcgtattcaaatttgatgcatatgaacacacagacgtagctattatggtggagtgtacactcacttcaagtctttcccttccgctactattgttcttgacattatacgcaatagaattttcctaatttggaggagattttatgtaaatcagaactaaaatataaaaaagaaaagtgccaggcaaattttcatagcgccacataagagaataccatagaaagaagagacgaacaggaaaaagagatgattccattcccaaactgcacacatactcctttcccagacgctctggccagcctgctgtgggtggcgactctcccccaccccaccccgaaatccccctctctgcaccatctaggatggagaagagcagcctgcctccagctctgcctgcagtgggcccctcactctctcttggccgcctgggaaaccggcctcctcctctcagttctgggctccttcacttctttcttcaacagtacatacccattacacttctcggggtaaacagaactgtcacttctcttgtgccccacccccagaagcaggaggggacactacattctaccgtaggagtgtgatgatgtcataacattctactaagggaaatccgaggaaatccgatcctgacacacgtccatggcaagcgactatgtaggtgacccccttaagccaaggtctgatctggtttgaaactggaggtagtaacatcactgaacaagtaaccaagaagtcatttttaaacatcaaattgatgctttgtggacaggcagtggcctaaagaagaaaaaaaaggtgggacccagactatcccacaaataggcatgtccagtttcctgggcctccgtgtcctgatatggaaggtaggaacaaataccacctgttctgccaacagtatagattggtgatagtaaagtgaaacagagttactcttatgctttgtagaaagtcttcccagcctgtggaataatcccctactcacatagtgccagggtttgcctctctaaagatactttgtcaaatgaccaagaaattttgcagacaagtggtagaccaggttctttttctacatttccaaattatctccaaatgcctttctgattactcctgggcattaaatcaacaaatcactaagagctcatttcaaagtcttccataaatcataaattattaggaacttgctttttacaaaaggcctgcacaatcaaatcaatcctcccataaatgccacttcacctttaaaactcagttcatactttacaaggtgctctcacatttgtttcatttaatgtaacaatgctctgaacgaataaaataggtattatcagacatctcattttaccaaagaagaatggaaataacggagctggatctacaactccagcctctttgttgttgttgtgttttgagtagatatggggtttcaccatgttggcaaggctggtctcaaactccgggcatcaagcgatctgtccacctcagcctcccaaagtgctggaattactggcttgagccactatgcccggccctagaactccagcctctttgagagcctaaccacagaacacccagcgggatctgactggctatttttcccagcctgagatgtagaagacaaagttaattcacacgtaccatggatgcctcagggtagtagggcttaattctcttgtggaagcactgctgaaaagattccaagataaggcaggtaaaaaaatgacctttccccccctatactgggtagtgctgacaaagtgtgactcacaggtgggaagacaattccacccagccagcctgtcttccatctccatcttggtgcctaggtaccagccgggcctcccctaaggttctagcctctccctgccagtgttcctcctcccacccttgaagagaagcctgcaaaggccatttgctgtttttcagctcattcactggccagcatgctgcagaacagatgcttttttttttttttttttttttttaaatcacaacagcaaacactccgtgtataaacgaacacatttaggaataaaagtgggttggaggcgagagcacagctgaatatctgacaatatgttctaagattcaggcctgagaaaaagtgaggctgactttaaaggaatcctgtttcaatcaagagtttcaatgtaaaaaaaaaaaaaaggatgattttaagtcagggactattcattctgcctcttctcctcactgacggatcatttttagagcacgagggtcaaaaaggctgctaaaagtccttggcatgtgtaaaatttaaaagcttatttataagaatggactcaattcactcggagttacttcatattattcttactatgcttgagatatgtatgtatttttttacataaaagaaacaacattctaggcagctagagcagtgtcaaagggtagtcctggggcacctacatgagaaccacctggatgatcattaaaagtgcagattcctcctcaatttccattaagggaaaggttttgctttatttttctttgcaggtagccaaagctgtactcagatattgctaataaggaagaaaaactggtctcctgttaacctgaggacactagggccagaggtcaggaagagggatcaccttccccatcaacacaacatctttttagaagtgctgcctctccttctgtaattgggaagcacctattactattccttaaagcccaaagaggggttagtaggatgatgggtataggagacgttggggtttaaaaaaaacaaagtgcagattcctggacttcatccccagccaaccaagtcagaagcaatgggcatgagaactgaggatctgcatttcaaccaggtctattttcgtacacaataaagtttgggagccactattctacacaataaggtattaaattaggaaaatcccaagttgagagactggagttaggacaaggaacaggacaaggaggaacagtcagtgggtttcaaacacaggtaccactggtaaaactgcatatctgcaggtgaaagaacatggccttttacttataaatacagccaaccaaagtccaaattgagggcagatgtggataggaagagaatgagctaagtctgaggtggctatcaactcagtcttcaaacaagtcagggagataaacagccctgttttggtgtacagttggttttcagtatattaatagatttttcattaaagcctacttcaagaaaagtcacttctggaattttacaactcaaaagtgacttacctgtaaagagtttaaaaattattttaaatacatagccttgttaaaccaaaattgtagataaaaacggaacagtgaatgaatcaacacattccatatggcgtgaggcaatgtgaagttcatagacactgggttaagtgttgattaggcaatgtgtatactgcttttggcaatgtactgttttttgcaagttactttcctcagtaagatacattttaacaatatttcttaaactcttgattagaagaaaaatattccaaaagtagctatcaatgcaaacgagcgtttatttcaaatagttttccaatcttttaaatcatttcatcaaactttccctgtggtgactaccagaagattggtggtctagccatcttgggttcttatgcaagctctttgctttccagcttcccttgggaagttacttaacctctgagccacaatttattttttataaatacaatgcagagaagtagactgagagctgaacattgtttgttagggatgagtaggcaccaaacacacgatgttgttatacctagctcataattttcatgcacaaaaatcaactggtctttttacactattataggaagggcaagcatttttagtgaattaaggattaaaatcttgtttcacaaaatagaaataatcaggactaatgtataaaaagatgagagttagctgttaattgtgatggctcaaaaataattttgaaatacaaaataatcttcattaatttagatcaagcttgtccaactcacagcctgcacgtggcccaggacagctttgaatgcggcccaacacaaatttgtaaactttcttagaacattatgagatgtgtgaatttttttcttttcgtcatcagctatttgctagtgttagtgcattttatgtgtggcactagacaattcttcttccaacgtggcccggggaagccaaaagattggacacccctgatttagatgaaaagtctgattccaaggattaacattaatgaaaagcaaaaagaactctaaagatcataatcatggccctctattgcaccagctgttattcaacatgactctggaaagaatcttatcctagaggcaaaatgtctgctgcagatgtagaccatttaactgtaatctatttccaaggctgacactttcaaaatgatctgattaactgggattgtcggacataatataaaatgtatccaagagagttacagctctcctttatgactatgcattcctaaaggacaattatcttttcttttcaagatgtggatttcattttttaattattctgactctgctttaaacttttattttaggttcaggggcacatgtgcaggtttgttatttgggtcaacttgaatcacaggggcttgttgtacagaatatttcatcaccccggtactaagcccagtacccgatagttattttttctgctcctctccctcctcccgccctccaccctcaggcaggccccagtgtctgctgttcccctctttgtgtccatatgtgtttgtcatagaaatgttaaacggtttatagaaaaacatttgtgcataaaaaacactgagtattagcatattttaagaagaaaactacctttccctagctaccactgttggtaataaaatcattcattgattgaagtctaagcacctgctaagtgccaagcacaaggtgggagaactacaaaaattaaggagctattggccttgcccttgaagagttcctaattctagatggcaagaagaggtctataaacaaatctctgtaagaacaaaatcttaaatgtgtacagggtgctttgaaaagcacactagaaggcacagttaacttacttgaaagatttgggtgaaattcaattgaagatattttagctaagacttaaaaactgagtaaaagagaaggagcatgaggggtccgcgacgggaggggagtggaaagaggagagtgcactccaggcagagaggataccgtgcaaaagatgtggacaagaggtgcaaatgaacccatggccggggcctgggaggggaaaggaggtctgaacaaaggggaaagagtgcctagacgtgaatttggactggaagatttcaatcagtcaaatcataaatggtgtgcttagtatgtctggattttttcccccaaggccaaaatagagtcttttgtgtttgttaaaaatgtccagtacaggccaggagtggtggctcaagcctataatcccaacactttgggaggccgcagcaggtggatcacctgaggtcaggagttcgagaccagcctggccaacatggtgaaacctcgtctctactaaaatacaaaaattagccggccgtggtggtgcgcacctgtattcccagctactcgggacgctgaggcaggacagtcacatgaatccaggaggtggaggttgcagtgacccaagatcatgccactgcactccagcatgggtgacagggtagaaaactccttctaaaaaacaaaaaaaacaaaatgtccagtagagacacatgtcagcctgactctaagtacagatcctggccgcaagtggagttgggggcgcaggcctggaggcaaggtgacccattgggtagctgttgcagtatcttccaggtgagaaattgtgggacttaaaacagcagcagccagaatgctgagcagggatggatccaagtggcatttaggacacagactgacatgcacgtggaggatgggggaacaggagtatgatttcagttgttagcttgggtggtaagtgaatcatatcgaccctgccaaagctgaggaacaggggtgaatgaggagacgctgcatggcgctcaggaaggaaggggctggaccatcaggaaggtctgattatactggactggctcacctgggggcagcccctcactgggaagcatctgcagcttgggaaggagagaactagaaaaataaatctgtgtcactgttgtataggtagtagcggaaaccatgggaatggatgagaaaacagctggcaatgaaacccttgctatatactatgacactatttaaggggtaagtgaacgtatgggacagccacttgacagactttcccccagcccattaaaggtgatcataatgaacactatgaggcaatgtggaaaagtgcttgacctatccagtgaaaaagatcacagcagacatctgaccaggtgccatggctcacatctgtaatcccagcactttgggaggccgagacgggcggatcacttgaggcaagtgttagagaccagcctgaccaatatggtgaatccctgtctctactaaaaatacaaaaattagcccagcatggtggtatgcacctataatcccagctattcgggaggctgaggcaggagaactgcttgaacccggaaggcagaggtcacagtgagccgagatagtgccagtgcactccagcctggcaacagagcaagaccctgtctttaaaaaaaaaagattggagcagacacttaacatacacaaatctcaaaagtattatgaaacaagccagagacaaaaaacagcatactatatctttccatttaaatgagaatctagttcagacaaaacctttgataataaaggttaaatcagtgtttgcttctagggggaggggtgttccactgtgaaatggcatgagggaatttactggattgacagaaatagtctatgcttgataaggatgtaggttttaggagtatatgtctgtcaaactgatggaataattagcattccgctgtatgaaaattacaccttaatttaaaaaatcgtagtatgaagttgtatatattcatataaactaagaaaagggaatatgcaaataaagttatgtcagggcagtggagctgccggctgttttcttttcacttaaaaatcttaattttcatacattgttctaaaaaaaaaaaaaactttaaaacttaaaatacccaaaaatatttatcgagtacccaagaaaacagaaagcatattatattatttttccataggaaacagaaaagaatccctacaattatggactttatacctgaaggtaacaagaaaacacgagacagtaaagacatcaacgtagagtatcaaaaaatcactggaccaaagggacacttttaagagtttctgcagaagcaaagaaccagtgcttccatgaagggagtgtggctcagacagtggaaacacacaggctgctttggacactgccacagtgagactgagggaacaacgggaaagtcagtggatgctgggacagctggaggctgttagatgcggaaggtggaaagcacagactctacctgggtttcagtgctcctgagtttatgaactgtcctttttctttgcagttcttagtagtttgggtaccttgtctcaactttcattgagaaggtgaagaaaaattacccaatgggagagtgacaccaactcccatcgccccacccccattattttggagggaagaagtgggtgctttgatgacggcgatagtggcagctctcttttcttgagttgctgtgatgggccaggcactacaccactgctttatatgcattactattttattcaagctccacaataacgcagcaaaatacatactgatttcatatcaccagcgaaaaaaccatactcaaagaagttaggtaacatccaactaggagtggatggacaaaaacctaggctttgactccacacaccacactctactggatcaggagaatactctgatgaggtctcatttccacttgagtttgaagagcctgtcgtttgggatttctaggaatatttagtctaatgattattcctttctgtagcatagatgatgccctcacaaaacagccagtgtggttaattactacacagctgtcaagctgcatacatcctaatacctattatttaatagcagttaacacttggtgctagatgctttacaatgcattacctcatgtaatcctcacacccacccttggggcagacaattagcatcgccatttttaccgaggatgaaattgggacagaagagatacaaagtgacttgtcctaagtcactcagttaccacaaatgtggccccggacagtgtgacaacatcagcctaaccactttactgcctcaaaatttaaaactgggttcccaactttgctatgtcaatgtcaaagttagtttcatgctgaaactaacaatcccactggcagccttgagagtgttcttcctggaccgcttcatcacaagtgtttacaggtttcgcttccctccacttacagaaccaaaacccttctccaaacggagaacggttaccatcagatgtatgcctgctgcaacagcagcaatgacacattccctaagaagccagcactgggtgactggggatctggataggccacccactgtaccaacactcgggaggcaggagaagcagtgcaccaggacagcttccttatcaaggataggaaggtgacagtgggcacagactgttacagctatttcctgtcaggctacctgactcactggaggtgctgaatccctgggccccaactgcggttgcttaattgtgctgtccactaaaatgtaaaaagagcatccttcattgaagcagagcgaatgggcacagtgttccattctcattgctgccttgtcttcggagagaggctgaaatgtgaacctctaggtaggctcacctccacttccactgggttataatgaactctgaaacacacacaaaaaggcctctttcctgatcttctaactctgttaattatgttatttaaggcatggacaaaagcaagttgggttggtcatttaggtaatcataagggctgctgtcaagttaagtaacatggcagaaagcctgcaaagtctgagagctgggctgtctctcagctgggatttccttgaactgtttcaccagaactctcaagtctttgggattctgaagtttccatctgtcttaaaattacttttccataaagaggccttcatttccacagcctaaaataaagtgaggactgatgtcttggctaggtattaagaatctggacggttagtcagggatttggcctcacctcccactggaaggggaaaagggaagatgaatgcagagaagtcttttacagagtcttgctctgttggccagactggagggcagcagcacaatgacagctcactgcagtctcgaactcctgggctcaagcaatcttcccacctcacactccagagtagctgggacaacaggcacacaccaccatgcttggctgatttttaaattattttttgtagagtcagggtcttgctatattgctcaagctggtctcaaactgctggcctcaagtgatcctcccacctcagcctcccaaagcgctgggattacaggtgtgagctaccacacccagcccagacaaagtcttgaccccacgttcactgccgtttgatttctgctgtggtgaaggtgggagaattaagagtgttcaaatccagcaaatcaggttggcagtgtggtcttgtccaaaagaaaaaagggcagtttctcctagagttgggtgaacacaatttgcttctctggatgttaccttgcattattcatacaacatacctgggcatattttggtggagactgtaacacacacagaaaactgcaaagggcaaggaaataagccctagaatggtcagctccagatctggctgaagctgaagcaggaagttgattctctaggttgaggagcccagggcagagagaagaaccccaaagcggtcagatcactccaagatacgagttgacgtagaaaagggagtgtcggctgggtgcggtggctcacacctataatcccagtactttgggaggccaaggtcaagagatggagaccctcctggccaacatggcgaaaccccatctctactaaaaatacaaaaattagctgggtgtggtggtgtgctcctgttgtcccagctactcggaaggctgaggcaggagaattgcttgaacccgggaggcggaggttgcagtgagtcgagatcgcaccactgcactccagtctggtgacagagcaagattccgtctcaaaaaaaaaagaaaaagaaacagaaaagagaaaagcaaaacaaagcaaaggcagtgtcgtgtctgttccatgaaccctaagggcttccaggagagaatggaactaaaataacagcgtagcctggaaactggagggctgggtggtgggtgttgagacctggaaactgcagggctgggtggtgggtgttgagacatgtaaactgcagggctgggtggtaggtgttgagacgtggggctccctgtggagcggggaggtggtgaaccatcagcccccctccaaatagtaagattagcatagaacgtgcctttttcagccaagttgccttcatggacagcatcctttcaacttcatactcactactcacaaaccaacccttggaagtacaacggatttactgtttatcaagaggggaaactttcactattctcatatgaaaagtgcttcagaaaaaaaaatgacaacattatttaacaggaattcacacaattacaaaaataactctgtccctctcttcagcaagagaaatattttgctcatcagaagttctgctaggcttagtcagatcagtgccaggaattctgtgaactgaaggtcaagctgccaagattcaaaagaaatgtcgatagtaagtgtttgcccagatactagacagggagtgccaacagctcccagcatgcaactccagccacaacgcagacaggacaaccacattttccagtgttccccttgtcccataaaatttaacaacaacaacaaaaagctcttacctagctctccccggaggttaacaagttcttgagatagggttttgtgttgtttcagtgcttcctcccgctgcggaaaacacacatcaagttactcatgctttcaagagggtccctttcagtaaggtacacatttgttatcactaggaaaatgagacccagtattgggaagccaagatatgaatcatttaggctaacaatttgtgttgttaaaagaaacacagttgtcccttagctgttaaggaaattcgtaattcaaaaatctgtatttttgcaggtcccagtgaaactttggtttgacgcagtgaatggcccatttagaaatatttactttgagccagtgcttcactgctgatccatagaacctttcggctaatgcatactgtacttaagatgtaatgcgttctcctcctccaagggcaataaacatctaatcagtttaagataaatatttaatgttctaaacataagcacatatatgcactttgtcctatatttgcacataaaaaagtttcgttacaatgccaatccttctaaaagaaagacaaaaagtttgttagaaagctatagcagaaagataatcctttaaagacaaaattaaattaatttttttcagctacataccattttctaaggattatgatattttggatcagtgataattctaaatcgatgttagagaaacaaaccaaagaaaaccggatggctgtttttagtatcagagaagcaagtatcaaccttgagctgaagaataatgttcaagttaccagcaactcccggcaatcacacatacacacatacttacacaaatacagtaattacatacagttccttaaaaggtagattccctagcaccagggagtaactaaaaaaaaaatgaagaatttcaaagctcgctgaaaaatgccctcacgaggatcacccaagacggagctcccaccacatcctgatcacagcgttgcagagatcatgagacccggcctttgcaggcaagagttgcttgtcattcaaagcattttccctgaattccagacagcctctgcagtagtcctgacattcttccagaaaagcactataaacaaatactaattacccttgttgctgcacatggagaatagaggcacagtttgctgctggggcagcccattttccagcttctgtctccaagtccccccacccctcgcactgtgcaagaagcatacaggtggccgcgccacccaccagtcgggtctgtctacattcaaagctctagcaggaggcgcgccattggccctcgggcgtcttacttcatgtcctgcaggttaccgtgtgcctcggattcctcactcacagaagctgatactgcagcttctgcctttggcacaggcagcctgtgattacttaaagccacagcctttcatttatgaaaaacgagaggcaggcattagactgatcgattgccatttagttaaatatcagctgcaacggaggaaagaaaaaactgaccccctctgcatggataatggagttatttttagacttgtgagcctttttcttcccctctctaattgtggtcattatttgatcacacttactaatagaaaagggaaacttgttcttcgaagcccatatactaaatgaggttatgaactaggtgaagagcaaggaaaggggcatgctgtcgtttacaaatttaaatgacattatgaaatgagaggtgtttcaaaataagtctgaagtgctgatctgagagttggagatcccatatatttttaacttttactttgttctcacctctcagtaagagctacggaagtcaagtctaaacgccagcactgaaacgtggtcagcagggactgggatttaagacccacttttcactgagtacctttctggcttcaatggtattctaaatgcttggtttttaaaaatatggcattaagttgttctgaaatcaccagtgagtcagagtttcttaaaataataagtaattggttttctaatgtagaaattaaagcctgaggaaaatcagcccgcataataatggaagaaaaacataaaaatatgtatcataaatacttctcgtaatatcaaatttaagcctgaattttgtttagtaatctacttcaagtaaacaccaggaagctttaccactcaagtaacaggaaaaacaagacagctttactaaatgcccacaaacaatcctgaaactcatttggtgaacttgcttaaaattcacttttcagtagtaaccaagttactaacagaaggaagagatggcaagaaaattcaatcatttttcaaatttatggaaactaatgggaggatgaaagaaattaaaaattacagttagtataactgcaaagaaaaattgtgtgaaatcattatgttctactgcaaaaatacaccaggtgatatttttgcttattaagggaggttttgggaaagggagtttcaccaagcatgtcgacatttccccaaacttcaactccactgcactccacgttcctgtccttaatgcctcagaaactactgacatcttccaacctctgtcaggcacagtaacagtaacaggaaaaccttgaggtcatctttcactctttgtctaaatgggttgtgcaaaagtcagttggttcttcccttgtaatgtgacaccattcccctcctccaaatgcatagaccatttacccttctaaattggttggtaacttattacttcaaactaattaactaagcatttttcatagcagatgctgtgaaaatataaaagaaatttaagacatggtccctgccttcaagaagcatggggcctacctagaactagaacatccaggctcaattcttttggtcatctatcaaggcagatgacctcatcggatgggaagcagtaatgaaaaaaaccaagggctttaaataccatccatagatgaaatgctgaccccagtgcccatactgtaaaagacacatactaagggttagtttctgcctgactctccctggtagcttggcctttacatgtacttaccctttacttgtagatgataaaatgcattatgtcctttagatactgatttactgtttctttttactcagctgctcctagatcagtgtttctctcttagatgataaactcttaaccgtctagataacaggttgattcaattctctttgtattgtaacatgcagaattacacacaatgtgaaaaaagagaaaggtggaaatctggatataaagatgcctttatgctcaggcattaaatatatgaaatgctcaagaaaaaaaaaatggattcaccataattgaattaggagtccctgggacacaggcacttagtctctggctgtggtcccatcggtgtgcctgcatttttgctagccactgagtagcatcaacagcatagagcatcttgcagagaatagccacatcagatggctcagacgtgtgctgcatctgacctcctccccatcacccacacagtgaatttgctcaatgcatctatgtttttttgttccaagtcaactttactgctagtgccattcaaaattcacctttgttcaggtgctactttaggttaaattccacttgcaaaaaaaaaaaaaaaagatgtggaggcattttgaagaattagaggtttggggagggtgacctcagccctgttcaagtttacctagaaagccacccaatagacccttttaggaagaagcttaattactaccatcaatactgttgttcactttggctgtctgtgcagaataccgtctaactaagcaaggataaaccaagaattagaaaaaaactaaaataactttagtgtgtcttctgcgaaacagagtgtgacattagttctcagattcatgagatataagaatgtctgatatgtaatgaaatatgtctgccactacagtgggaaacttatagttactaagtagacttgcaacaaaagcatggtagttgcaagattctcttaaccattttcacccataatcgaaggctctaaagccatttagaaaaggttagcaataacaaaaaatatatatacacacacacacacaaatacctatatattatacatatataaaaatacatagacatacaatgtataggtatatcatgtatataaaaaacatacataatgtatatgtatacaatgtgtatctgtatctattttatatacatatgcatgtgtgcgcgcgcgtgtgtgtgtgtgtgtgtgtgtataaacacagtatatatacttctgtaatgggaatgggaactaaaaggttaagggagtttttaaaattgtttaactttacccatgattttttttctccaactatttttattttatttatttatttatttatttatttattttttgagacagggtctcactgtcacccaggctggagtgcggtggtgcgatcttggctcactgcaacctccacctattgggttcaagcgattcgtatgcctcagtctcttgagtagctgggactacaggcacatgccaccatgcctggctaatttttgtattttttggtagagacagggtttcgccatgttggccagactggtctcaaactctggacctcaagcgatccacccgcctcagcctcccaaagtgctgggattacaggtgtgagccaccatgcctagcctccaactgttttataatagtgctcagtatacattacacaatcagtaaatatttgctgattataaaataaagagagcaaagaacatttacataagactttatgctcatcctacatctggaattccatcctctccgttcatatgttcactcacatatatactgtgttgactattaaagctgctggggtggtttcataagaaagaactagatgcagatcctgccttcagtaaatttcctgtcttaaaaagcaaaaacaagcattaaaccggtatctctaatataacacagacaatgaaagagaagcatatatgctcctggaatccagacgggaacagaacgtagatctagaaggccaggaaatcattcctgagtgggttctggactgggagtggtggatcatgcctgtaatcccagcactttggaaggccgaggcaggtggatcacttgaggtgaggactttaagaccagcctggccaacatggtgaaacctcatctctactaaaaatacaaaaattatctgggtatggtggtgggcatccgtaatcccagctactcaggaggctgagtcaggagaactggttgaacccaggtggcggaggttgcagtgagctgagattgcgccactgcactccagactgggtgacagagcaaggccactgtcgcaaaaaaaaaaaaaaaaaaaaaaaaaaaaaaaagcgggttctggagctgtattcagtgcagtcacaattccttggctgtcaggacctaaatttaagtataaggtgaaattcacacacagtacaattgtctgggaaattcactaggagcttgccatgtttgtggacaatgcatctctctgtagatccaacccagtgaatttttttcctctagcgttggatcaactctctctataactgagcacctgataaaggcctcggcttgtgtttagaggccaggttgcatgagggaaaagtatctttaaacactaagatagcagagagtatagaatgctcacgccacaagaggtgttcggggactgagcagacacatgaaggaagggtggactcctgaccttcatctcaaattgactcccgggccttcgttcactggggggaatacaaggtggacttgtgttcttcatttaatttgctttttttcttttttttttaagttggaatctcgctctgttgcccaggatggagtgtagtggtgcgatcttggctcactgccacctccacctctcaaagtaaagtgattcttctaccttagcctcccgagtagctgggactacaggcacatgccaccacacatggctaatttttgtagttttaggggagatggggttttaccatattggtcaggctggtctcgaacttctgacctcaggtgatccacccgccttggcctccccaagtgctgggattacaggtgtgagccacagcgcccggcctgcatttttcttccttcagttgtttgtgtactgaatctatgtaaattaaatgcaagtggtgatgtgatgctgctgtaaaaccgacctgaacatgtaggtattgtgggcaaggacagcaacccagtaatgatacgtgaacaatggatgacgtacaggaagtttacaggacatttttagttgatagcttcctagacctaggtttacgtcctggttctcctcttgctagctgtctgatagcaggcaaattacctaactctatgcctcaattttcatatttgtaaattccaactcgtgtctttggtgaggatttaaataaggtaagtaagaatatctggcacttagtaaatattaggctggtgcaaaagtaactgtagcttttggcatgatggcaaaaccgcaattacttttgctcaaacctagtattcaataaatccctcttgcttctcctccatctctttatgtacggctacagcatctgggcatgataataacattaaaaggggcagttgttgccaaatgataaagagccttatagtaccagttgaaaaccagactccccaaaacaaaataacatgagttacgtaattataaatttcctagtagccacgctgagaaaagttgaaaaagatgaagctaattttaataacgtattttatttaacccaaatatatatataaaataatatttcaatatattcaatataaaagttgttaatgagatattttacatcctttgttttcattctaagtttttggaatccaagtgtattgtacacttaccacacatctcaattcaacggatttacatttcgaatgctcagtctcatatggctagtggctaccacactggacacatcagctgtagataagggagaaccactggaagatttaatcagcagcgtgggatgctttggtaagaggacgctgtcagcagtgcttgggatggattataggtgagaaacagtacaagcctaatgattggttaaaaaggtgctatcacaggttgggcgcagtggctcacgcctgtaattgcagcactttgggaggccgaggtgagcggatcacctgaggtcaggagttcaagaccagcctggcccacatggtgaaaccctgtctctactagaaaattacaaaaactagtcgggcatggtggcgggtgcctgtaatcccagctattcgggaggctgaggaaggagaatcacttgaacccgggaggtggaggttgcagtgagcccagatcacgccattgcataccagtctgagtgacagagcaagactccatcccaaaaaaaaaaaaaaaaaaaaaagttgctatcatgatctagtggaagctatccagggtctgagcaaggatggcatgaatggggacagcaaagacataggaaggggaaaagcactgtgaaatgagagttcacaggacttgactgacgtcatgaggaggatgaaaggagagaaaacagttgaggatgggggctattaggctagatataataaaataaaataattggtttatttctaaacataaaaactaattgttccccacatttgatagtatacagtttctagttagcttacttggttatataaacacactcttgattcctttcttacaaatgaaagagaaacaaaaataccatatactattaccgttactaaaaccctaagtagtctccaacttcccctcaaaaaaaacaaaaacaaaaacaaaaacaaaaaaatctggagaaagctgtaaaatactcatcaagaaatcattaaggctgggcgcagtggcgcatgcctgtaatcccaggactttgggaggccgaggcagacagatcacagggtcaggagatcgagaccatcctgcctaacacagtgaaaccccgtctctactaaaaatacaaaaaactagccgggcgtggtggcgggtgcctgcagtcccagctactcgggaggctgaggcaggagaatggcatgaacccgggagatagagcttgtagtgagctgagatggcgccactgcactccagcctgggcgacagagtgagagtctgtctcaaaaaaaaagagaattcattgaaactgtctactagtctggtagtttctccaaggcacagaccaagtctcatccacttctctctctccccactccctaaaaaggcagccatattacaggggcctctgtatgaaaccaggacaggtttgttgatctgaacaaaactacagaacaaccaaactgaacagttttctttttgcttttaatttttattttttccctatgttgctcaggctggtcttgaactcctgaccacaagcgatcctccctcctcgtcttcccaaaatgctgggattccaggcatgagccacagtactgagccagtctttttttttcccctttgcattatcatgtatagccatctttaaaactgtgatttaaaaaatgtctgaagagctcaagttgtattcttatcagttgccccctgagataattacagcttttattgctatgtcagtaacatgttgatataaacttggttttctcaatgaattttagccagttcctgaaataacatccctgaagaatattagggaaaagtaacaacacggcaaatctgctttgcttttgttgcaccacagagattgttttaggaataaacagaactttcagaaagaatccccagatatgattcagggagttaactcaaaagtgctctttaatccataaatataactaacgtcatttttcaaagcattaaactaagtgtgatatgaaaagctacacacagacaaacacacaaattaagtgaaaaaaatgctaatgctagtttaggtctagaggcatacaccggcgtaagaggcaattatgttttttgctgttgccattctaaccaacagactctaggggaaaaaaaggaagtgagaaaatgtttccatcccaaattgctagagaccgactcaagtatctggtgaagtgacaaaaatgtaatgggatgaatgacacctgatctttcccatcatttacctagatattcccaaggccagcgtgtgagcaagtcctccccgtgctcccccgacctcaagtagaaaggctctttctaggatgcacctccttacctcagacagcaggtgctgaatcacaactgtcaatgcctcaaacttggtattaccacaggcaagaagctgcttgagctgcaggataaatccactttggttttcacattttgttttatattgcgtcaattcaagtgttttctcagggggcagcgcatcgggagctgtctgtggctggatacataagcttcgaggattcttttgcctgctcttttcaactgcaaaacgaattaacataggtacaaagataggtgaggttaatttttaaaatcaccaccacaaggattcaaaaacaaccagataagccacagaaatccatttaagttatgttgctgtaaggaatgcatatggatgagaactggaatgaatcggagatctagacggttggaattcatgaacagggaccgtggcttcatttatgactttaaaagatttatggggaacagagaattaggaacatgacacaaatggatttggcaacccagaaacacaaaaactgggtgcaaaatgttgttctcctcgtttctcattttccagttaaattggtagagaaaccttgactgaagagaagcctgacttttctgatctcatatgctgaaaggaacacacaaatcactggactttaaattaaatgcctttctctcctcccatacattttctacaaatcttttaccttttccctgatgatggcctagccattacacagatttataccgcagatgagtcatttcctaatctctaataaatcataacatacatcgaaaatatactcagattttgcctctttaagttcactgttaggagtactatactgttgactatactattccattttctatcgaacacaagctttgttggtcttttttcccaagtagtaataacggcttacacagtttttttttaaagcacatgctaacactccaaatccacccaaaatgccacgctaagtgattattcccttcctgtgcaatggtgccctgggtattactctgttttaaataaaaaactgttcagtcttggaaccattccaaatgtgtcattttgaatatcaaacagaattggaaaaacaggacatcaattgcttaggttcttgaaataaacaagccaagtaatccaaacaaatgtaaatctggaaaaaagacacaagaaactaaaaaaaaaaaaaagtttccttattctaacagtctttcattacagcatccacgttctgtggtagcaaatctgaaacaacttttaaagaaatttagtaattactgtctctaatttttcaggaaaaggcaagctactacagtgattgcttaaagaaacatcagtactcactttctaagaacaaatggctaaatatattgaataaactaagttaaaaacagggaaaaaaaggctcttattttctatggctgcattacatggttaaataagtcatatttgtattaatacttgataattctcagttctaaaatcactaaaatatccattgtcccactgtgtctctgtaatacttgatgagaggaagtatttatccattactctttattattagcaattattagtagtagcttatgaataattgtcacttgcatagatgtagaaaatagccaagttaatatcgtaatattacagccctgaaggaagaacaaattattagttacatactaatgaaaaataatctaaatatttgaccatgagattagcattctttcatgtcatttcctaaatgtttttagaaattgtcacataacacataacaattccacagtgtttcgctcatcacagtgtgctctcactttccctttcttttcatcctcccaataaccccagatagggaagagaaggctcacaggtgtgaatgtcttccctggatgtagacaacttctatgggaatccagattcaaagtcagaacccaggcctctgatgctaagcctcttctgttcccacacattttggaaagcggattaggtggtgatgtaatatatgacatacataaaaataaatatttatgcaacaaatgtaataatatcttgctataatacatataagcccattatctgataactcattttaacaaacctacatataaacatctatgtgttatataactttataaacaaaaatgttcaaattctttcactatctagaatttactgtaacaaatatagacacagttcattctcctgatatcatttgtatatgtcctaccgaaacttacttaaaaattcatttattgataactcctttatcatttcctgagtcctgagtaacatttgcctctctttctagaatttctatgctaatcaacgctatttttaacacaatttcagagctttaaaactgttggtttataattatttacaaaatctgagaggtgagtcttttatattaatattttggagaaaatattcttcaagattcttgctttttgcttataaatccgtaacaaaaatatcacagaatacatgtaattgtactaacaatgtttacttttgaagggaaggtaataggaatcagacagctaaaaagtatcctgaagcattttttatactttttaaccatggggtaaatatattacctattcaaaagttaaatataagaagtaaataaaatcacttttaacagacagttaaagtgaaattcgaggacatacattttttatataatacttagctatgaaggaaatagtctatgcagaatttttccttggggaaactacacaggaatctaaacattacgcagggtttgtaagtgattactcaggatagctttatgattaaggaggaaagaacacattgatgtattcgtctaagagtacgtgtcttcaaattttaaaatgagagcaaatgagccaacagactgccctctccgtggcgctggaaactcgtgctgtgcagtcaccatcttccgctccatatactgtgctccctaaggatgaagtgtgaccgcatggcagccgatgacccagtttccacatgcttcccactctcagcactcctggctcagctgaagatcagagatgatgcaaaaatctccaatgacgctcaaaaccccaaggctcatcaatacgtacttcacagtactgaaaagccaggggttcccttaaatcctgcaggattcattactaacgtgaaattagcatattatcagccaaactttgcccttacccttgcttattagcatgttactgttttgataacaaaggttttatacagaagtataaattattttgtttactgtacctattaacagaacatgttctgattttaaagggccaatttaatcagaaaccttaaaattaaacgtcaacttctatatcgattcagatttatctcaacaagataattaccaccatcagctgtgatccagccttactgggactcattctaatgaaatggcagcctccatcaggaaaacgaaggccagaaccaaagacatttgctcatttggaaagcagctggatgaccctgttggctatctttgttctttctattcagaaacctcaatttaataagatttaaaactagtgcaatgaagtcatgtatcatcttcttaaagaaagtagttggttaatgaggaagatgcccatttctcaggctcaaatcacttaggcaaatagacctccaaatcccaagaccaaaaacaattttgagagaaaaacctaaccattaagacatggactaaccgtaaccacatactagcagctgaggacacattcattctaggctgaagaagccacacatttcctcaatctgctggcttttccaattattaaaatcaagttagagaccagacctactgagggagtttgccttgggttccgtgaaacacaaactaaacacagaatttggaaacgaacgttgtccacttttgtgtatactcactgacctactcactcactcatgaaatatatttattaaaatctaccatgagggcactgctgtggtgggtgtgcacctgccctggtgctttgcggggacaggagaagtatcacataagagggtggtattgctcagagaggcacaaagacaccaaagatctctgctgactcatgtttccctagtgctcagctcttcaactccaaatctcaacctatctgtaaaaaggtgacagtcactgactggatggtaagtcctttctacaacatattgcattaaaaaccgatgtttgtgggttgacaaaacataggttatgaactcagaagctagtgagaggtctctctctgctagcggcatggacagacagaaaattcccttttttctgccttaatctaatcgtacacatctaaaagccctcacagggacactgacacagaagttctttcagtcagtttccccagcatctggtggcaggtgcttatcctgcctatgcaatcttacatacagttttttaaagttaccattcatgtcaattattagtttatgtttgtataaagttttctagtgttcattagctgtttactctaaaagagttaacagtaataatttaggagacatatatttttctatttacatataatatttttctatttctaggtagacatggcatttactgaaaatggaaaattttaagctcagcaaagcacagtgtttagacatttagaattacccaagccaggccgggtgcggtggctcacacctgtaatcccaacattttgggaggccaaggcgggcagatcacaaagtcacgtgattgagaccattctggctaacacagtgaaaccccatctcgactaaaaatacaaaaagttagctgggtgtggtggcacctgcctgtactcccagctactcgggaggctgaggcaggagaatcacttgaatccgggaggtggaagttccagtgagccgagatcacgccactgcactccagcctgggtgacagagcaagactccgttctcaaaaacaaacaaacaaacaaacaaaaaaccccaagccaagcccaattatttgtagggggagggaggaggatttaggatgcctcaccatttaaacttttcattactatattggtagaattcgttgcaatagctcatattatatcaaaaagggttctacttcttttcttcacattaaaagcagattagagaatagaaagcatattcgagaatagaaagcatattcatataaaaaattcctgtttgggttaattacgcttataaaatttttcctgaagcaacagtccaaacttgccctaaactattttccatatagctggcaggaaaaaaccaaatttctcatactcttatgtacctaaaatggactcctaactcaaagaagagttaatataaattcaccacattcagaagtacttttaagaaggcattgcctctctcctatagcaaccaaaaaagcatggcactggtctaaaaatagacacatagatcagtggaagagaacagagaacccagaaataaagccacatgcttacagctaattgatctttgacaaagtcagcaaaaatacatacaatggggaaaggacaccctattcaataaatggtgctgggaaaattggaacagagaaactggagacctatctcttatcatatgcaaaaattaagacagatttaagacttaaacgtaagacctgaaaaaataaaaattcctgggtggggggagggaactagaaaaaactcttcacaacattggccgacgcaaggaattcatgactaagatctcaaaagcaaatgcagcaaaaacaaaaatagacaaatgggacttaaactaaaaaggttctgcacagtaaaagaaacagtcaacagaggaaacagacaacctatagaatgggagaaaatatttgcaaactatgcatttgacaaagatctaatattcagaatttacaaggaacgctagcaactagcaagaaaaaatacaaccccaataaaaaatgggcaaaggacatgaacagatgtttctcaaaagaagacacagaagcagccaacatatggaaaaagtagaacatacgaaaaaatgctcaacatcactaatcatcagagaaatgcaaatgaaaaccacgatgagataccatttcctatcagccagaacggctattaccaaaaagtcaaaaaaccacagatgttggcaaagatgtggagagaaggcaatgcttatacactgttggtgggactgtgaattagtacaatctctatggaaaacagtatggagattcctcaaagaactaaaaatagaactaccattcacccagcaatcccactgctgggtatcttcccaaaggaaaagaaaaacacagactatcttataacagaaatgaaaattaaaatagccaattaaaacattaaacattagaaatatttacaatacaaacaataaataaaaagagaacatcattctcaaaatactaaactgtcgacaagcaatttggaagaaacgtgcctaggactcaggtcaccagggagaaaaaaggcaaatctctcaccccaaaagaaagctctattactcttaattttccacagagccacataattgctgatgtttataaaaaggaccctcgtgtactaaaatgacccaaagtattgcctaagataaatacagaaatatgatattcaatattagatacctctaaaatcacacctgttgtgtttctaagaaaataatatgcatatactattaataaaatattattcttagctctgaaagaggctttaaagctcataaaaagcatcattacattaatttatagggtaattatctattaattaaccagaataaattgttctaacaaaacaagtatttacttatatacagcttgccatattcctccagtgtctcttgatgaaaaacactgctatccttcccattctgaatgcaactctaaaccgtaatttattacttactttccatttttgtgtaaaagtagatactacattaaaacataatttagtgtagtaaaactctagttatctgaaacttgtcaaattaggacatactgtccctttcaacatctcacttttaaaaacttatcaaaatcttacctattgtgagcaaaacttgccattcaacactttattgtcttcttcaattgaaagctgtaactacaaaagggcagatattcatgtcacggcaaagctacagctctaaaaccgccacagctaccgaagcttggaatcaatccacgacaaaacgttttcagcatcatgccattcatcacaccagttcttagcaaatgcttgtctatgtggcaagaggccagcaaaatctttcatgactgctttcaaggaggctgaaaggaagaatctggattcacagtaagataactaaggggcagtgaaagactacatctctcgttcttcttcaccttggtccttttgatttcttctacattctacaaatccctgaattttaccttttcacacgcaaatgctaatatatgtgtttttttttaatggaagctttctaatatggcttcattgacgtctacattttgtagtacgaaaaacacaagagaaattgaagtttacttactgtcaccttaacagtacatgaataaatgccctcctaatccataacacatccataaatgcgctaataacatattaagcatacaaaagccacatttaaagttgaacacattcttcccaatgtattttataactgaaaattcattcaagagatcaaaaatcaaatgttaagacttacgtccaaacgacaaaataacttgaaagtttaatggaaccattacacacaggtaatcaatgcccctccaaaacgcatagaatagagaaaaaatagcaaggcctgttgcaagatccaacttgttaaataatacactcccctcatttataatcggccaacatccgcttgagaaatacctgttctgccttctctgtggcagatattccaatagagctcttataacattttatacctgtctgtgggacagagactagagaagtcacacgctctatttcccagcctcccttccaggtcgagtcatgtgactaagacccggccaatgagacggaagcttaagcgacctggcaccaccccttcctcatttctttttcttccttcctggagcagctactgtgagatcatgaggcaacaatcatgaggacacggctaagaagacagcagagatgaggattcctgacacggcagagccaccgaacaacctcaaagctgcttttcttcaggtgagacaagttgcttcttagtgaagctgttaattccatctaaaaagagtcaaaagtgaataccaaatgcgagaacataatttgatgaatttcatcctaattaaacaaacgcattcacattctgcctgcctgttactgaacacttctttaaaacggttctcttcacgaacacaaagaagggaaacaacagatgggggtctaattgagggtgcagggtaggaggagggagaggagcagaaaacaataacttgggtgctgggcttaatacttgggtgatgaaatcatctgtacaataaactatttattgtacaagaatctgtacaataaactctgtgacatgagtttacctatataacaaacctttacatgtacccctgaacctaaaagttcaaaataaaataaaatggcaaaagtaaatggaaatattttgttctgatactacctctgccatccctcgatacgtacgtacacatgttcctcccttgcgctgcagtaatcacttttaatgtcactagctcagcagaaagaattctgtctttagcgtactgaattgccttcactggagtcaagaaggaaattaacctgtgaggttcaaatggcactcttcatagcaattaatacaagaatttccagcttcatagaaaaactgaatgctaagtggcagggaatatttcttagcaaagtcttttccctccactaactcattataaaaatagaactaatatgttgaggtagaattccgaaatagaccgagtttaatactttggtaaaaagactattgctgacccttctccatgtcagtgacgtcatcactggacttcttagattttcatctgtgcctaatgtcctgcaacatcacgcacagttcctgacaaattcactcttttcctcctctcccctgtttaaagaggaaagataacctcgatccaacaacacgctttgccagtgatggataccacccagtaataatatatcagagtgcccagtgccctctgcgtgggatcaatgagaaagcttattctggccggatctctacaatgaccagcccccgtcccaccacattctatgctcagaaatactacaactcctttgtttccttgaaggagcccttcctcaagcccctcaaggtttttacatgctgttttctctgtcggaaacactttgtttcttagtaaattctccatttcctgaggacccaacttaaaaggcacttctactggaggacctggattaaaggtacctccacctgctgagagctgcttgggcacaagtccacaccctgcattattaactggtgctctgtctccttctgttaaacagtgggctgtgtgaaggcagggtccatgtgggacttagtcccagtcatactttcagcacctaccattatgcctggtacacagtactcatctaacgggtacttctttatgaaacgaatgaattaatctgtaatgtgaaagacagtctagaagcaagggaaaggctggaggcacagaccaaatactaagctcttcagaaagcccagtcaacatcttaggctggattatacaaaactgttcctatttggctacttttgacttattatacaaaagtgttcatatttggccactttttacctattaattttttgtgtgtggttttttaaatagagacagggtctcattaactctccagggctggtctcaaactcctagccttaagtgattctcttcccttggcctcccaaagtactgggattataggtgtgagccagtggcaccagccaggaagagcagtttcaatgcttcaacatgataatgcctggactagggtaatggcaggtggtaaaaacaaatcaagatttcaaatgatggagtcttagagttttcaaccaattgattgtggataaatcaggacaagtaatgattcaaaggtgaggtttggccagacgtggtagctcatgtctgtaatcccagcactttgggaggctgaggcaggcgaattgcctgaggtcaggagttccagaccagtatggccaacatggtgaaaccccatctctattaaaaatacaaagaaattagccgggtatggtggtgggcacctgtaatcccagctactcgggaggctgaggcagcagaattgcttgaacctgggaggcggaggttgcagtgggcccagacagcaccagtgcactccagcctaggcaacagagcgagactccatctaaaacaaagcaacaaaaaaacaacaaaaaccaaaggtggggtttgatgaccagacacatggtgtcatgaaaagaaacagataattcatgagtattaactgaatttaggaggtaaaaaaataaggagacaaatcatttagataagatgaatttccaagcagagtaatacactgagggttttcaaatcttcagccagaaattcacagatttggaggctaaggggaacctggaagtcatctcttgtggttcccttattttgtagccgtgtgaggttaggtgcacagggctattcacttggtcaccagcagaatcaaggctacaatccaggcctcttgggatccaggtcaacaccactgcactgaggcaaccaacaccacttccttcactaaggataccaacccaagttactgctgacagtccattcagataagagtcaccatgacggcatgaattacccacttgacggacgatttctcggacgttaaaatgacataacatggataagcccatcaaagactgatattgggagtaagcagaattatattccttacatgattttaaaaagcctccaacacacaaaacgcttcctccatccctgctattccttggatctaacaaaattacagcaaaatttgcagctggaaaatatgtacgccaaaaattctaaatagaagtcccaggttttagtcctatctctggcacttactgtgtgcctctgggcaagcgaattcacttctctgggcctcagacttcctggtataagacagattagatcacctctatgtgaactctagctcaaaaaattatgactgcaaataaacagaaaatagttttacgtaagtttagaaaataaaatgtgtccaatacatcactatcaactaaaccctggtaatagaagccttgtgtcgtttgcttacgctgtcttggaaagctatctgcttcacaacaacactacagacaacttagaatgtctactactagagcactggttaagtaaatcatgacttacccaataatggaatgttacagaactattttttttaatgaggtagataaacatgtgatcacatgcaaatctaaaacacattaactttaaaaaggtatagaatatatagtacgcttttatttctgtataacaaaaaagaataaaaaagacctgcatagatttacatgtgactggaaacgtgcaagaacactatgcaagcagctgagagcggctgtctccacggagagcagacagggactctgggtaagagagaggcttgcctaggactgcacaaccttccatactgtttgatttttaacttggagcgtggattacagtatttttaaaagaactctttaaaattaaaagctatttggagctactttagatcagacaaattattgcaaatatagggcaccctttgttatttttcccccctattaatttgttcagttggaagggctgcagcggccctgagctgggagaggagggccactgctgacctcctcctcgctgcctccccccatttaccgtcagctcagactgaaagggagaggctggcaaaatcaaatgacaggtcaaggggagttatgaaacacgagagagaggtgctggaaaaaatgagaattctcccacagagaagggagatgcctctgggaaaactaaaaatagtcagctgaaaacaaatcaccagggacagagatgagccacgtggaaaataagaaacacgaggggtcacgtgcacatgaagcagaaacaaaaatctatttacatcctcatcaaacattcctgtgacacctaacgctattcagcccaaaacaaatataaaaacaccccagctaacatattttacagaataaaactgatttaatttactgtagctgtaaaatcatctaggacaaaagtagcaacataggccaacccaatgccctaaaagtgagcagacaggtcaccacgtgcctaaaatatatactaaatttattttcatcttaggcaccgaaaataataagcagatacaaacataaacctcaggggaagtattttgagactgcacacacttttattatgaagattggaaaactagatttgtgattcacttactacttccccataaccattaggatgttttctgtcagaagtgtttagtatacagaaatcttttagcatattaaaattaactgtcaaatctgactgagaaactatccaatgaaaaacgatgggaaccttctcatctacacaggcgaacaggaaatattcttctaaatttacctgtgtcctatttcccaaacactggaactaaaatataatttaacaggtgctgattttcacacatttggctggtgatggagaaaagagctagggaacaccaaggcaacaattctgccttccatcaacacaaacaacacaatctgctgccaaaagtaaaagtactatgcacttgtgctgaagcaacagaaaacaatttttaaattaagcctcatctctcattagagagagcttttttcctccaattatctgtctccttggaaaaacctctgataaacatctgcaaattaatgaagacatcccccgtgcaacactaaacagagatctatgcgagacagacctgtgtggaaaacaacagtgcttctcctaaaccctgaaggaagtcgaaggtttcgaagcaatcctttggccgtcagtcgtatgtgaatggtggataaggagaatttgggagacaacaacatgtcttcggagcaggtggcgagatttcacagaagaggcaatttccatggactgtcacatactgtctttttaaactcagtactcttcaaggccaagaaatacagtcagaggaaagatgcctacacagcaaatgtcattccaccagagaggcatagaagaaaaaaatcccccagggctggccaagtgtttctggcttccgttttcactttcagatgttgccaaaatgatgctcttcctctgaatacaatctccctcctgcaggtctagaagctgcctctgaaccacatcacactgtgcatgcttgtggagttgttatggttttcatccgagatggtaaaggggaggagaaagtgggtggtctcaggagctttacagaacaaccaataatgtcacagatcctgtaaccacttgaaagatcgctaggggaaattaactacttcaagtgcctaatgtttctttcataattagaaaaaaattaggatttcctgaaagtaaactgtgtcctgattttaacatttttcactccttatattcacaatgataacatgagcattttttctctagatattttacatgtaaactacatttaaacctggtattttggaaaagttttttttttaaagacttcaggcaataaatgttctcaactacaatatttaagaaaatttctattctaatatattaatgacagattgtcaaaaggttaaagttcaactttaattcccacatgctgaggacctcacaaataatcaacagtaaaagattaatacggtttctctatcagatgtaatatcagagttccagaagaatagtccatcagataggcatattctaaagactacatttattgcatgagtaattgcatttatagaacatcatgtggtctcttatagtggtctttcaagactaggagtgtgaggagggcacagttatgaatatcttttgccagttatctactaatttttatttcagtagagtggcttgtaaaagtatgttaaaacatgatagcaaaaccaaaagaacttgaaaaacaaagatatggttataagaattaacaacaacaatatgcccacttaagctaattccattaaaccacgaatagcctgagctcttaacatttttaaaaatgttataaacaaaacaatgttttaaaaatgtcctatgcctgtttccaagatttcctagaaaataagactcagaaataaatgcagaattgttaccataaataacactattaagtgctattaaaactagcaggaagcagttcttttagaaattctatagagtagggtatgaagcagggaagagagagggaggaagagaaaatttaaataagttctcttccctcaagccccctccctcttcactcaagcccccaacttgccattttagaggttgtcagcaagagagacagacccaataacctgtccagggttcctgtgagaaagatacacctagttcatacactgacgaaaaacctgctacatacattgcaccacagcaactgaagctaaatgatcaaggaattaaaatcaaggccagctgcttctaggtgttgccttttacttcatcccagtttattattaaaaaacctgaacaccttttccttccagattctacatactaaaaatataccagaaccttttcctctacctcccaaaaccttgtaaaaaccaagaaaccaatcagcattaaaaacaaacagaagaacagagtcaaattttgccatgattaaaaacagacatgccaccactccatatagtaggaggtggtttttctttcttttggttgtgtttgttgtttcttcagtaacagcaaattctaaattatccttttttgtttgtttttgtttgttttttgagatggagtttcactcttgttgcccaggctggagtgtaatggcgcagtctctgctcactgcaatctctgcctcccgggttcaagtgattctcctgcctcagcctccgtagatgggattacaggtgcccgccaccatgcctggctaatttttgtatttttagtagagatgagttttcaccatgttggccaggctcgtctcgaactcctgacctcaggtgatccacacacctcggcctcccaagtgctgggattacaggggtgagccaccacgcccagccttaaattatccttgttaaaagggaagttctttagactccctaaaagaagaaattaccatctaatcatcgattaatcagattcattaacatttttacttgaattacattaagctataaccacacatattgaaaataaacattgttaatgatatctcttaacagcagagcaagaagctgcaggaataaactaaattcagttctttcccaaacatagtctgcctcctggtggccgtgcagcacaagtgcaccaaagcaagggagctgccttggcagtccataaacaaatggccatcgcttacaatctactgctccaagcactctcttacacactttacgtttgctcatttaaataactggataagcaattactttcaggtcacaactatttttatactatatatgcctctggggggagccaagataaaaaattggttccaaaaaattctttgattatttgatcatctgttaccagttaggaactccatattttctgaaattgaacgaatgtgagaagtacctaaaaaaagcatctttgttatttttaaaagtcttaatttaagaggaaaagataggcatcaccaaggacagtagaggaaaaaataaggaaattttagtgcctaaagtacaacagtttgtagttgtaaaagttagctatgagtctttatgggccgggcgcggtggtgagattacatgcctgtaatctcagcactttgggaggccaaggcaggtgggatcacctgaggtcagaagttcaagaccagcctggccaacatggtgaaaccccgtctctactaaaaacacaaaaaattagctgggcatggtgacaggggcctgtaatcccagctactcaggaagctgaggcaggagaaccgcttgaatctgggagatggaggttgcaatcagcagagattgtgccattgcactccagcctgggcaataagagcaaaactcctcaaaaaaaaaaaaaagatgagtctttatgaagcagagcctgtgttaggatgtcagtggaaaacaaaaacatgatttaaaattttatgcaatgtaggatctcaacattaaacaaaaacgattaagtatattggagcaaacatgccagaatgtcaccaatgctctgggaggtagaagagggaggatttctattttttctttattatatgtttttgtattttcctaattttttttttcaaaaatcatgcagccagaaaaaaattaaaaagtttaagtgttagaataattttatagaaagcctacaaaatgagccgagttttcataatgacacaaagaaaaataaacgatgtgtaaagtctatactaaggcttaaataacaaaagaggatgatacagaatgtttcataagtcagtatgttgtaatatcacagtatattcaaacaaacagaaattccactggtctgcatagaaatgtgtttttttaaatcagtgatttagaaaacaatgatgtcatgattctagacaagaatctagcataatctgtatggggtgcttagatgctacaaaatgccttcaatttatctgttattgtttgttgttgttaatgatcataaagaatgaggaagaagattaaaatttaaaccaagtgacttgtgtggagattcaagcatctctatccaaccaatcttccttagcctaatatggaatattaatctttatatttatctccttactttccctaacacagcattaattgcaacattttcttcattttactcctcacagtctttaatgtagtaagttcaattctctattccagttgtagaaacttcaacttaaggcccaatttttccacactatcctcttcctcagtacgaagataaattgtaattatcaaaaaattaacacaaagcaattagaaaaacaatcaacttccacccacctgtaagatgataagctctcaaagaacagtgacattgccttttattttgcaataagcaaaataagagtttaaattaaaagcagtaatgcttttaattcatgtacaatgtttgtttttaaaaaacaaaacctcatatgttcatcgtagaattttttttttgagacggaacctcggtctgtcgccaaggctggagtgcagtggcgtgatctcggctcactgcaagctccacctctcgggttcaagtgattctcctgcctcagcctcctgagtagctgggactacaggcgcccgccaccacgcctgactaattttttttgtatttttagtagagacagggtttcaccgtgttagccaggatggtctcaatctcctgaccttgtgatccacctgctttggcctcccaaagtgctgggattacaagcgtgagccaccgcacccggccagaattttcttttcaatttaaattacttacacatcagactgctctccaatttgtttttaaacttaacataagcttaataaacttattaaacttaaaaatttcacacttatctttccatgggattaaataagcatttatattgttattttaatggcttcaaaaatgtctttaaaatgtcaacgaacttaattcctgtaaggtatataggttgtttccaattttcccccattgtaaacaattctgaaaagcagtcaataagtaaataaattactttcctaggaccaattctgaaaaacagaattcccgggtggaaggtgtttgctctctgctacagctgctgtaatttaccaaggagctgtacatatgagtgctgtttcttattcttcgccagtaccaggtgctaacattaagaaataagcaagaactgagagcacattattttaactcatatttggtaaacatttttcatatattccttagtccttcatatatttcttttctgtccatccacttatttttccctttctttttgtttagtttttttaattgtggcaagaacacttaatgagatctaccttctcaacaaaattttaaaagaacaatataatattgttaactgtaggcacaatgctgtaacaaacatctcgaaaaccttttcgcccttgcataacaaaccttgtaccattgaacatcaagttcccattccctggcaaccaccactctactctgtttctgactttgactatgttagatgcctcctataagtggaatcatacagtatttgccccatgactggtttatttcacttagcatagtgtcctccagctttatctgtatcacagcatatggcaggactttcttctttttaaaggctgcataatactccagtgcacatatatgccatatttgctttatcctatggacacatttaggttgttcccacatcctggctatcataatgtggcaatgaccattgttgcagggagtcagggaccccgaatggagggaccggctggagccacggcagaggaaacataaattgtgacgatttcatggacatttatcacttctctaaaaatactcttataatttcttacgcctgtcctactttaatctcttaatcctgttatctttgtaagctgaggatgtacgtcacctcaggaccctgtgatgattgcattaactgaacaatctgattgcaaaatgtttatttgaacaatatgaaatcagtgcaccttgaaaatgaacacaataacagtgattttagggaacaagggaagacaaccataaggtctgactgcctgcgcggtcgggcagaatacagccatatttttcttcttgcagagagcctataaatggacgtgcgagtaggagagatatcgttaaattcttttcctagcaaggaatataatattaagaccctaggaaaagaattgcattcctgggggtaggtctataaacggccgctctgggagtgtctgtcctatgcggtggagatagcttggccgggtgcggtggctcacgcctgtgatcgcagcactttgggaggctgtggcgggcagatcacgaggtcaggagatcgagaccatcctggttaacatggtgaaaccccgtctctactagaaatgtaaaaactttgcctagcgtggtggtgcgcacctgtagtcccagttagtagtcccaggcaggagaatggcgtgaacctgggaggcagagcttgcagtgagccgagatcgcgccactgcaccgcagcctgggtgacagagccagactctgtctcaaaaaaaaaaaaaaaaggactgagagagatacgccctggtctcctagtctcctgcagtaccctcaggcttactaggattgggaaacaccaaccctggtaaatttgaggtcagaccggttctctgctctcaaatcctgttttctgtaaagatatttatcaagacaatacgtgcactgctgaacatagacccttatcaggagtttctgattttgctctggtcctgtttcctcagaagcatgtaatctttgctctgcctttttccctttgaggcatgtgatctttgtgacgtactccctgttcatacaccctctccccttttcaaatccctaataaaatcttgctggtttcgcggcttaggtggacatcacggacctaccaatatgatgtcacccctggaggcccagctgtaaaattcctctctttgtactctttctctttatttctcagaccggccaacacttacaggaaacaaaaataacctacattgaaatattgggggcgacagaccatgggaatgcaagtatctcttcaacatcctgatttcaattattttggtaaataacgccttatcagacgtatggtttgcaaatgttttctcctatctcataggctgccttttcatgctattaaatgactgctttgctctgcagatttttaatctgatgtactccaacctgtctatttttgcttttgttacctgggcttttggtgtcataccaagaaaaatgacatgaagttttgccccatgttttgtttgaggtgttttatagtttcagatcttatatttaagtctttaatccatctcgagttgatttttgtgtactgtgtgagataagggtccaatttcattattttgcttgtggatgtccagttttcccagtactatctacaaaaagactatcctttccctattgtgtattcttggcacacttgctgaagattagctaaccgtatatgcacggatttatttctagactattttattccatcggtctatgtttctatatttgtgccagtaccatactcttttaattactgtgtgttgtaatatactttaaaatcaggaactgtgatgcctccagctttgttctttgtcaagattgttttggctatttgcagtcctctgtcattctatatgacttttgggattgttttttctatttctttaaaaaaatgacactgggattttgatagggattgcactgaatctgtagatctctttgggtggtatgtccatttagcttctattatagagttgtctttatcttgctgatttgacagagctctacacagagtatgtgctaatataacctcagtttgttctttgcttataaatactgtttctaatgatttttattctttttattttttttgagacggagtcttgctctgtcacccaggctggagtgcggtggtgcaatctcagctcactgcaacctctgcctcctgggttcaacgattcttctgcctcagcctcatgagtgctgggactacaagtgtgcacaaccacgtgcagctaatttttttgtatttttggtagagatggggtctcagtacgttgcccaagctggtcttgaactcctggcctcaagcaatccacctgtcttggccccccaaagtgttgggattacaggcgtgagccaccatgcacagcctgtttctaaggttttttaaagcttttgttgtcctaattattaatcgtttctattatactagtgttcctggaaagatcttttctacttaagtctatattcttagtgttttaattactttgtgtgtttaaaactaatttatctgaaatactttgtatatatgtgaaaaagatctagctcctgctaaaaaggtagtcactgtctcaagaagatttactaaatgatccactcctcacaacccccaacaccaatttgaaacaaaaatgtatcccatatgaaaagagcatctgtgttttaagtatagggggaaagttatgttaatcataaaacaacagtgaaaaaacagccttctctctactctcaccagaagaaaccctggcagcctcggcatcacctcatcagcaggtttgcaacttgcaaccacttcccagcacttggcaaaagaaggcaagaaagccgccctgttctcctgtgatgtctttactaagtaactgcggaaggaccagtgcattttctaccttccaaggcagacactctggcacctgagagtgatgatcttgtgtaaaccaatcagggtactggataaatacagctctgatgcctctggtatgccagtggctttagtgtatggtagaaccaaggtaataatagtattctgtggtatgtgtgacatcttccttatcagcagtaagccaagattttttttagagtcaatatcaactacaatcttgcagcgtcataacgtttaaataaattacaacagttagaccccaagaggttggttcttgactttaagcagtctttcctgcttgctttagagatttaaaataattcaacttcctggaaaagaaccctaaaaataagcccctagaattataaaaacaatgtaaaagatcgccatcattaccgttcctagcagctgacttaactattatttgagaaccttttataaaacaattctatgatgtcatattattgcctttctgggaattatttccccaatattcccatgtctccaaacgagaaatttgagacttggagaggcttagcaactagcccaaggtcaggacacaaatagaaagcagcaggacgaaggtttaaaccaacatcccgtgccttaaaagttcgttctcctcctgcttttctacattgtcttatgagataatgtaatttctttaattgataaaggtcaagctaaaacaatgatgtaacattttaaactattatgttagtcaaaaaaatttaaaaataatatccaatgttgacccaaggtatgatgaagccaggtgtcttttatgtcaaccacggtataaaatgatatgaagcttttggaaaacaatttggctatttgagtgaagtgactgtaaatgggtacatattgtgatttcctgatactacttttaataatctatcacaagaaattgaaagttgaaagtgctaattgtatagatgttcatcatagaatcatttatgaatgtgatacagaagcaccctaaatattcaaaagtagttaaatgttactgtatctgctaaatgtaaaagtgattactatatgttaaatgacaaagcaggatatacacttatctaaatttcatttaaaacgacaaattttaaaaagctgaagggtgatttctaaactacatgctaaactttttgaagtttggcaaactgctataattaaaagtgattattttactagaactaaggaatatgaagttggtcaactcaactgtaatctccaccactacttacagctttaaaataaaaatatctcaaagccatagtacaacgattaaaaatttacactcagaggaacatgtttatgtgtggaggcaatgtcttctgtatcagctaaaatatgactcatttccagcagaatatgaaaaaagtcaaggtgattttcagtcacagaatatcacagtagggagaaatctagaaatccaccctttcagttacatagaaaactattatcaaagaggttcaatgatccacccaaagtcactggcttttcagcatcatttttcagcatcaaagtcgtctttccaaagcaaacacactttgttgtggtcctctgtccacacagtaacttttcctcactaggctcctcataataccaggttagtcttaagtcatgataataactaaccatcgagaagaacctgggaaagtcatgcttatggtttcgggaaaatacagaggcctaccacacaatctagattaagctgcaatgttgaccccttagaatacattctatatatacagagtcatctatagattcaatgtaacagaaattattagaattggaattattagattacattcctaaaacctcacctgacttcattacagagattgacaagctgatcctaaaattcatacagaaaatcaagggacccagaatagccataactatcttgaaaaagaaagacgttgaatgactcacatcctgatttcaaaacttactaatcaagacagtgtagcactggcaaaggtaacatataaatgcaaagaacacaatttagaaatcagaaataaaccctcacattcttaaccaattatttttaacaaaggtgccaaggcatttaaatgggggaaatacatgtcttcaacacctggatgtccatgtgcaaaaaagaattagaccttctatctcataccatataaaaatgtaactcaaaatgaatcagaaacctaactataacagctagaatagcaaaaaaaacttaaatgaaaacacaggcttaaatcttcacaaccttggattaggcaactgtttctgagatacaataccaaaagcagaagcaacaaaagaaaaaaagttgataaagtggaccttgtcaaaatttaaaacgtttatgtttccaaggacattatcaagaaagtgaaaacacacccaagaattgggagaaaatatttgcaaatgataactctgacaagggtctaatatcagactatacaagaactcctacaattcaacaataaaaatgacccagtttaaaactggcaaatgatttgaatagacacttctccaaagaagatatacaaatggccagtaagcacacgaaatgacactcaatgtcactggctgtcagaatgcaaattgaaacaacaatgaggtatcacttcatacccagtagggatagctataataaaaaagacagacaaagccaagtgttgacaaggctgtggagaaacaggattcttcatacactcctggtgaggatataaagtggtccagccactttggaaaacagcctggaggtttcttaaactgttaaacacagagctaccaattgagccagttttctgataatggttaactaatttttaaacaaagccattccatagaatattagctatcttttttccccagatattaggatgtaccagaaacttaaaaggaaataaaagcctaaatgtgtacagcagagtttcttctgcatttttaccctataaaggctttagtaaccacatatattcacactcagcatcctggggatctttagaacttagatcattctgcatggctgtcttcctagctttaagagcctacaaaaggttacgaattctgagatagctgggcgcagtgactcacgcctgtaatcccagcactttcggaggccgaggcgggcggatcacgaggtcagaagatcgagaccatcctggctaacacggtgaaaccccatctctagtaaaaatacaaaaaattagccgggcatggtggcaggcgtctgtagtcccagctacgcgggaggctaaggcaggagaacggcgtgaaccagggaggcagagcttgcagtgagcagacatcgcgccactgcactccagcctgggcgacagagcaagactctgcctcaaaaaaaaaaaaagaaaaagaattctgagataatttccccacacttccctgcttattacactgaggaaactgaatacacctgatggggcatcaaggatatttgttattcatgttattcatgatgtaatgttatcccaccctgttttctttacacaacaggctcagaaatttatacctcttgcccaggtttccctcacatgacagccttcaatccggacctctcttctaggacaagacaaccctccttcctagaactcagtgcatttgtgattcatgtctatttgagcaggttttttattttatttttttaactatcctattagctctccagagacaaggcccctgctcattcttcgctcaggactgcatccttaacacctgacactcacaatgtgtgaacaaactgtagtcaacattctgtaacattacatgcatacctgggagatatatatcaccccataagacacatgacataataaggcaaatcacaaaaattgtctggtttctcagtgcatataaaacttatattaacactacactatagtctagtgtgcaacagcattatgtctaaaaaaatatataccttaatttgccaggcgtggtggctcacacctgtaatcccatcagtttgggaggccgaggcaggtggatcatgaagtcaggagatggagaccatctggctaacacggtgaaaccccgtctctactaaaaatacaaaaaattagccgggcatggtggcgagcacctgtagtcccagctactcgggaggctgaggcaggagaatggcgtgaacccgggaggcagagcttgcagcgagcagagatcatgccactgcactccagcctgggcgacagagcaagactctgtctcaaaaaaaaaaaacaccttaatttaaaaatatttcattgctaaaaaatgctaaagatcatctgagccttcagtgagcaggaattattttgctggtggaacatcttgcctcaatgttggtggctgctgactgactgattagggtagtggttgctgaaggtttgggtggctgtggcaatttaaagtaagacagcaatgaagtttgcgacatcaattgactctttcatgaaagatttctttgtagcacgtgatgctgtttcatagcattttacccacagcagagagtctttcaaaattggagtcaatcctctcaaaccctgccactgctttaagtttatggaatattcggactcctttgtcatttcaacagtgttcacatcatctttaccaggagtagattccatctcaagaagatactttatttgcttattcataagaagcaactcctcatctgctcaaattttaccagagatcaacagcaatgcagtcacaccttaggcttcacttctcattctagttctcatcctatttctaccacatctgcagtgacttcctccactgaagcactgaacccctcaaagtcatccatgacggttaggtcagcttcttccaaactcctattcacgttggtgctctgacctcctcccatgaatcacgaatgttcttaatggcatctagaagagcaaacccttttcagaaggttttcaactgactttgccccgttccatcagaggaatcagtatctagggcagctacagtcttacacaatgtacttcttaaatagtaagacctgaaagtcaaaattactccttgatccatgggctgcaaagtggctgctatgttagcaggtgtgaaaacatccatcttcctgtactatactcttgtactatatattactatgtaatacactatactatactccatcagagttcttgggtgaccaggtgcactgtcagtcggcagtagtattttgaaagacatctcttgagttgtaggtcttaacaatgggcttaatattcagcaaaccatactgtaaacaaatacgctgtcatccaggctttgttgtttcatttatagagcacaggcagagtagatttaacgtaattcttaagggccctagaattttcagaatggtaagtgaacgtcagcttcaacttaaaattaccagaagtattagcttctaataagacagcttgtcatctgaagccaggcactgacttctcctgtttacctgtgcaagtcctaaacagcatcttctttcaatatgaggctgtttcacctacactgaatgtctgttgttttgtgtagccacctttatcaaatgatcccagctagatcttctggatgactcgctgtagcttctacatcagcacttgctgcttcgccctgtactttcatgttatgaagagttaccttaaacctcatgaaccaacctctgctagcttccagcttttttttttctgcagctccctcacctctctcagccttcatacaattaaagagagttagggtctcactctggattaggctttggccgaagtgaaagttgcagctggcttaatcttctggtcagaccactcagactttctctctgccgggagtctgttttgctttcttatttgagtgttcactagaggagcacttttaattttcttcaagaacttttcctttccatttacaacttggctaactgcttggcacaagagacctggcttctgaattatcctggctttcaatgtgccctcctcattaaactcaatcatttctatcttttgatttaaagtgagagacatgcaacttttctttcacttgaatattcagaggtcattatagggctattaattggttactttcaatattattgtgtctcagggaataaggaagaccaagaaaagggagagagatggaagagggaccagtcagtggagcacttgaaatgcaaacgtatcagctgtgttcactgtcttagatgagcatggtccatggtgtcccaaaacaatcacaacagtaacatggaagatcactgatcgcagatcaccgtaaaagatataataataatgaaaaagcttgaaatagtgtgagaattaccaaaatgtaacacacagacatgaagtgagcaactgctgttggaaaaatgatgctggtagagttgcaaaaagcacagtatttgcaaggctccagaaaatgagcgatgcttgtaccttcgtttcttctgatttgctcttctaatctgccatggatttagaaggcacataactgttttatcactgtatataaaataagacaatgtaggcagtgtacaggagaccttatctatctagagagatcaatccatctatctttttttttttgagacagggtctcactgtgtcacccaggctggagtgcagtggtgtaatctacgctcaatgccacctctgcctcccaggttcaagcaattatcctgcctcagcctcctgagtggctgggactccaggagcgtaccaccacgtccggcaaacttttttgtatttttagtagagatggggtttcaccatgttggccaggctggtcttgaactcctgacctcaagtgatccacccaccttggcctcccaaagtgctgggattacaggtgtgagccactgggcccagcctatctgtcggtctgtctgtctgtccatccatccatccatccaaagtataggaatcgcagtgaagatattttgtgaaatcttttatgggttcttgagagacataaagttttggattctcagctgtggttcaaatagtggaggctgcaggctatcttgggaatgttaagtccagtgaaagtgtgaaaaaaaaaacataaaaatataggctgctgaactgggaaaaggtgctaaaaccaaatattgagaccacttaaaaattaaggaatatccaatttcaaaatagcattgatcttgggggaagtacattttccatttcatttagaccacattaacaaaatcattttttaaaagactataactatctattagtaatacaatgtcctttcatgcattagatggccagtcatgcttaccgtattttaatgctatgcgacccgtcataaaaagttaggtttacacctcaaattggaaattctacttataagcacaccagtaaaaaatcactgtaaatacttgtagtaacataactttacaaaaagattctttttatcgccatccataaagtggtcactcacctgcattaagagctgtaaataaattttttctcgaaggacctaagatataaaagaaacatgtaaaatacatatgttttatttgacatatcacataaaaacaaaccatgttgataagaattattttcaaaaacaatcaatcgctacatttcaggttcccggtgggaaatatcaccgagattcaaccaacttttgtcaagtgcattttaaatataaggtgatatttcacataacatcaaaatgtttaagtatgatatgaagtcaccacaaattaaataggaccagttttaaaaggaaaagccgcagtattttttcagtcaagaacagctgaagttcaagttttaacagtactgaattcacagactgtgcacatatgccattctgctgccgggagagcagaggccagacttcacgaaggacagtcactcccgtgtgctttccgaaactacccgtttctattcagctatgaagaaaaatagaagtttttcctccaaactgataaaatataaaatcaggaggggtaataggtacacagctgtaagtcactaaaagaaatctatgatgcttctacttaacatgaaatagttgtttctaggacataatcatctgcagataccagttagaacagctaccatgttctatctgaaattttacagagatgatgatctcttaaaatacgtggctgttatcaatggaaagcactgattcccacacaggtaaaactgttgcgacataacctatccattcaatagtgaggcattttagaattctgagtctcctgttctacaaagctgtccatggaatctcattctctgcaagttattttagtatcaaagttcaacagcgttaacttcattattgctgtgtggatcatggggctttatcatcatcaataaaaaaccacagttttccaacctgatgtcaactcagcaagaggtcatttggtgcctccgaaatttgattaactccctaggcaaatgacaacctgctgcacactgaagaattcaacccactcctaaaattcatgcctattttctcttcaattcagtacaaagaaaaggtattgacatacattaaccagcctcaaggtaccatattatcctttaaacacacacacagagagagagagagacatgttaaggaggatgctgtgacagagtaacacctctgagaaagttactaatagatattaacaatccaaagagtttcatgcaggttaacccagtaattcctccttctgggatatccacaagtaaccagaatctgaaacaatgaatcttgactcacatttgaagaggttcatctcagtattaataaaccccaataaaagtcagaagttgcccactataaactgaagtggacaaccatagaatagccatttaaagtgaagaagctctcctgatacactactaacttaataaaaagcaagatacagaagagtatattcattattacctcagttttgctggaataaaaacaaaacaacatatacatacagaggaaaaaagtcacaaggaaatgtgacagcaattgctggttgacagaattaaggaagactctttgtttctgtgttttccaaattctctaacataaatgtgggtctcattttataggtcaagtttctcactcacaattattcgctcaggctttagttaagcttcagttcactaagcacaaataatgctttttttttttttttttttttttttttttgagacagagtctcactctgtcacccaggcgggagtgcagtggcgcgatctcggctcactgcaacctctgcctcctgggttcaagcaattctcatgcctcagcctcatgagtagctgggactacaggtacacacgaccatgcccagctaatttttgtatttttagtagagatggggttttgccatgtcggccaggctggtctcaaactcctgacctcaagcaatccacctgtcttggcctcccaaagtgctgggattacaggcgtgagccaccgcatgtggcacaaagaaggcttctgatgtgctttggccccactgagacaaagctgcatgaaaacattgcacattaagtgtataccacatattttgtaaacctgaaaattacttttcataatcacagcaaataaaaagtgagggatatgagaaggaacagagataaagaacatttagaggaagaacaatgtcttagaccaaagacatgaagacacaagtacagtaataaacataaaacatctaccctgatgaaaagtaatcatgcatttctactcctttctcactattctagagcactgttttagaataatttaactcctgaagttttgctgtttctaccttatacctttgttctgcctgctgacttacacgtaatgatttttaactatagaacctaccaactgtcagaaaaacaatttcctcagtgcaaaaatgtattatatctcctttctcaacatatttgtaatcattgttgactataccataaacctaattgtcaaaatttaactttctacaagccaaggactttaagcgtcttgccctccctcttcaaaccacaatgaggactgtaccttttggaggagttttcatcaagtgaacatgagccctggataccaaaggcttcaaataaaaggatcctgaggaaccattctgaaatgctggttttggaggtttctcctcatatttgatgacagcggcattaccagctgtaataaaacagaaaagtacattttattgtatagataaacacagtttcgaccttccacatttattcctttgtccttgaaccaacaaatgctcaataagcacctacgacatgccagtcattactgaacattgggaatacaacatggataacaggtagcttgtgtctcagggatgcgaaataaaggctataatcagagtgaccacacatcctggttagcctggcacagtccaagcttatgcatcttgtccagttcagctttcatcccagataagagttggggaagaaataatacagccacttcatgctatgtaacaagaatgccccaggtgcagctaggaagagcacccatctccatggggacaaggaagaattcgcacagtcagctagttaatgacacaagaacagtaacatacagactccttggtagctataaggacacgctctggttcaaatccttgctcctacagcaaggagttaaaatgctaacttctgccctgaacaaaggaagtttgttccaaagtaaactttatgttttagctccaaagcaaaaacataaaagggaatcttacctcaataacaaaaaccatctttttatattatgtgtaaaaatttcccctccaccaatccagactggattttctactgtttgtttgtttgtttgtttgttttgagacggagtctcactctgtcgtccaggctggagtgcagtggcatgatctcggctcgctgcaagctccgcctcccgggttcacgccattctcctgcctcagcctcttgagtagctgggactacaggcgcccgcggccacacccggctcattttttctatttttagtggagacggggtttcactgtgttaggcaggatggtctcgatctcctgacctcgtgatctgcccgcctcagcctcccaaagtgctgggattacaggcgtgagccaccgcacctagcctgtttgtttccaaataatgatcaatatccaattctaggcacccaattctattctactattcaacgcttataaatttctttattaccaactatgatcccttttctcacttcactcacttagcaaagggttaagatacctaccttgtttacaaatgcattataaatgtgaagacagctagaaatttttcactaggctaacctattccaactgctacaatagtgcttatacacatcacattcaaactttgtacaggcgtgctattattttcccctaatccacacccaggccctgtacaatgagccatctgttcattgttctcgtgcccaaataacattcctaatattaggtcaaatcaacacagagctttccctcctgctgagaaaattctgtcaatttcctgtccttttttccaattctcaccttccctagaacctagagacttggcttttccaaagttgacaggaagctaatgggagtgacagtattaaagacaccgccattacaacattcaacagaaccctttttagatgttcatagaaaatggatattgggtttcaattagcattttagcttttgctgaatcaaatccaacaaagaaaattagacagtcttaaccatggaattataacaatctggattttagtcttacttttcttgaagccgtatttgattatattcagcaacaaataagtcacttattcatattttaaaaaattaaactgagttcaatttacagacctaatatgcaattgtatgattctaaattcatgcttttcttttctaaaatttagagacacaaaggcccacggttcacaaagagatcagtaaaaagattttcactaaagtaaaggacaggttcttcatgagggatggtactcctgtgtcccttgcctctctgtcacatgcaaaataggaggtggtgtgctggaaatcagctgtctcactgccacttttcagactcaatacaacactagatcaacccggcaccacacccatcatcagcttcataacacgcaacatgaagtcagaattcatactgcaaggataaaatgtctgcgtttgactcaggtacaaacacacatgcatttatattttatacatatttacatgaaagctatatatacaagatacatattcatatactctatgatcaacgattgtacctgctttctgctttactaatggcaggcacaacctgtactgagctgaacataattttatgactaacaatatctttctctcaatttctacttactgtactctaggctggcccactgctttccagtaaaccccaacttgaaggatgtataccaccatgagtcataatgctcttcaaatatttcccctgccctctatttctgttcctaacatggcaactgactgagtatcctgatgctatctaaattttccctcagccagagtcattatatccaaacaataaagtcctcagcggcaacaattccaatataagagatgcataatagtttccagcaatggaacaggatgtaaaatatcctagttctggtgctgacttgaccactgcctagctgtgctgaatcacctatctatgaataacaagggtctgaatatcgggtatgggaatagacagtgcattcgcccatatcgggtatgggaatagacagtgcatttgccttcacaactcactgtggtattcagtcccactgaggctggatgcatcctcagaatcatcctaaagacagtgttctagagagccatggacactaaacactgctggcttgaagagacaatacataaaatttttcatgtggccacctacttctcaacctgatctaatatgtagtttaaaactgcccctttgtcatctttggtcccaactgtctcaattatgccagaataacagattctctggaatctttatcttcatttccccatggccaaagtgtggttcaagtgaaataaaggagctggtgagtctaaaaggaaaaactaagggatattctcaggaaagcccaagcagaagacatgattttcctattagaaaagggcttctcatgctgggcacagtggctcacaactgtaatcacagaactttgggaagacaaggtgggcagatcacttgaggccaggagtttgagaccagcctggccaatatggcaaaaccctgtctctactgaaaatacaaatattagctggacgtggtggtaggcacctgtaatcccagctactcaggaggctgaggtgggagaactgcttgaacccaggaggcggaggttgcagtgagccgagatcgtgccactgcactccagcctgggcaacagagtgagactctgtctcaaaaaaaaagaaaagggcttctcattgtttcagacttttatctgcaaactaacattcatactacattctaacacctagtgaaaattcgcttttattacattatgtatatacacacagagccaacattctgttcatttcttgaattttatgtgaatcagtttaacactccccactgtgccagatcatctgcccacttggcttaaaatcaaagtactactgaaatctaaacttttgaatttcaaaagcaatatcactcaactatataataacaagaatgtctcacatataccctagaaaaacgtgaacagagaaagaacgagaacaaagttaacagtggtctggataatatttcctttttaaatagtccattcagaagtgcgtaagtactaacatgttttgtgatgtggagcctaatgaatctaccgcctgttcctcatcttagcctcacccatgacagacatcacgacttgaacacaaaactttccctctgaacctggaggcaccctgagaaaccactgacaccatcctacaggcgaattcttatccactaaccagtgttggccactaaccagtgttggcaggtgagacaatattcacttcccattcctgttgtgagagaagaaaaaaaacaaaaaacaaaaaactaagggtaaataagatccaccctattctttatcagcttaatcacttgaacaactcaaaacaccatcctgccaaacaatgaggccctgtcttattgcagtgaaaagggtcagaaatgtttgttgctgcaaggactttgaagatgacccagtcctcccttgtcattgatcagaggagagtatggaggctggaggctaagaaaagacaaagatagtccaacttaacatgagttagtaggaaaactacggtgggaccgggcgtggtggctcatgcctgtaatcccagcactctgggaggcagacgcaggcatatcacttgtggttaggagttcgagaccatcctggccaacatggtgaaaccccatctctactaaaaatacaaaaattagccgggcatgatggggcatgcctataatcccagctacttgggaggttcagacaggagaattgcttgaacccgggaggcagaggttgcagtgagctgagatcatgccactgcactccagcctgggcgacaagagcgaaactccatctaaaaaaaaaaaaaacaaaaaacaaaaaacaaactaaggtgggtccaaggttagtgcccttttctgcatgttacaccccactcagccagggctgtcagtgaaggtgaagggaaagaacactccatttcttttattcagtctccttctgttccttccatttccaggagaatgcaaatagctttggtctgcacctcttacatttcccctaccatctggctctcaaatataaacatggttttgtggccaaagtggaagaggaagtaatgtctttggaccttactttcctgctaacatcgcaaagttatacactctcccaagacccccttctaaattgcacaatagtccccaaatcttcaactctgttcatgacatacaatatatcatttatttttacccagttactttaatgatcttaaaaactggatattaggtatctgagtgtgaaagaccttataatctttaacctctataaatgagcacatttggtatagaaaccattgtgaaatgttttacactaatatccaaaaggatcaagatcgtaactttgaaattttctacacttaaaagaacacacacaaagaacctgctaaaattcccaaataagaacaatttattgccttacgtattttgatttggtcatttaaaaaatttagtaacattatttctataggatcccaaagttccgagaacccagtgctaattttacaacagcactgtgttatatcagaagttcttaaatgatgccactaaagatatcacatcacaaagaaacaagcagacaaagcgagaaaccaatatttgttaaagggattcaaatacttaagccagtataaatcagaacactgatcaaaagaggaagttaattcttaacatgaccacccattatcagaaacaggaaattttcagcgcgagatgattttttcatgttttgaggtagcctttaaaagtatacatgtttaatactttcagttacaacttaggaaaataaagatgtgatgtttccattttaattttagaaaagtatttttctacacttgcacaactaccagctacatacacacaaaaactagttatttcataagaaattaaaccatcaaaaagtctttgataataggataatttcatgtgccagaacattaacgatgctgctgaattatattaagagtgcaaaacacataaaagagacaacaaaattggtcctacacagaagcattcacatcttaaatatacatacaaaatgcccccaaatactaccattaccataaattacaagttacaaaaacagaagtcaagagatcctaaatcaatttattgaataaaaatttaagcatgcttacaaagaaaagaaaccagaaatcgtcgacctactttttttcccagtaaacgtggctaacaaaggaattatacaaaggctgtacgatcccacgaccagcagtgtcaataaggtagcatcatagtgcctctctgaaccagccggtggggtgagtgtagaattgataaagatttttgaagaaatatcagtttctgtacaactgcgaaatcctcctggtacagtcatttaaaaggatcaaagcaagcttaagcaggaaaaactgcagccatgttcactctcatatccctcatgcttgctcttagtgaattcgaatggagggaaaaaaaaaaaaatgcgtaagctccaaggcactacacaaaacagattaaaccagctagcaaatcaaactaagaaagagactcactgatttgaatgcttaatccgcaacaggaacacatcgccactagacaggctctgtgggtgtatggtaaacccctttgttaaaagacaaaaaggaatggacaaaagcactttacagcctccttaggagcatcagacacagtactgaaacggtggccaagtcaacatggatgtcgatggaaaacacggggctgtggcactacagactgtgtctgcttcaagtgccacaaattctgttgccacaacagtttttctagagcatgttggtgattctgttttggcagtttgtctttaaaattgctttgcaagacaaagagagcttaaaataatacacgtgtgaattaccttttcaaattcagagttccctcttacatgcaagcctgattttgtgccacaccttcaaaattccaacagtaaagctggtaacaatcctgtttaattgcaagtcacatatcccagtattcctgaagtgccagggtatgcagctacttactctcata

SEQ ID NO: 1626 - DNA, 53944 bp, Homo sapiens
tgcaattcttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaacaacacaagatttaccatgcctaggggatgaatggcaaacccaactttggctaatgtcattgagaacaacttggaagcgtgagcagagatatctcatgaagtggcagtgaacctacatttccatttatcagaagcaaacatggaaggttacatacatgatgaagtattggaagttaaagacttaagacacaaaatcactaatttaaaagaacatgcaacatgagtatcaacttgctatgtagtgtacatgtaaatgacccaaatattcacctctagcatcctgaatctcttcttactacagctgttatttgtacagccactgaatgtagattagtaaatactgacatcacaatgttgacacatgcagggagggggagataaagcaacagttcttccttccaccttttccaaagtctcaggattaggggaggtaataagttttggaaagaaactgaaatgcaacctggaggagagttggacaagccacattttccactcatgggaaagaagcggaccattctgctactttcccaaagacaaagggactccttaaagggtaactgaaaaatgagcgctatcctcccagactgttttcttctatcaagtactgcatcatcggtaagcactgaatcctacctttcttaattatactagccaatgacttccttgttctcgttctttattctaagatttcccaaaatttgtaatatcaaatccaggctttagtttatttggaaagtggtttcagcacctggaagatgagctggctctggggctctggaaaatcatattcctttatccttgtcccagagaaaagtaggtaggaggtagaaggtttgcttttgtggctctggatggtggagaaaggtaaaaggaaaatgagaataatgggagggaagaagacaggttaaatctgcaagggtagatcaaaggtaaaaataaggtggaaaaacccattggtacttccctttttctttctttacacagttagttagttagtttgtttttttatagaaaaattagggttctacatttacacatagcctgagaaaatgaattacaggatagtgttaggctcacatgggtaagtaaaaaatctacagaaaaatctagtttcaactgacatggctgaacactgaaaaactgccaagaagttacccccaaaagatacagagaatgtatagacagggacaagtcaaagctcttcctgttataccctctccctaccctgttacagggctgagcagagttggtggtagatgatcataattcaagcaactattgctttttcttctatggctttggctgaaatgtatatgctgattgattgattattatttgattagtacatatccagatatattcagattttgacatttaatacacagcagaggaggctgcatcagacacatgacactctgtgacatccatttcattcacaccccccacccccacagtcagactgaaaactcacaagaaggtgtctgtggtgaagaacattacaaaggttataaatcttaatagggccctgagagtttttccccctatgcttaggtgaaaaaggcaatgaacaagatgctctcgttctttaagtgctttgtgcaacaacgtccgtgtcgatgccgaaatctttttttaaatctttttttggaggaatcttttggacggaggcaaaagtcttcctccagagttccagtctcagaagctgcgattccgccggtggtgacgctccagttaccctacggtgatcacacgtgtgctgatatacctcttgtgcccacgttcctccttggggtcagtcctgcagacctgcatcaaaatgctttcagagagtctgtggactttggggaggtgtcatctgggtgaaatgctggggctagggaaggagcccgaattccttggtgactgcaaagggatggcggaggatgtgggggatctcttggggctacacaggtccccattgtgcagtttccacagaagctcctcgttttccatagagagtcgcttgttgactttcgactccttctccagcgactcttgcagaacagcctgctccgtggaaagctgccttgaagaaaaaggccagaaaccatgagatctatgtaaaaaaaaaaaaaacttgaaaaatttttcttagcgtttgaaactttaaagtccaaaattattcctttgggataaaacagaatcctgcacaaggtcacaggtatttggctggctaagaaaacccaaacacaggccgggcgtggtggctcaagctcataatcctggcaccttgggaggccaaggtgggtggataacttgaggccaggagttcaagatcaacttgggcaacatggcgaaactctgtctctattaaaaatacaaaaattagtcacgcatggtgacatgtgcctgtagtcccagctactcaggaggctgaggtgggaggactgctcgagcctaggaggtggaggctgcagtaagctaagatcacaccactgtactccagcctgggcagaagagtgagacctcatctcaaaaaaatatataataataactgtactttttgggcaatttcatagtaggctgagagccacttttgcaaatattcgacatgttttatgactaccttatgttgcaggctgttttctatttggttttgtgttgctctttgtctgaaagcattctcagaggcagccagaggccgtgggagcaggcttgctggcctgggtctcagtgtacagttttcaggccgctttggtaaaagcatgaactactacaatcatattttccacagagaaatcaatgcccttttaaccatctgcttccatcatatttccaggaggtgcaggggtagagcgtgtccagaaagtacactggatgtccaagggagcggggagctcgggagaaacagcactgttttatttttaccttgagattgccatgtgcttgtccatccgagctttcaattcttcattctcctgctggaaacgcttcaatttgtcaaccaatgctgtgttgttgtccaccttggcataaacaagaattccaacatttatacaatattaaaaaaaaaacccctcatttcttaaggcacctcacgacacaagcacactttggagatttaattaaggaaaatgcaattccatattaaaatatttatacactaacaaacatactgaaaaagattttaaaacagcaaaacagagcggctgggtatttttaaaacatgtatgccaggacacttaaatattgatacgagtgggtaacagatttgttccaggtcatgttgttttggaattctctaagaattggtgcctctttctgtttcaatgtgaaataaaccctgcagacacactgcccacacttatcaaagcttatctatctccttacggtgaattttgctggaaaaaaaaaaaaaaagattcccacatctgatgaaaactcacaggccagcaattcacagtccctggcaacgtttactatggacttgaactcagtttcatggtaagttttcagcatttgcgtctgagtggccatacaaagcttcaattcgatagagctcttagagcatgccatcaaagaagtaacatgccacgagtctcctcaggtcagctgaagatagataggtctgttctcttgctgccctgtgcaggctgaactttcaaggcaaacaaactgatcagcggagagatgaaaggataagatgcctgaggacatttaatcacttaacatgatgaagacctgattccatcccccactcactttctaaaggtaaggctttatgaagaggcaatattatagctccgtcaggattaagtctaagtccttgtccttgtagcaggactaacgcgctttgagtatgttgcttagtttggaacctgattgttcttaagacatcctgttatccagaagcagctcaggacaacctgttcaggttaaatcactttccagaaaaggagtctacgttcagtaattatgaaggattcccagataaaacaacgtggaaaaaaacctggaatttgagattgggaggtattgtcctttaaatatctcatcctagggaaactagtcctaataatgtcacagagctgattatgggcagtgccggtttcatgggaaagctgtctttcttagaaaacttcctgtgcttctaagtctcttaatttcatcagaggcctgtaatttacaaatatgaagggaacagtgggtctccctctcattgtatcaactcattcttgcacacatacacaatgcaaggctgaaggatattatcaggatacctctggggcatggcaagaaacaaatagtagatcatcagaaattaaatgtgttggtaagtttacagcaaagtctgatttattgcacatgattttttgaaagttttgatgcatgaatggcatatggagcagtcctattaacaggatcatctgagtcatccctgactaccagattagaagataccagactcagtcgaacaggacgacctttggcaggaactggtatgtatactaggttggcccattaacaaccatgagttcctttccttcctttacaaaaatttcctgataattcaaaatgctggtatatccacacaggggcttggccgttatctccctcaacagaagtcatagtctccagaagaaaaccaaacgccaaaccaacacaaaccaagcagcagagaggtcccccatgtcccctactgtccagggctggtttgggtttgaatgaggcacttgtagaagcctgagtcactcatcactgtggggagaagaggccagtagcatgcggcagctggacagtcaacagcaaggcaccgcgagggcggggatcacttaagctgccttgccaaactctgccaacttggttagagtcctggctggcagcagctgtatttcagggccgggccaagactgacgctgaacactgaacatgccactcacactaacatcgttctctgttctagacactgcaaagtgaatgttaattcatatttttggtaacacctgctacttgtccaaatggattaatcttattatagcacaattttttttttgagatggagtcttgctatgtcgcccaggctggaatgcactggtgccatctcacctcaatggaacctccaccttcccagtacttgggattacaggcacccaccaccacacccggctaagttttatatttttagtagagacagggtttcaccatgttggccaggctggtctcgaactcctgacctcaagtgacccacccatctcaacctccctaaactgctggcattagaggaatgagccactgcgcccagcccacgattcttttatcacatgctaattcacaagaagcaagatgaagaattttgataaatagtattgctattcatttctattaaattcatttctattcatttctattaaacgtatccaactgttttggatctaagaaacctgtccagggtggctggtatattaaagtactgattttacatagatatttaaacatttttcttatgcaggtgaagatccaaaataccactgaaatataagcctgatttgtttgtagtttttccaaggactgggtgctgttttacatgttccttgaaaaagaaaacattctaggaggcagcaatgaataaatatggaacaaacttggaaagaaaatgtgaactttatcttttgtataatttctaaatatctttaggagcagttaacccaactccacagttctaaaatgcagggctcaatttcacacatattaccccatttgtaagatcctctttcattctgaaggaaacataccagtttctccattttcattaacttgatgtcctgttgatgcagtttctcattcttgatctctaacacagctttcaggctttctaactcctgttctagatacatgatctgaggatttttctggaaaggacacagcaagatactgctcttattccacatagttcaaattcttaacagaaagaatctttgattagattgagacattagacaagtagcaagcgacagatgttcatcatcttagagcaatttcaaagaaagaggtgaaaaacaagagcaccttaatgtcgaagactggtcctaatactgaaagcaaacatttcacttatttatcagtaacttaatatgcaaaaatgtgagttgcatcaaacatgttattgtatcaagagaaaaactttgcttacatacaaaacagaatcttggctggagatgaggcaatctgtgagtcagttattggcattttctgggagaacagggaacaacagttctctcctaccaaacaaactgatcaggaaagaaaaagcagtgcattatacggctctctggaaaacaacagggataacaatgtcctgagtgtttggatttttgttatgatggggctacgttgactgggccatacttctagggcagacataatactatcattttctattgtgacaccccagtacctacacggcatggagtacacagcctatttaaatttctctccaaaaattacaagtttgccaggcatagtggcatatgcctacagtcccagctactcaggaggctgaggcgggaggatcaactgagccaggaggtcaaggctgcagtgaactgtgaatgcaccactgcattctaacctggtggcagaacaagatcctgtctcaaaaacacaaaactctccaaaataaatgctacatcaggggaggcgtcctctgagagcacaccatcagtgtggatttcccaccaccgcccacccactccttgctttattcggaaattcaactaaaccattcaaaatttatgctacagaagaacagcatatggtccactgatcagatatgtttaatgaagcaacgtcttaggtaagagtcggtggtgtggtcatcaagcttatcttccggggcattggtttctgctctggaccaatccttagggagaatccaggaaggggcctcggggattacttaatccaaaccccttacttcacacagaaagaggaaacgtgttccacgggttaagcgccctactcaggaaagatcaggaaagcttccagagctggaaagggtcagggcagggactaatacatctttaattctaggttctttagatagttccctgaggctaggagaggtatgcgtgtgtatggtgggaggtggggtggggtgggatgaggagaggttggttaatgcatacaaacatacagttagacagaaggaataggttctagtgttcaagaacatagtagggtgactatagttaataataatatattgcgtacttcaaaatagctacaagagaagatataaaatgttccaaacacaaagaaatgataatgatgacggataccctaaataccctgacttgggcattacacagtctatgattgtctcaacacatcacacgtaccccataagtacatgcaaatactaagtatcaatttttaaatttcatacattttatacagtgttacccttgtacgcaggatttttttttttttttttaccttgaaaatagcgaatcctacctcatttttgttagagggaaatggcataacttaccgtcagttttaaaattagagcatttacaagacttgtaccctctgcattttctcctcctcctctgccagcccatccctttctcccggactacagtcagacgcactctttttccgcagcctcagcatgcttacgtgacagaagcggttggatgcttctgtgttcctcactctgactctgccttagcttttcaaaagcggctgcagtagaagaatcccctttgtgtaccggaagctctttcaaacctgtttcctgagccatcaataaagtttataccctgcatatccctgcatgtaagtctagatttcttttgaaatcactgactcttcctaagaatcttctagaataaatagctttgaagtttctttgaatataagctcatctaatgttatcaaatagctagagggtctcccaatgacattatttgcagaaggtctcactgagagatccacacatgtactttctagagctggccagagatttgaagtggagaaaagctttgcttctgcagtctcagagtataaacatgaaatgaaaacagtggtactaaaggcagaagcagcaaggaaacaaatttttttcaaaaagacaaaggttggggtaaggctggggaaaaaggacaaatgtgccacaagaaatttcagcttccaagagatttgtacttttcagaattgacatttatccatacggcgaaatattattcatccataaaaagaaatgaaatactaacataggctacaccacggatgaaccttggaaactttatactaagtaaacgacgccagtcttaaaaggaccacatgttctacaatcaaccttttctattcattcctcagaataagtaaatccatagagatagaaagtagacgggggagagcctggtgctggggaatttgggggaatggggagtgactgctaatgggtccagggttccttttgggggtgataaaaatgttctagaaagaggtactggtgaccaatggacaactttatgaatatactaaaagccactgaattttacatgttaaaagagtgaacttttcctgggcaacatggtaaaatcccatctctactaaaaatacaaaaattagctggccatggtgatgcgtgcctgtaatcccagctactcgggagggtgaggcaggagactcgcttgaacccaggaggtggacgttgcagtgagccgagatcacgccactacactccagcctgagtgacagagtgagactccctctcaaaaaaaaaaaaagaaagagtgaactttgtagtttgttttatctcaatacagtgattttttttttaaataaagtcttcacataaaactctaatcctaattggtagtttccttctttttagcttagaccaccagaaacatcctggacttcatccgtatgtcagattttaggatggtaaaacaagacgccagtaagcaaagcagttgttttacacaccttagaaagcacattgccagacatgagaaggattcccaacctgtgttatttctctggctgctgagtacttgaatgactctaaaaggcaactgagaagaaaaattccatactgataaaggagcacacacaacttaccaaatttgctttttctcttgctcttcttttttgttcttctgatttcaatttttcatttaaagcatcattttcactcttcagatcattgatttgcttctaaaacacaatgaaatgtggaacttaagttaacaagaaaaccccagaaactcagcatacgtacacagaaacattaaaaccaaacaaaatcaaaaatgatatttttttttgtgggggatactgggatattgacattcacccacctctagcgattcctgcttctcagaaagtaaatcttcaagcgatttcttttctatttcatggcctttcttaatttctgggaaaataaacggatatttttgaggcaataacattctatgagatcaatgtactctaaaacagttaaagcatatagatgtaggggttgatgatgaagccgtatgacgttactttacatctatagtatgcttttatgtaaattggccatctgttctcaaaatggccttgagaggtggttagggtagacattcccattttatgactgagagccctgaggcccactgaagcccaccatggcccacagaggccatgcgaccttaggacaacactgagtgccatttcagggcaggctctcataaatgccactccagactcctggtctggaaaccctgtgctcttttcaatttgctcttcataacctaaacataagtctaaaattatactcatttctagcaggaaggaagaaaaacaatgttcactacaagtctgcctggagccagtcacttttacacattatcacctctgcctgactttgggcaactctatttttgtggtgagaaagtccttgctgaaggtcacacagccggttcttagcactcatccacgctgctctgtaagatgcaactggtttagtagaaagactgtgagcgacactgccgattctgttctgaaagcaatggcttacaccctcccactgatgacagatgaaaaatagaaaagactatttttctattcaataagtggcatcgacatttcacagcaacactgctgtgcaggagcacttggggtggatcctttactgtggattacaagatagaaacttgtacttgccacttcccagggacctaagctggcaaccaccaccgccaaaatggcctttacagtcttccaaagcccatcctatttaacacaaggctggcatttgtaactattatttgcatccttagtgggaaaaggcatctgttaacaataaaccacgcaaaaaggaaccaagaacaccccagcctgaaggccacagggcattcgctgaagcaggaagttatgaatcatttccatcttaaaacatcatgtggttccttcagattttattctgtttaaagaggaaaaaaagcatccttgcctgaaagggaggcttcataggccttctttagcaattcaagtttctctgagtggctagcttcaatttccaacttagaggtttcatgcgcagcatttaagttgtcaaactgtaagcaacaaacaaaaccgtggtttaacagtaaaaccaaatgtcctaagttgaatacgcaaagcaaccacattaggagacgtcacagcttcacaggtaagcgtgggctctagtttaaaggctcctcaacacatacaaaggtcagggcagtggttcacacttgtaacctcagcactctgggaggcagaggtggaggatcacttggagcccagcagttcaagtccagcctgggcaatgtcgcgagactctgtccccacatgtgcacacacaaagaatgcatgaagagcaacgcaactgggattcaccgctcaactctcctctgtctccttccctaccctcaggaacacagacacagaggctctccagggtgacagatggaaatggctgcatcagtcacaaggaatgaccaggaacgaggatatgtttcacagtgacagggccacatgctctgcgcctgtcacttgaccactcaggccctagcatgtgcctggcctggagtaggcactctgtagatatttactaaatgaaaaactgagttaaaaagggagctacaaaattaaaaaggtttgatattttattcagtgaaaaaaaaaatgggatatttaaacagatgccactaaaaaaaaaaaaaagaaagaaatgcaaaacaatagtttggcaacacaccaccaggatgtttacaagggattatttctgggtagaaagaaagggttgttttttcaattttatcttttcctcctccttttcttcccttctttcacttaacataatacattcctttggtcataagaaaactattcaattaaaaagatactgtttccaaggcaggcggatcacctgaggttgggagtttgagaccagcctggccaacatggtgaaaccccgtctctactaaaaatacaaaaattagctgggcatggtgatgggtgcctatagtcccagctactcaggaggttgaggaaggagaatcacttgaacccgggaggcagaggctgcagtgagccaagatcaagccactgtactccagcctccagcctgggagacagagtgggactctgtcttaaataaacaacaacaacatgctttttatacctattagactaaaaaagagaagctcatcaagatgtgaagagcaaccaggattcaagtaagcagcagaggcctcagacaagctctggctgcaaaagcacagacctgctcttgcaattgcattttgtacttctctgcttcttcaatgtaagtgtcccgaagcttttcatactccctggtgtaaaactctttaagccgattctctcgttctgttttttcagcctggtgctgctggacgaatgcttcatacactgtttgtaactcattcctggctttttctaatttctcacaggtggttgaagcagtgactgaaaacagaggagaaagaagagggaagaggtcattttatttgtgaaatgtcctatattcattacagtcacacacagctgtgatgacacctgaagcatacacccatgatgtcttgggtctctagtgaccatgtcttcaaatataacagtatggaagtgaactgtaaaaaggaacacgagggcagggcgcagtggctcacacctgtaatcccagcactttgggaggctgaggtgggggaatcacctgaggtcaggagttcaagaccggcctggtcaacatggtaaaaccctgtctatcttaaaaatacaaaaattagccgggcatggtagcaggtgcctgtaatcccagctactcgggagggtgaggcaggagaattgcttgaacccgggaggcggaggttgtagtgagccaagatcacgccactgcactatagccggggtgacagactgagactccatctcaaaaacaaacaaacaaaacccccccccaccccacattcaaaaaactgactcccaagcagtaagagaagtacttcagaagacccaggtttctaagagaagatcccctctcatgtggtgaccagtcaatgcagtggtcaagaaaagagccttggccaggcagagacatttcttaggacaagcgactcctccctctcccagccagccagtgtggtagaagctcacacaagagcaggaaagacgagggataagaaacaagtggaccggccgggcgcggtggctcacgcctgtaatcccagcactttgggaggccgaggcaggtggatcatgaggtcaggagatcgagaccacggtgaaaccctgtctctactaaaaatacaaaaaattagccgggtgtggtggtgggcgcctgtagtcccagctactcgggaagttgaggcaggagaatggcgtgaacccaggaggcggagcttccagtgagccgagattgcgccactgcactccagcctgggcgacagagtgagattctgtctcaaaaaaaaaaaaaaaaaaaaaaagaaacaagtggaccttaaacttgtagttaatttgagttgattataatttgttatttcaaaactaataaaaataaaatattagcctctattaaacgcaaatcaccagagcacaaatatcttagggaaaaaaaaacacatcttaaaagcacccacataggccaggcacggtggtttgtgctataattcaagtattttaagaagctgagaccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagagagactccgtctcaaaaaaaaaaagaagctgatgcaggagaatcatttgcacctaggagttcatgaccagcctggacaacatagggaaacccatctcttaaaattaaaaaaaaaaaaaaaaaattatccaggcatgatggtgtgggcctgtagtccctgctactgaggaggctgaggtgggaggatcacttgagctcaggagattgaggctgcaactgttgggcaacagagcaagaccctatctcaaaaaaaaaaaaaaaaaaagcaatataaaatgaaaggttaaaaaaatttatatatgtatacataggtacatatgtgcacgtatatatgcatacatatgtatgcatgcatatatgtatatatctatgtgtacatgtgtatatatgtacatatatgtatgcatatatacatgcatatacatatacatatataatacatatatacacatatatacactatatatatagacacacacacacacacacacacacacacacacacacagagtcttgctgtattgcccaggctgaagtgcaatgacacaatcttggctcactgcaacctccaactcccaggttcaagcgattctcctgcctcagcctcctcagtagctgggattacggcacatgccaccacgaccagctaatttttgtattttagtagacacatggttttaccatgttggtcaggctgttctctaactcctgacctcgtgatgcgcctgcctcggcctcccagttaatatattttaaaagggcaaagtaatctgatacacataattgaaaatcagaacatcttagctcttccctacaactaccaaaaatagaatgactaacaatataatacatggcagaacacaaccaaagatatatgtacacacactacaataaatcctagaaaatcttgaattccttaggaagcctgactttggacattcccagtcttctgtcaccgatgtgtaaatacaggcagacagggtactactgtaactgtcagggatacacatgctgtccacatccccagagtactcgtggattaatacgacagggttgctggcaaatctgttaaattaacccttacctctctttggaaaggaataacatatcaggagttgaaggaagaagattattttagggcacagaaaaggacaatttagatcaataattatttggcctaaggaacgtgaaaatggcaggttcttaggaagatttcctacaatggtgtcaacttgttatctcaggaacctgccatgtggtggtagaaatacccaagtcacttgcccccagtcagtattctttcagaggaaaaggaggccacattgaaataatggcaggaatagtgtctgccaaagagaacccttaaaaattaaatcaatctacaaatgtttattgaagggcaaagatttaacattaaaaaaaaatccccaaaacaaaaactatttctcgttgcctggcacagaatggggctctttatcttgtttaaccctcacagaggaccctcctaaacatatagataaggaaaccgccacagagaggctaaatcatctgcccaggggcacagagctggcaagcgtgagaggatgggtttcggtgagcagtctgaattctgattctgcctgcacccaaagcccgtgccccttcttttctaccaagctgtttcttgtgctggggctggcaaggcgcatgatggggcctctactggaagagacaacagacagaggagaagtggcaggaccaggccagaccttggggcccagggagtggcactcaggatagtttacgtccagtcagggtggaccaaaggtttggtcagatttttaaaacaattaaaaaataaataaataaaaactgtgatgagggctgggcacagtggctcacgcctgtaatcccagcactttggaaggccgaagcgtgcagatcatgaggtcaaaatatccagaccatcctggccaacatggtgaaaccccatctctactaaaaatacaaaattagctgggcgtggtggtgtgtgcctgtagtcccagctactcagcaggctgagtgaggcaggagaatcgcttgaacccgggaggcagaggttacagtgagccaagatcgcactaccgcactccagcctggcgacagggaaagacttcatctcaaaaacaaaaacaaaaaaactgtgatgaagcagataccaaattaaccattttaattatttttaggtgtatgattcagtggcattgaatacacttacatcgttgtgtaagctttgtcatcatccattctccagaacgtttccccccaacctgaaacttcgtaccaattaaacagtaacaacccatcccctccccttccccaaggccctggcagcgaccattttactttctttctctatgaatctgaccattcagtacctcatatacctggactcaaatagtacttgtcctgttgtgactgtttatttcatttagcgtatgtcctcaaggctcatccaagctgtgggatgtgtcacaatttccttccttttgaaggctcaatattattccattgttggccgggtgcagtggctcacgcctgtaatcccagcattttgggaggccaaggcaagcagatcgcttgagttcaggagttcgagaccagcctggccaacatggtgaaaccccatctctagtaaaaatacaaaaattagcggggcatgatggcgcacgtctgtagtcccagctactcgggaggctgaggcaggagaatcgcttgaacccaagcagtgcaggttgcagtgagccaagataacgccactgcactccagcctgggtgacagagcaagactccgtgtcaaataataataatgataatattccattgcacgtacagatgacatttgtgtatccacttaccatccacggacacttgggttgcctccacctttggctactgtgaataatgctgctatgaacaccgggggacaaatacatgcccgagtccctgctttcaattctttggtgtatatacccagaaggaattgctgactcatatggcaattctattattaattatttgaaggactatggtactcttttccatagtggttgaaccattctacattcccatcagcagtactacacacaagggttccaatttctccacatgctcaccagaacctatttgattttttcaaatatatgtaacagccatcctaatgagtacatcactgtggttatgatttggtcagtagattttcaaattaagccatatgatagaaataaaattgaggcatcaaggatgaaaatcctatcccagcatgagcaatgatgggcgacagaacggtgagccttggtgattaagaaactcacaaagcagagaagatagaacccaaaaagacagacggaggccagattacaggggccatcgcacgcaactcaagcctttgggactgaatattaaaagtttcttttctcctttaaaagaatttagtgaaagatagtgatggtcttgactgctggagaacattctctgcacattcacttttccttctattacactagtaaccacagaagaaaaaatgactcaagaagtccaatgttagtcaaacgagtaaacactgcattagcttctgccaagtaactttccgactctgaaggctcctcgtgtgaatctcgtattagaactttctatgaaaacctacaacagaaacatactttgcaagccgttggtgaaggtatcaaatagcttctagtcagagaaattctagtttcacgcaggcttttcacttgcttctcttaaaatttccggtatttccaaagttaaaaaataaaaaagcaggaacaagatctgaacccatctggaagctcatatctgggacagaaacatctaagtgaactcagggactcagcaataaacaagagactgcctccaagccctgggctagaagagcttcgaagctgacgttaatagcagactaccctggctgattttaacacatctgtttatgataaaaatactgtcgctttgaatatgtaattgtggcacatcagcctttaaaaccaaataggatacacagaagtcctttcctattagccatgggacagggctgtttccctctattcaccaaaaaaaaaaaaggcagctctgacgttttgataagtgaggtgaagagaggacacatgggaagaaacgggaaagagaaagggagaaaatgggtcagatgggggaacaggaggttcactgctgttattgtaatagtccaaagcagcaggcccagccccagacagtgacatcagcctgcagctgtgcacagacctttgctctgtttactggcccggtgtgctgctggggaacagctgggctgcagtaatcgctcacactaatggctttcgtttgaaggaagtggcctgggctgcgaaggaaacatttatttggcataaagactcatgaagtattttttaaaggatgcacatgtaaacgctgtattaaaggttctcagagtgctcctcggcagctgtgacataaacgtgtgtgtgtggcggtggggggcgtgcataaccccgattttaggccatggactttcctgtgcactgactacagcttaggagagatttatggtgccacctgtgtgtgctctcactcctatcctcagcctagtctcttcttgctcattctccagaattccactcactttcaattaatcagacaccccacaaagccaaaaccaaacataaaattgtttcgaatttgcaacaagcaagcatggacatgcgaatgtttgaaagaaggtattagacaaacacaaagtcaaagtagtctttttgtccctattttttttttttttttttttttttgagatagagtctcgcactgtcacctgggctagaatgcagtggcacgatctcggctcactgcaacctccacctcccgggttcatgcgattctcttgccacagcctcccgagtagctgggactacaggtgcacaccaccacacttggctaattttttgttttttagtagagatggggtttcactatgtgggtaagactggtctcgaacttctggcctcatgatccgcccacctcagcatcccaaagtgctggaattacaggtgtgagccactgtgcctggcctctgttgttttaatcattccattagtctattttttaaaaaagcacatatatgattaggaacaccaacagaccaccatctgtaggagaactgctgggcaacttttgtatacatgtttgtaaaccatgaaagctatctccagcaatctagcttaaaagaggaaatacagttctcaggatttaaggaaaaagagaaaaaaaaaaaaagaaaaaggaagaaaggaggaagggagggaaggggaggaaggagaagaaggaaaggaaggcaaactcatgtacaaaaacatctctaaaatgtaaggccacattgagattagaagtcagtattttcactctgcaatgaatcacccaagaagaattctaggccagtgaccctccctgacagtttaaatcatggatatctcagcaagaaaaaaaaatcgtaatcagtgaaatgctttaagttttgcttttcaagtaattatcaagatgatatgtggaaaatgcccagtgccacagtcaaacataatctctggaaaacagagctggagtcctcccaggtccttcattacttagccctgcagaactggagtggagccattacttaattagtcctcatggctttttctcagaggggaaggtcagacttttattatttccatctcacagagactcatttccctttgttgattgataaatgtactgtttacagagaaaagcattacacagccatggcccgacattgttaatattcttttgaaatgatacagtgctttcctagtttttatatctgagtagcatggttcattatgagacgaccaaaaatattttaatgctcaagaacataaataaatgtcctaataggatagagccaaaattacttgggttcaaatctcagtcacaccactcagctgctacatcacttgagcaaattacttaaactttctaagcctactttttgttttgttttgttttgttttttttgagacagaggcttcctctatcacccaggctggagtgtagtggcacaatctcagctcactgcaacctcggcctcccaggtttaagcgattctcctgcctcagccccctgagtagctgggattacaggcatgcaccaccatacccggctaatttttgtatttttagtggagacagggtttcactacgttggccaggctggtctcgaactcctgacctcaaatgatctgcctgcctcggcctcccaaagtgctgggattacaggcatgagccaccgcacctggcctaagcctacatttcttcatttttaaagtggagatattattagtcccttctctagaagatgaaatagcacaggtgaagcactcaccccagtgcctgaccacagtaactttgcagataaattgtataactgttacggcttgcaagagtccattgattccagtgtgtttgaagactcctggaagacaggcttagggttccataacagaaatataacagttaaaaagcagcattgctggcctcgtattcaaatttgatgcatatgaacacacagacgtagctattatggtggagtgtacactcacttcaagtctttcccttccgctactattgttcttgacattatacgcaatagaattttcctaatttggaggagattttatgtaaatcagaactaaaatataaaaaagaaaagtgccaggcaaattttcatagcgccacataagagaataccatagaaagaagagacgaacaggaaaaagagatgattccattcccaaactgcacacatactcctttcccagacgctctggccagcctgctgtgggtggcgactctcccccaccccaccccgaaatccccctctctgcaccatctaggatggagaagagcagcctgcctccagctctgcctgcagtgggcccctcactctctcttggccgcctgggaaaccggcctcctcctctcagttctgggctccttcacttctttcttcaacagtacatacccattacacttctcggggtaaacagaactgtcacttctcttgtgccccacccccagaagcaggaggggacactacattctaccgtaggagtgtgatgatgtcataacattctactaagggaaatccgaggaaatccgatcctgacacacgtccatggcaagcgactatgtaggtgacccccttaagccaaggtctgatctggtttgaaactggaggtagtaacatcactgaacaagtaaccaagaagtcatttttaaacatcaaattgatgctttgtggacaggcagtggcctaaagaagaaaaaaaaggtgggacccagactatcccacaaataggcatgtccagtttcctgggcctccgtgtcctgatatggaaggtaggaacaaataccacctgttctgccaacagtatagattggtgatagtaaagtgaaacagagttactcttatgctttgtagaaagtcttcccagcctgtggaataatcccctactcacatagtgccagggtttgcctctctaaagatactttgtcaaatgaccaagaaattttgcagacaagtggtagaccaggttctttttctacatttccaaattatctccaaatgcctttctgattactcctgggcattaaatcaacaaatcactaagagctcatttcaaagtcttccataaatcataaattattaggaacttgctttttacaaaaggcctgcacaatcaaatcaatcctcccataaatgccacttcacctttaaaactcagttcatactttacaaggtgctctcacatttgtttcatttaatgtaacaatgctctgaacgaataaaataggtattatcagacatctcattttaccaaagaagaatggaaataacggagctggatctacaactccagcctctttgttgttgttgtgttttgagtagatatggggtttcaccatgttggcaaggctggtctcaaactccgggcatcaagcgatctgtccacctcagcctcccaaagtgctggaattactggcttgagccactatgcccggccctagaactccagcctctttgagagcctaaccacagaacacccagcgggatctgactggctatttttcccagcctgagatgtagaagacaaagttaattcacacgtaccatggatgcctcagggtagtagggcttaattctcttgtggaagcactgctgaaaagattccaagataaggcaggtaaaaaaatgacctttccccccctatactgggtagtgctgacaaagtgtgactcacaggtgggaagacaattccacccagccagcctgtcttccatctccatcttggtgcctaggtaccagccgggcctcccctaaggttctagcctctccctgccagtgttcctcctcccacccttgaagagaagcctgcaaaggccatttgctgtttttcagctcattcactggccagcatgctgcagaacagatgcttttttttttttttttttttttttaaatcacaacagcaaacactccgtgtataaacgaacacatttaggaataaaagtgggttggaggcgagagcacagctgaatatctgacaatatgttctaagattcaggcctgagaaaaagtgaggctgactttaaaggaatcctgtttcaatcaagagtttcaatgtaaaaaaaaaaaaaaggatgattttaagtcagggactattcattctgcctcttctcctcactgacggatcatttttagagcacgagggtcaaaaaggctgctaaaagtccttggcatgtgtaaaatttaaaagcttatttataagaatggactcaattcactcggagttacttcatattattcttactatgcttgagatatgtatgtatttttttacataaaagaaacaacattctaggcagctagagcagtgtcaaagggtagtcctggggcacctacatgagaaccacctggatgatcattaaaagtgcagattcctcctcaatttccattaagggaaaggttttgctttatttttctttgcaggtagccaaagctgtactcagatattgctaataaggaagaaaaactggtctcctgttaacctgaggacactagggccagaggtcaggaagagggatcaccttccccatcaacacaacatctttttagaagtgctgcctctccttctgtaattgggaagcacctattactattccttaaagcccaaagaggggttagtaggatgatgggtataggagacgttggggtttaaaaaaaacaaagtgcagattcctggacttcatccccagccaaccaagtcagaagcaatgggcatgagaactgaggatctgcatttcaaccaggtctattttcgtacacaataaagtttgggagccactattctacacaataaggtattaaattaggaaaatcccaagttgagagactggagttaggacaaggaacaggacaaggaggaacagtcagtgggtttcaaacacaggtaccactggtaaaactgcatatctgcaggtgaaagaacatggccttttacttataaatacagccaaccaaagtccaaattgagggcagatgtggataggaagagaatgagctaagtctgaggtggctatcaactcagtcttcaaacaagtcagggagataaacagccctgttttggtgtacagttggttttcagtatattaatagatttttcattaaagcctacttcaagaaaagtcacttctggaattttacaactcaaaagtgacttacctgtaaagagtttaaaaattattttaaatacatagccttgttaaaccaaaattgtagataaaaacggaacagtgaatgaatcaacacattccatatggcgtgaggcaatgtgaagttcatagacactgggttaagtgttgattaggcaatgtgtatactgcttttggcaatgtactgttttttgcaagttactttcctcagtaagatacattttaacaatatttcttaaactcttgattagaagaaaaatattccaaaagtagctatcaatgcaaacgagcgtttatttcaaatagttttccaatcttttaaatcatttcatcaaactttccctgtggtgactaccagaagattggtggtctagccatcttgggttcttatgcaagctctttgctttccagcttcccttgggaagttacttaacctctgagccacaatttattttttataaatacaatgcagagaagtagactgagagctgaacattgtttgttagggatgagtaggcaccaaacacacgatgttgttatacctagctcataattttcatgcacaaaaatcaactggtctttttacactattataggaagggcaagcatttttagtgaattaaggattaaaatcttgtttcacaaaatagaaataatcaggactaatgtataaaaagatgagagttagctgttaattgtgatggctcaaaaataattttgaaatacaaaataatcttcattaatttagatcaagcttgtccaactcacagcctgcacgtggcccaggacagctttgaatgcggcccaacacaaatttgtaaactttcttagaacattatgagatgtgtgaatttttttcttttcgtcatcagctatttgctagtgttagtgcattttatgtgtggcactagacaattcttcttccaacgtggcccggggaagccaaaagattggacacccctgatttagatgaaaagtctgattccaaggattaacattaatgaaaagcaaaaagaactctaaagatcataatcatggccctctattgcaccagctgttattcaacatgactctggaaagaatcttatcctagaggcaaaatgtctgctgcagatgtagaccatttaactgtaatctatttccaaggctgacactttcaaaatgatctgattaactgggattgtcggacataatataaaatgtatccaagagagttacagctctcctttatgactatgcattcctaaaggacaattatcttttcttttcaagatgtggatttcattttttaattattctgactctgctttaaacttttattttaggttcaggggcacatgtgcaggtttgttatttgggtcaacttgaatcacaggggcttgttgtacagaatatttcatcaccccggtactaagcccagtacccgatagttattttttctgctcctctccctcctcccgccctccaccctcaggcaggccccagtgtctgctgttcccctctttgtgtccatatgtgtttgtcatagaaatgttaaacggtttatagaaaaacatttgtgcataaaaaacactgagtattagcatattttaagaagaaaactacctttccctagctaccactgttggtaataaaatcattcattgattgaagtctaagcacctgctaagtgccaagcacaaggtgggagaactacaaaaattaaggagctattggccttgcccttgaagagttcctaattctagatggcaagaagaggtctataaacaaatctctgtaagaacaaaatcttaaatgtgtacagggtgctttgaaaagcacactagaaggcacagttaacttacttgaaagatttgggtgaaattcaattgaagatattttagctaagacttaaaaactgagtaaaagagaaggagcatgaggggtccgcgacgggaggggagtggaaagaggagagtgcactccaggcagagaggataccgtgcaaaagatgtggacaagaggtgcaaatgaacccatggccggggcctgggaggggaaaggaggtctgaacaaaggggaaagagtgcctagacgtgaatttggactggaagatttcaatcagtcaaatcataaatggtgtgcttagtatgtctggattttttcccccaaggccaaaatagagtcttttgtgtttgttaaaaatgtccagtacaggccaggagtggtggctcaagcctataatcccaacactttgggaggccgcagcaggtggatcacctgaggtcaggagttcgagaccagcctggccaacatggtgaaacctcgtctctactaaaatacaaaaattagccggccgtggtggtgcgcacctgtattcccagctactcgggacgctgaggcaggacagtcacatgaatccaggaggtggaggttgcagtgacccaagatcatgccactgcactccagcatgggtgacagggtagaaaactccttctaaaaaacaaaaaaaacaaaatgtccagtagagacacatgtcagcctgactctaagtacagatcctggccgcaagtggagttgggggcgcaggcctggaggcaaggtgacccattgggtagctgttgcagtatcttccaggtgagaaattgtgggacttaaaacagcagcagccagaatgctgagcagggatggatccaagtggcatttaggacacagactgacatgcacgtggaggatgggggaacaggagtatgatttcagttgttagcttgggtggtaagtgaatcatatcgaccctgccaaagctgaggaacaggggtgaatgaggagacgctgcatggcgctcaggaaggaaggggctggaccatcaggaaggtctgattatactggactggctcacctgggggcagcccctcactgggaagcatctgcagcttgggaaggagagaactagaaaaataaatctgtgtcactgttgtataggtagtagcggaaaccatgggaatggatgagaaaacagctggcaatgaaacccttgctatatactatgacactatttaaggggtaagtgaacgtatgggacagccacttgacagactttcccccagcccattaaaggtgatcataatgaacactatgaggcaatgtggaaaagtgcttgacctatccagtgaaaaagatcacagcagacatctgaccaggtgccatggctcacatctgtaatcccagcactttgggaggccgagacgggcggatcacttgaggcaagtgttagagaccagcctgaccaatatggtgaatccctgtctctactaaaaatacaaaaattagcccagcatggtggtatgcacctataatcccagctattcgggaggctgaggcaggagaactgcttgaacccggaaggcagaggtcacagtgagccgagatagtgccagtgcactccagcctggcaacagagcaagaccctgtctttaaaaaaaaaagattggagcagacacttaacatacacaaatctcaaaagtattatgaaacaagccagagacaaaaaacagcatactatatctttccatttaaatgagaatctagttcagacaaaacctttgataataaaggttaaatcagtgtttgcttctagggggaggggtgttccactgtgaaatggcatgagggaatttactggattgacagaaatagtctatgcttgataaggatgtaggttttaggagtatatgtctgtcaaactgatggaataattagcattccgctgtatgaaaattacaccttaatttaaaaaatcgtagtatgaagttgtatatattcatataaactaagaaaagggaatatgcaaataaagttatgtcagggcagtggagctgccggctgttttcttttcacttaaaaatcttaattttcatacattgttctaaaaaaaaaaaaaactttaaaacttaaaatacccaaaaatatttatcgagtacccaagaaaacagaaagcatattatattatttttccataggaaacagaaaagaatccctacaattatggactttatacctgaaggtaacaagaaaacacgagacagtaaagacatcaacgtagagtatcaaaaaatcactggaccaaagggacacttttaagagtttctgcagaagcaaagaaccagtgcttccatgaagggagtgtggctcagacagtggaaacacacaggctgctttggacactgccacagtgagactgagggaacaacgggaaagtcagtggatgctgggacagctggaggctgttagatgcggaaggtggaaagcacagactctacctgggtttcagtgctcctgagtttatgaactgtcctttttctttgcagttcttagtagtttgggtaccttgtctcaactttcattgagaaggtgaagaaaaattacccaatgggagagtgacaccaactcccatcgccccacccccattattttggagggaagaagtgggtgctttgatgacggcgatagtggcagctctcttttcttgagttgctgtgatgggccaggcactacaccactgctttatatgcattactattttattcaagctccacaataacgcagcaaaatacatactgatttcatatcaccagcgaaaaaaccatactcaaagaagttaggtaacatccaactaggagtggatggacaaaaacctaggctttgactccacacaccacactctactggatcaggagaatactctgatgaggtctcatttccacttgagtttgaagagcctgtcgtttgggatttctaggaatatttagtctaatgattattcctttctgtagcatagatgatgccctcacaaaacagccagtgtggttaattactacacagctgtcaagctgcatacatcctaatacctattatttaatagcagttaacacttggtgctagatgctttacaatgcattacctcatgtaatcctcacacccacccttggggcagacaattagcatcgccatttttaccgaggatgaaattgggacagaagagatacaaagtgacttgtcctaagtcactcagttaccacaaatgtggccccggacagtgtgacaacatcagcctaaccactttactgcctcaaaatttaaaactgggttcccaactttgctatgtcaatgtcaaagttagtttcatgctgaaactaacaatcccactggcagccttgagagtgttcttcctggaccgcttcatcacaagtgtttacaggtttcgcttccctccacttacagaaccaaaacccttctccaaacggagaacggttaccatcagatgtatgcctgctgcaacagcagcaatgacacattccctaagaagccagcactgggtgactggggatctggataggccacccactgtaccaacactcgggaggcaggagaagcagtgcaccaggacagcttccttatcaaggataggaaggtgacagtgggcacagactgttacagctatttcctgtcaggctacctgactcactggaggtgctgaatccctgggccccaactgcggttgcttaattgtgctgtccactaaaatgtaaaaagagcatccttcattgaagcagagcgaatgggcacagtgttccattctcattgctgccttgtcttcggagagaggctgaaatgtgaacctctaggtaggctcacctccacttccactgggttataatgaactctgaaacacacacaaaaaggcctctttcctgatcttctaactctgttaattatgttatttaaggcatggacaaaagcaagttgggttggtcatttaggtaatcataagggctgctgtcaagttaagtaacatggcagaaagcctgcaaagtctgagagctgggctgtctctcagctgggatttccttgaactgtttcaccagaactctcaagtctttgggattctgaagtttccatctgtcttaaaattacttttccataaagaggccttcatttccacagcctaaaataaagtgaggactgatgtcttggctaggtattaagaatctggacggttagtcagggatttggcctcacctcccactggaaggggaaaagggaagatgaatgcagagaagtcttttacagagtcttgctctgttggccagactggagggcagcagcacaatgacagctcactgcagtctcgaactcctgggctcaagcaatcttcccacctcacactccagagtagctgggacaacaggcacacaccaccatgcttggctgatttttaaattattttttgtagagtcagggtcttgctatattgctcaagctggtctcaaactgctggcctcaagtgatcctcccacctcagcctcccaaagcgctgggattacaggtgtgagctaccacacccagcccagacaaagtcttgaccccacgttcactgccgtttgatttctgctgtggtgaaggtgggagaattaagagtgttcaaatccagcaaatcaggttggcagtgtggtcttgtccaaaagaaaaaagggcagtttctcctagagttgggtgaacacaatttgcttctctggatgttaccttgcattattcatacaacatacctgggcatattttggtggagactgtaacacacacagaaaactgcaaagggcaaggaaataagccctagaatggtcagctccagatctggctgaagctgaagcaggaagttgattctctaggttgaggagcccagggcagagagaagaaccccaaagcggtcagatcactccaagatacgagttgacgtagaaaagggagtgtcggctgggtgcggtggctcacacctataatcccagtactttgggaggccaaggtcaagagatggagaccctcctggccaacatggcgaaaccccatctctactaaaaatacaaaaattagctgggtgtggtggtgtgctcctgttgtcccagctactcggaaggctgaggcaggagaattgcttgaacccgggaggcggaggttgcagtgagtcgagatcgcaccactgcactccagtctggtgacagagcaagattccgtctcaaaaaaaaaagaaaaagaaacagaaaagagaaaagcaaaacaaagcaaaggcagtgtcgtgtctgttccatgaaccctaagggcttccaggagagaatggaactaaaataacagcgtagcctggaaactggagggctgggtggtgggtgttgagacctggaaactgcagggctgggtggtgggtgttgagacatgtaaactgcagggctgggtggtaggtgttgagacgtggggctccctgtggagcggggaggtggtgaaccatcagcccccctccaaatagtaagattagcatagaacgtgcctttttcagccaagttgccttcatggacagcatcctttcaacttcatactcactactcacaaaccaacccttggaagtacaacggatttactgtttatcaagaggggaaactttcactattctcatatgaaaagtgcttcagaaaaaaaaatgacaacattatttaacaggaattcacacaattacaaaaataactctgtccctctcttcagcaagagaaatattttgctcatcagaagttctgctaggcttagtcagatcagtgccaggaattctgtgaactgaaggtcaagctgccaagattcaaaagaaatgtcgatagtaagtgtttgcccagatactagacagggagtgccaacagctcccagcatgcaactccagccacaacgcagacaggacaaccacattttccagtgttccccttgtcccataaaatttaacaacaacaacaaaaagctcttacctagctctccccggaggttaacaagttcttgagatagggttttgtgttgtttcagtgcttcctcccgctgcggaaaacacacatcaagttactcatgctttcaagagggtccctttcagtaaggtacacatttgttatcactaggaaaatgagacccagtattgggaagccaagatatgaatcatttaggctaacaatttgtgttgttaaaagaaacacagttgtcccttagctgttaaggaaattcgtaattcaaaaatctgtatttttgcaggtcccagtgaaactttggtttgacgcagtgaatggcccatttagaaatatttactttgagccagtgcttcactgctgatccatagaacctttcggctaatgcatactgtacttaagatgtaatgcgttctcctcctccaagggcaataaacatctaatcagtttaagataaatatttaatgttctaaacataagcacatatatgcactttgtcctatatttgcacataaaaaagtttcgttacaatgccaatccttctaaaagaaagacaaaaagtttgttagaaagctatagcagaaagataatcctttaaagacaaaattaaattaatttttttcagctacataccattttctaaggattatgatattttggatcagtgataattctaaatcgatgttagagaaacaaaccaaagaaaaccggatggctgtttttagtatcagagaagcaagtatcaaccttgagctgaagaataatgttcaagttaccagcaactcccggcaatcacacatacacacatacttacacaaatacagtaattacatacagttccttaaaaggtagattccctagcaccagggagtaactaaaaaaaaaatgaagaatttcaaagctcgctgaaaaatgccctcacgaggatcacccaagacggagctcccaccacatcctgatcacagcgttgcagagatcatgagacccggcctttgcaggcaagagttgcttgtcattcaaagcattttccctgaattccagacagcctctgcagtagtcctgacattcttccagaaaagcactataaacaaatactaattacccttgttgctgcacatggagaatagaggcacagtttgctgctggggcagcccattttccagcttctgtctccaagtccccccacccctcgcactgtgcaagaagcatacaggtggccgcgccacccaccagtcgggtctgtctacattcaaagctctagcaggaggcgcgccattggccctcgggcgtcttacttcatgtcctgcaggttaccgtgtgcctcggattcctcactcacagaagctgatactgcagcttctgcctttggcacaggcagcctgtgattacttaaagccacagcctttcatttatgaaaaacgagaggcaggcattagactgatcgattgccatttagttaaatatcagctgcaacggaggaaagaaaaaactgaccccctctgcatggataatggagttatttttagacttgtgagcctttttcttcccctctctaattgtggtcattatttgatcacacttactaatagaaaagggaaacttgttcttcgaagcccatatactaaatgaggttatgaactaggtgaagagcaaggaaaggggcatgctgtcgtttacaaatttaaatgacattatgaaatgagaggtgtttcaaaataagtctgaagtgctgatctgagagttggagatcccatatatttttaacttttactttgttctcacctctcagtaagagctacggaagtcaagtctaaacgccagcactgaaacgtggtcagcagggactgggatttaagacccacttttcactgagtacctttctggcttcaatggtattctaaatgcttggtttttaaaaatatggcattaagttgttctgaaatcaccagtgagtcagagtttcttaaaataataagtaattggttttctaatgtagaaattaaagcctgaggaaaatcagcccgcataataatggaagaaaaacataaaaatatgtatcataaatacttctcgtaatatcaaatttaagcctgaattttgtttagtaatctacttcaagtaaacaccaggaagctttaccactcaagtaacaggaaaaacaagacagctttactaaatgcccacaaacaatcctgaaactcatttggtgaacttgcttaaaattcacttttcagtagtaaccaagttactaacagaaggaagagatggcaagaaaattcaatcatttttcaaatttatggaaactaatgggaggatgaaagaaattaaaaattacagttagtataactgcaaagaaaaattgtgtgaaatcattatgttctactgcaaaaatacaccaggtgatatttttgcttattaagggaggttttgggaaagggagtttcaccaagcatgtcgacatttccccaaacttcaactccactgcactccacgttcctgtccttaatgcctcagaaactactgacatcttccaacctctgtcaggcacagtaacagtaacaggaaaaccttgaggtcatctttcactctttgtctaaatgggttgtgcaaaagtcagttggttcttcccttgtaatgtgacaccattcccctcctccaaatgcatagaccatttacccttctaaattggttggtaacttattacttcaaactaattaactaagcatttttcatagcagatgctgtgaaaatataaaagaaatttaagacatggtccctgccttcaagaagcatggggcctacctagaactagaacatccaggctcaattcttttggtcatctatcaaggcagatgacctcatcggatgggaagcagtaatgaaaaaaaccaagggctttaaataccatccatagatgaaatgctgaccccagtgcccatactgtaaaagacacatactaagggttagtttctgcctgactctccctggtagcttggcctttacatgtacttaccctttacttgtagatgataaaatgcattatgtcctttagatactgatttactgtttctttttactcagctgctcctagatcagtgtttctctcttagatgataaactcttaaccgtctagataacaggttgattcaattctctttgtattgtaacatgcagaattacacacaatgtgaaaaaagagaaaggtggaaatctggatataaagatgcctttatgctcaggcattaaatatatgaaatgctcaagaaaaaaaaaatggattcaccataattgaattaggagtccctgggacacaggcacttagtctctggctgtggtcccatcggtgtgcctgcatttttgctagccactgagtagcatcaacagcatagagcatcttgcagagaatagccacatcagatggctcagacgtgtgctgcatctgacctcctccccatcacccacacagtgaatttgctcaatgcatctatgtttttttgttccaagtcaactttactgctagtgccattcaaaattcacctttgttcaggtgctactttaggttaaattccacttgcaaaaaaaaaaaaaaaagatgtggaggcattttgaagaattagaggtttggggagggtgacctcagccctgttcaagtttacctagaaagccacccaatagacccttttaggaagaagcttaattactaccatcaatactgttgttcactttggctgtctgtgcagaataccgtctaactaagcaaggataaaccaagaattagaaaaaaactaaaataactttagtgtgtcttctgcgaaacagagtgtgacattagttctcagattcatgagatataagaatgtctgatatgtaatgaaatatgtctgccactacagtgggaaacttatagttactaagtagacttgcaacaaaagcatggtagttgcaagattctcttaaccattttcacccataatcgaaggctctaaagccatttagaaaaggttagcaataacaaaaaatatatatacacacacacacacaaatacctatatattatacatatataaaaatacatagacatacaatgtataggtatatcatgtatataaaaaacatacataatgtatatgtatacaatgtgtatctgtatctattttatatacatatgcatgtgtgcgcgcgcgtgtgtgtgtgtgtgtgtgtgtataaacacagtatatatacttctgtaatgggaatgggaactaaaaggttaagggagtttttaaaattgtttaactttacccatgattttttttctccaactatttttattttatttatttatttatttatttatttattttttgagacagggtctcactgtcacccaggctggagtgcggtggtgcgatcttggctcactgcaacctccacctattgggttcaagcgattcgtatgcctcagtctcttgagtagctgggactacaggcacatgccaccatgcctggctaatttttgtattttttggtagagacagggtttcgccatgttggccagactggtctcaaactctggacctcaagcgatccacccgcctcagcctcccaaagtgctgggattacaggtgtgagccaccatgcctagcctccaactgttttataatagtgctcagtatacattacacaatcagtaaatatttgctgattataaaataaagagagcaaagaacatttacataagactttatgctcatcctacatctggaattccatcctctccgttcatatgttcactcacatatatactgtgttgactattaaagctgctggggtggtttcataagaaagaactagatgcagatcctgccttcagtaaatttcctgtcttaaaaagcaaaaacaagcattaaaccggtatctctaatataacacagacaatgaaagagaagcatatatgctcctggaatccagacgggaacagaacgtagatctagaaggccaggaaatcattcctgagtgggttctggactgggagtggtggatcatgcctgtaatcccagcactttggaaggccgaggcaggtggatcacttgaggtgaggactttaagaccagcctggccaacatggtgaaacctcatctctactaaaaatacaaaaattatctgggtatggtggtgggcatccgtaatcccagctactcaggaggctgagtcaggagaactggttgaacccaggtggcggaggttgcagtgagctgagattgcgccactgcactccagactgggtgacagagcaaggccactgtcgcaaaaaaaaaaaaaaaaaaaaaaaaaaaaaaaagcgggttctggagctgtattcagtgcagtcacaattccttggctgtcaggacctaaatttaagtataaggtgaaattcacacacagtacaattgtctgggaaattcactaggagcttgccatgtttgtggacaatgcatctctctgtagatccaacccagtgaatttttttcctctagcgttggatcaactctctctataactgagcacctgataaaggcctcggcttgtgtttagaggccaggttgcatgagggaaaagtatctttaaacactaagatagcagagagtatagaatgctcacgccacaagaggtgttcggggactgagcagacacatgaaggaagggtggactcctgaccttcatctcaaattgactcccgggccttcgttcactggggggaatacaaggtggacttgtgttcttcatttaatttgctttttttcttttttttttaagttggaatctcgctctgttgcccaggatggagtgtagtggtgcgatcttggctcactgccacctccacctctcaaagtaaagtgattcttctaccttagcctcccgagtagctgggactacaggcacatgccaccacacatggctaatttttgtagttttaggggagatggggttttaccatattggtcaggctggtctcgaacttctgacctcaggtgatccacccgccttggcctccccaagtgctgggattacaggtgtgagccacagcgcccggcctgcatttttcttccttcagttgtttgtgtactgaatctatgtaaattaaatgcaagtggtgatgtgatgctgctgtaaaaccgacctgaacatgtaggtattgtgggcaaggacagcaacccagtaatgatacgtgaacaatggatgacgtacaggaagtttacaggacatttttagttgatagcttcctagacctaggtttacgtcctggttctcctcttgctagctgtctgatagcaggcaaattacctaactctatgcctcaattttcatatttgtaaattccaactcgtgtctttggtgaggatttaaataaggtaagtaagaatatctggcacttagtaaatattaggctggtgcaaaagtaactgtagcttttggcatgatggcaaaaccgcaattacttttgctcaaacctagtattcaataaatccctcttgcttctcctccatctctttatgtacggctacagcatctgggcatgataataacattaaaaggggcagttgttgccaaatgataaagagccttatagtaccagttgaaaaccagactccccaaaacaaaataacatgagttacgtaattataaatttcctagtagccacgctgagaaaagttgaaaaagatgaagctaattttaataacgtattttatttaacccaaatatatatataaaataatatttcaatatattcaatataaaagttgttaatgagatattttacatcctttgttttcattctaagtttttggaatccaagtgtattgtacacttaccacacatctcaattcaacggatttacatttcgaatgctcagtctcatatggctagtggctaccacactggacacatcagctgtagataagggagaaccactggaagatttaatcagcagcgtgggatgctttggtaagaggacgctgtcagcagtgcttgggatggattataggtgagaaacagtacaagcctaatgattggttaaaaaggtgctatcacaggttgggcgcagtggctcacgcctgtaattgcagcactttgggaggccgaggtgagcggatcacctgaggtcaggagttcaagaccagcctggcccacatggtgaaaccctgtctctactagaaaattacaaaaactagtcgggcatggtggcgggtgcctgtaatcccagctattcgggaggctgaggaaggagaatcacttgaacccgggaggtggaggttgcagtgagcccagatcacgccattgcataccagtctgagtgacagagcaagactccatcccaaaaaaaaaaaaaaaaaaaaaagttgctatcatgatctagtggaagctatccagggtctgagcaaggatggcatgaatggggacagcaaagacataggaaggggaaaagcactgtgaaatgagagttcacaggacttgactgacgtcatgaggaggatgaaaggagagaaaacagttgaggatgggggctattaggctagatataataaaataaaataattggtttatttctaaacataaaaactaattgttccccacatttgatagtatacagtttctagttagcttacttggttatataaacacactcttgattcctttcttacaaatgaaagagaaacaaaaataccatatactattaccgttactaaaaccctaagtagtctccaacttcccctcaaaaaaaacaaaaacaaaaacaaaaacaaaaaaatctggagaaagctgtaaaatactcatcaagaaatcattaaggctgggcgcagtggcgcatgcctgtaatcccaggactttgggaggccgaggcagacagatcacagggtcaggagatcgagaccatcctgcctaacacagtgaaaccccgtctctactaaaaatacaaaaaactagccgggcgtggtggcgggtgcctgcagtcccagctactcgggaggctgaggcaggagaatggcatgaacccgggagatagagcttgtagtgagctgagatggcgccactgcactccagcctgggcgacagagtgagagtctgtctcaaaaaaaaagagaattcattgaaactgtctactagtctggtagtttctccaaggcacagaccaagtctcatccacttctctctctccccactccctaaaaaggcagccatattacaggggcctctgtatgaaaccaggacaggtttgttgatctgaacaaaactacagaacaaccaaactgaacagttttctttttgcttttaatttttattttttccctatgttgctcaggctggtcttgaactcctgaccacaagcgatcctccctcctcgtcttcccaaaatgctgggattccaggcatgagccacagtactgagccagtctttttttttcccctttgcattatcatgtatagccatctttaaaactgtgatttaaaaaatgtctgaagagctcaagttgtattcttatcagttgccccctgagataattacagcttttattgctatgtcagtaacatgttgatataaacttggttttctcaatgaattttagccagttcctgaaataacatccctgaagaatattagggaaaagtaacaacacggcaaatctgctttgcttttgttgcaccacagagattgttttaggaataaacagaactttcagaaagaatccccagatatgattcagggagttaactcaaaagtgctctttaatccataaatataactaacgtcatttttcaaagcattaaactaagtgtgatatgaaaagctacacacagacaaacacacaaattaagtgaaaaaaatgctaatgctagtttaggtctagaggcatacaccggcgtaagaggcaattatgttttttgctgttgccattctaaccaacagactctaggggaaaaaaaggaagtgagaaaatgtttccatcccaaattgctagagaccgactcaagtatctggtgaagtgacaaaaatgtaatgggatgaatgacacctgatctttcccatcatttacctagatattcccaaggccagcgtgtgagcaagtcctccccgtgctcccccgacctcaagtagaaaggctctttctaggatgcacctccttacctcagacagcaggtgctgaatcacaactgtcaatgcctcaaacttggtattaccacaggcaagaagctgcttgagctgcaggataaatccactttggttttcacattttgttttatattgcgtcaattcaagtgttttctcagggggcagcgcatcgggagctgtctgtggctggatacataagcttcgaggattcttttgcctgctcttttcaactgcaaaacgaattaacataggtacaaagataggtgaggttaatttttaaaatcaccaccacaaggattcaaaaacaaccagataagccacagaaatccatttaagttatgttgctgtaaggaatgcatatggatgagaactggaatgaatcggagatctagacggttggaattcatgaacagggaccgtggcttcatttatgactttaaaagatttatggggaacagagaattaggaacatgacacaaatggatttggcaacccagaaacacaaaaactgggtgcaaaatgttgttctcctcgtttctcattttccagttaaattggtagagaaaccttgactgaagagaagcctgacttttctgatctcatatgctgaaaggaacacacaaatcactggactttaaattaaatgcctttctctcctcccatacattttctacaaatcttttaccttttccctgatgatggcctagccattacacagatttataccgcagatgagtcatttcctaatctctaataaatcataacatacatcgaaaatatactcagattttgcctctttaagttcactgttaggagtactatactgttgactatactattccattttctatcgaacacaagctttgttggtcttttttcccaagtagtaataacggcttacacagtttttttttaaagcacatgctaacactccaaatccacccaaaatgccacgctaagtgattattcccttcctgtgcaatggtgccctgggtattactctgttttaaataaaaaactgttcagtcttggaaccattccaaatgtgtcattttgaatatcaaacagaattggaaaaacaggacatcaattgcttaggttcttgaaataaacaagccaagtaatccaaacaaatgtaaatctggaaaaaagacacaagaaactaaaaaaaaaaaaaagtttccttattctaacagtctttcattacagcatccacgttctgtggtagcaaatctgaaacaacttttaaagaaatttagtaattactgtctctaatttttcaggaaaaggcaagctactacagtgattgcttaaagaaacatcagtactcactttctaagaacaaatggctaaatatattgaataaactaagttaaaaacagggaaaaaaaggctcttattttctatggctgcattacatggttaaataagtcatatttgtattaatacttgataattctcagttctaaaatcactaaaatatccattgtcccactgtgtctctgtaatacttgatgagaggaagtatttatccattactctttattattagcaattattagtagtagcttatgaataattgtcacttgcatagatgtagaaaatagccaagttaatatcgtaatattacagccctgaaggaagaacaaattattagttacatactaatgaaaaataatctaaatatttgaccatgagattagcattctttcatgtcatttcctaaatgtttttagaaattgtcacataacacataacaattccacagtgtttcgctcatcacagtgtgctctcactttccctttcttttcatcctcccaataaccccagatagggaagagaaggctcacaggtgtgaatgtcttccctggatgtagacaacttctatgggaatccagattcaaagtcagaacccaggcctctgatgctaagcctcttctgttcccacacattttggaaagcggattaggtggtgatgtaatatatgacatacataaaaataaatatttatgcaacaaatgtaataatatcttgctataatacatataagcccattatctgataactcattttaacaaacctacatataaacatctatgtgttatataactttataaacaaaaatgttcaaattctttcactatctagaatttactgtaacaaatatagacacagttcattctcctgatatcatttgtatatgtcctaccgaaacttacttaaaaattcatttattgataactcctttatcatttcctgagtcctgagtaacatttgcctctctttctagaatttctatgctaatcaacgctatttttaacacaatttcagagctttaaaactgttggtttataattatttacaaaatctgagaggtgagtcttttatattaatattttggagaaaatattcttcaagattcttgctttttgcttataaatccgtaacaaaaatatcacagaatacatgtaattgtactaacaatgtttacttttgaagggaaggtaataggaatcagacagctaaaaagtatcctgaagcattttttatactttttaaccatggggtaaatatattacctattcaaaagttaaatataagaagtaaataaaatcacttttaacagacagttaaagtgaaattcgaggacatacattttttatataatacttagctatgaaggaaatagtctatgcagaatttttccttggggaaactacacaggaatctaaacattacgcagggtttgtaagtgattactcaggatagctttatgattaaggaggaaagaacacattgatgtattcgtctaagagtacgtgtcttcaaattttaaaatgagagcaaatgagccaacagactgccctctccgtggcgctggaaactcgtgctgtgcagtcaccatcttccgctccatatactgtgctccctaaggatgaagtgtgaccgcatggcagccgatgacccagtttccacatgcttcccactctcagcactcctggctcagctgaagatcagagatgatgcaaaaatctccaatgacgctcaaaaccccaaggctcatcaatacgtacttcacagtactgaaaagccaggggttcccttaaatcctgcaggattcattactaacgtgaaattagcatattatcagccaaactttgcccttacccttgcttattagcatgttactgttttgataacaaaggttttatacagaagtataaattattttgtttactgtacctattaacagaacatgttctgattttaaagggccaatttaatcagaaaccttaaaattaaacgtcaacttctatatcgattcagatttatctcaacaagataattaccaccatcagctgtgatccagccttactgggactcattctaatgaaatggcagcctccatcaggaaaacgaaggccagaaccaaagacatttgctcatttggaaagcagctggatgaccctgttggctatctttgttctttctattcagaaacctcaatttaataagatttaaaactagtgcaatgaagtcatgtatcatcttcttaaagaaagtagttggttaatgaggaagatgcccatttctcaggctcaaatcacttaggcaaatagacctccaaatcccaagaccaaaaacaattttgagagaaaaacctaaccattaagacatggactaaccgtaaccacatactagcagctgaggacacattcattctaggctgaagaagccacacatttcctcaatctgctggcttttccaattattaaaatcaagttagagaccagacctactgagggagtttgccttgggttccgtgaaacacaaactaaacacagaatttggaaacgaacgttgtccacttttgtgtatactcactgacctactcactcactcatgaaatatatttattaaaatctaccatgagggcactgctgtggtgggtgtgcacctgccctggtgctttgcggggacaggagaagtatcacataagagggtggtattgctcagagaggcacaaagacaccaaagatctctgctgactcatgtttccctagtgctcagctcttcaactccaaatctcaacctatctgtaaaaaggtgacagtcactgactggatggtaagtcctttctacaacatattgcattaaaaaccgatgtttgtgggttgacaaaacataggttatgaactcagaagctagtgagaggtctctctctgctagcggcatggacagacagaaaattcccttttttctgccttaatctaatcgtacacatctaaaagccctcacagggacactgacacagaagttctttcagtcagtttccccagcatctggtggcaggtgcttatcctgcctatgcaatcttacatacagttttttaaagttaccattcatgtcaattattagtttatgtttgtataaagttttctagtgttcattagctgtttactctaaaagagttaacagtaataatttaggagacatatatttttctatttacatataatatttttctatttctaggtagacatggcatttactgaaaatggaaaattttaagctcagcaaagcacagtgtttagacatttagaattacccaagccaggccgggtgcggtggctcacacctgtaatcccaacattttgggaggccaaggcgggcagatcacaaagtcacgtgattgagaccattctggctaacacagtgaaaccccatctcgactaaaaatacaaaaagttagctgggtgtggtggcacctgcctgtactcccagctactcgggaggctgaggcaggagaatcacttgaatccgggaggtggaagttccagtgagccgagatcacgccactgcactccagcctgggtgacagagcaagactccgttctcaaaaacaaacaaacaaacaaacaaaaaaccccaagccaagcccaattatttgtagggggagggaggaggatttaggatgcctcaccatttaaacttttcattactatattggtagaattcgttgcaatagctcatattatatcaaaaagggttctacttcttttcttcacattaaaagcagattagagaatagaaagcatattcgagaatagaaagcatattcatataaaaaattcctgtttgggttaattacgcttataaaatttttcctgaagcaacagtccaaacttgccctaaactattttccatatagctggcaggaaaaaaccaaatttctcatactcttatgtacctaaaatggactcctaactcaaagaagagttaatataaattcaccacattcagaagtacttttaagaaggcattgcctctctcctatagcaaccaaaaaagcatggcactggtctaaaaatagacacatagatcagtggaagagaacagagaacccagaaataaagccacatgcttacagctaattgatctttgacaaagtcagcaaaaatacatacaatggggaaaggacaccctattcaataaatggtgctgggaaaattggaacagagaaactggagacctatctcttatcatatgcaaaaattaagacagatttaagacttaaacgtaagacctgaaaaaataaaaattcctgggtggggggagggaactagaaaaaactcttcacaacattggccgacgcaaggaattcatgactaagatctcaaaagcaaatgcagcaaaaacaaaaatagacaaatgggacttaaactaaaaaggttctgcacagtaaaagaaacagtcaacagaggaaacagacaacctatagaatgggagaaaatatttgcaaactatgcatttgacaaagatctaatattcagaatttacaaggaacgctagcaactagcaagaaaaaatacaaccccaataaaaaatgggcaaaggacatgaacagatgtttctcaaaagaagacacagaagcagccaacatatggaaaaagtagaacatacgaaaaaatgctcaacatcactaatcatcagagaaatgcaaatgaaaaccacgatgagataccatttcctatcagccagaacggctattaccaaaaagtcaaaaaaccacagatgttggcaaagatgtggagagaaggcaatgcttatacactgttggtgggactgtgaattagtacaatctctatggaaaacagtatggagattcctcaaagaactaaaaatagaactaccattcacccagcaatcccactgctgggtatcttcccaaaggaaaagaaaaacacagactatcttataacagaaatgaaaattaaaatagccaattaaaacattaaacattagaaatatttacaatacaaacaataaataaaaagagaacatcattctcaaaatactaaactgtcgacaagcaatttggaagaaacgtgcctaggactcaggtcaccagggagaaaaaaggcaaatctctcaccccaaaagaaagctctattactcttaattttccacagagccacataattgctgatgtttataaaaaggaccctcgtgtactaaaatgacccaaagtattgcctaagataaatacagaaatatgatattcaatattagatacctctaaaatcacacctgttgtgtttctaagaaaataatatgcatatactattaataaaatattattcttagctctgaaagaggctttaaagctcataaaaagcatcattacattaatttatagggtaattatctattaattaaccagaataaattgttctaacaaaacaagtatttacttatatacagcttgccatattcctccagtgtctcttgatgaaaaacactgctatccttcccattctgaatgcaactctaaaccgtaatttattacttactttccatttttgtgtaaaagtagatactacattaaaacataatttagtgtagtaaaactctagttatctgaaacttgtcaaattaggacatactgtccctttcaacatctcacttttaaaaacttatcaaaatcttacctattgtgagcaaaacttgccattcaacactttattgtcttcttcaattgaaagctgtaactacaaaagggcagatattcatgtcacggcaaagctacagctctaaaaccgccacagctaccgaagcttggaatcaatccacgacaaaacgttttcagcatcatgccattcatcacaccagttcttagcaaatgcttgtctatgtggcaagaggccagcaaaatctttcatgactgctttcaaggaggctgaaaggaagaatctggattcacagtaagataactaaggggcagtgaaagactacatctctcgttcttcttcaccttggtccttttgatttcttctacattctacaaatccctgaattttaccttttcacacgcaaatgctaatatatgtgtttttttttaatggaagctttctaatatggcttcattgacgtctacattttgtagtacgaaaaacacaagagaaattgaagtttacttactgtcaccttaacagtacatgaataaatgccctcctaatccataacacatccataaatgcgctaataacatattaagcatacaaaagccacatttaaagttgaacacattcttcccaatgtattttataactgaaaattcattcaagagatcaaaaatcaaatgttaagacttacgtccaaacgacaaaataacttgaaagtttaatggaaccattacacacaggtaatcaatgcccctccaaaacgcatagaatagagaaaaaatagcaaggcctgttgcaagatccaacttgttaaataatacactcccctcatttataatcggccaacatccgcttgagaaatacctgttctgccttctctgtggcagatattccaatagagctcttataacattttatacctgtctgtgggacagagactagagaagtcacacgctctatttcccagcctcccttccaggtcgagtcatgtgactaagacccggccaatgagacggaagcttaagcgacctggcaccaccccttcctcatttctttttcttccttcctggagcagctactgtgagatcatgaggcaacaatcatgaggacacggctaagaagacagcagagatgaggattcctgacacggcagagccaccgaacaacctcaaagctgcttttcttcaggtgagacaagttgcttcttagtgaagctgttaattccatctaaaaagagtcaaaagtgaataccaaatgcgagaacataatttgatgaatttcatcctaattaaacaaacgcattcacattctgcctgcctgttactgaacacttctttaaaacggttctcttcacgaacacaaagaagggaaacaacagatgggggtctaattgagggtgcagggtaggaggagggagaggagcagaaaacaataacttgggtgctgggcttaatacttgggtgatgaaatcatctgtacaataaactatttattgtacaagaatctgtacaataaactctgtgacatgagtttacctatataacaaacctttacatgtacccctgaacctaaaagttcaaaataaaataaaatggcaaaagtaaatggaaatattttgttctgatactacctctgccatccctcgatacgtacgtacacatgttcctcccttgcgctgcagtaatcacttttaatgtcactagctcagcagaaagaattctgtctttagcgtactgaattgccttcactggagtcaagaaggaaattaacctgtgaggttcaaatggcactcttcatagcaattaatacaagaatttccagcttcatagaaaaactgaatgctaagtggcagggaatatttcttagcaaagtcttttccctccactaactcattataaaaatagaactaatatgttgaggtagaattccgaaatagaccgagtttaatactttggtaaaaagactattgctgacccttctccatgtcagtgacgtcatcactggacttcttagattttcatctgtgcctaatgtcctgcaacatcacgcacagttcctgacaaattcactcttttcctcctctcccctgtttaaagaggaaagataacctcgatccaacaacacgctttgccagtgatggataccacccagtaataatatatcagagtgcccagtgccctctgcgtgggatcaatgagaaagcttattctggccggatctctacaatgaccagcccccgtcccaccacattctatgctcagaaatactacaactcctttgtttccttgaaggagcccttcctcaagcccctcaaggtttttacatgctgttttctctgtcggaaacactttgtttcttagtaaattctccatttcctgaggacccaacttaaaaggcacttctactggaggacctggattaaaggtacctccacctgctgagagctgcttgggcacaagtccacaccctgcattattaactggtgctctgtctccttctgttaaacagtgggctgtgtgaaggcagggtccatgtgggacttagtcccagtcatactttcagcacctaccattatgcctggtacacagtactcatctaacgggtacttctttatgaaacgaatgaattaatctgtaatgtgaaagacagtctagaagcaagggaaaggctggaggcacagaccaaatactaagctcttcagaaagcccagtcaacatcttaggctggattatacaaaactgttcctatttggctacttttgacttattatacaaaagtgttcatatttggccactttttacctattaattttttgtgtgtggttttttaaatagagacagggtctcattaactctccagggctggtctcaaactcctagccttaagtgattctcttcccttggcctcccaaagtactgggattataggtgtgagccagtggcaccagccaggaagagcagtttcaatgcttcaacatgataatgcctggactagggtaatggcaggtggtaaaaacaaatcaagatttcaaatgatggagtcttagagttttcaaccaattgattgtggataaatcaggacaagtaatgattcaaaggtgaggtttggccagacgtggtagctcatgtctgtaatcccagcactttgggaggctgaggcaggcgaattgcctgaggtcaggagttccagaccagtatggccaacatggtgaaaccccatctctattaaaaatacaaagaaattagccgggtatggtggtgggcacctgtaatcccagctactcgggaggctgaggcagcagaattgcttgaacctgggaggcggaggttgcagtgggcccagacagcaccagtgcactccagcctaggcaacagagcgagactccatctaaaacaaagcaacaaaaaaacaacaaaaaccaaaggtggggtttgatgaccagacacatggtgtcatgaaaagaaacagataattcatgagtattaactgaatttaggaggtaaaaaaataaggagacaaatcatttagataagatgaatttccaagcagagtaatacactgagggttttcaaatcttcagccagaaattcacagatttggaggctaaggggaacctggaagtcatctcttgtggttcccttattttgtagccgtgtgaggttaggtgcacagggctattcacttggtcaccagcagaatcaaggctacaatccaggcctcttgggatccaggtcaacaccactgcactgaggcaaccaacaccacttccttcactaaggataccaacccaagttactgctgacagtccattcagataagagtcaccatgacggcatgaattacccacttgacggacgatttctcggacgttaaaatgacataacatggataagcccatcaaagactgatattgggagtaagcagaattatattccttacatgattttaaaaagcctccaacacacaaaacgcttcctccatccctgctattccttggatctaacaaaattacagcaaaatttgcagctggaaaatatgtacgccaaaaattctaaatagaagtcccaggttttagtcctatctctggcacttactgtgtgcctctgggcaagcgaattcacttctctgggcctcagacttcctggtataagacagattagatcacctctatgtgaactctagctcaaaaaattatgactgcaaataaacagaaaatagttttacgtaagtttagaaaataaaatgtgtccaatacatcactatcaactaaaccctggtaatagaagccttgtgtcgtttgcttacgctgtcttggaaagctatctgcttcacaacaacactacagacaacttagaatgtctactactagagcactggttaagtaaatcatgacttacccaataatggaatgttacagaactattttttttaatgaggtagataaacatgtgatcacatgcaaatctaaaacacattaactttaaaaaggtatagaatatatagtacgcttttatttctgtataacaaaaaagaataaaaaagacctgcatagatttacatgtgactggaaacgtgcaagaacactatgcaagcagctgagagcggctgtctccacggagagcagacagggactctgggtaagagagaggcttgcctaggactgcacaaccttccatactgtttgatttttaacttggagcgtggattacagtatttttaaaagaactctttaaaattaaaagctatttggagctactttagatcagacaaattattgcaaatatagggcaccctttgttatttttcccccctattaatttgttcagttggaagggctgcagcggccctgagctgggagaggagggccactgctgacctcctcctcgctgcctccccccatttaccgtcagctcagactgaaagggagaggctggcaaaatcaaatgacaggtcaaggggagttatgaaacacgagagagaggtgctggaaaaaatgagaattctcccacagagaagggagatgcctctgggaaaactaaaaatagtcagctgaaaacaaatcaccagggacagagatgagccacgtggaaaataagaaacacgaggggtcacgtgcacatgaagcagaaacaaaaatctatttacatcctcatcaaacattcctgtgacacctaacgctattcagcccaaaacaaatataaaaacaccccagctaacatattttacagaataaaactgatttaatttactgtagctgtaaaatcatctaggacaaaagtagcaacataggccaacccaatgccctaaaagtgagcagacaggtcaccacgtgcctaaaatatatactaaatttattttcatcttaggcaccgaaaataataagcagatacaaacataaacctcaggggaagtattttgagactgcacacacttttattatgaagattggaaaactagatttgtgattcacttactacttccccataaccattaggatgttttctgtcagaagtgtttagtatacagaaatcttttagcatattaaaattaactgtcaaatctgactgagaaactatccaatgaaaaacgatgggaaccttctcatctacacaggcgaacaggaaatattcttctaaatttacctgtgtcctatttcccaaacactggaactaaaatataatttaacaggtgctgattttcacacatttggctggtgatggagaaaagagctagggaacaccaaggcaacaattctgccttccatcaacacaaacaacacaatctgctgccaaaagtaaaagtactatgcacttgtgctgaagcaacagaaaacaatttttaaattaagcctcatctctcattagagagagcttttttcctccaattatctgtctccttggaaaaacctctgataaacatctgcaaattaatgaagacatcccccgtgcaacactaaacagagatctatgcgagacagacctgtgtggaaaacaacagtgcttctcctaaaccctgaaggaagtcgaaggtttcgaagcaatcctttggccgtcagtcgtatgtgaatggtggataaggagaatttgggagacaacaacatgtcttcggagcaggtggcgagatttcacagaagaggcaatttccatggactgtcacatactgtctttttaaactcagtactcttcaaggccaagaaatacagtcagaggaaagatgcctacacagcaaatgtcattccaccagagaggcatagaagaaaaaaatcccccagggctggccaagtgtttctggcttccgttttcactttcagatgttgccaaaatgatgctcttcctctgaatacaatctccctcctgcaggtctagaagctgcctctgaaccacatcacactgtgcatgcttgtggagttgttatggttttcatccgagatggtaaaggggaggagaaagtgggtggtctc

SEQ ID NO: 1627 - DNA, 43576 bp, Homo sapiens
gcggagcgcgggaggccagttgggaggcgcacatccggcggttacccggtgcttcataaagccgctttcgccgctggctgtcgccgcgttttgcctccgcagcagctctgggctcttctcagctgcgcgagcagctgctccaatgccccggagtggccatgggcgccccgcactggtgggaccagctgcaggctggtagctcggaggtggactggtgcgaggacaactacaccatcgtgcctgctatcgccgagttctacaacacggtgcggggcgcgggagcggggaaggcaggcgggccagcgggagggggctgttcccgcgccgcagcgtctggaagctggacgtgggtctctgcgcgcatctgggggcattctctccaggggctgagtcagtccacaccccctcctcggcgcgctcctttcagttctccatctgtcctcctctcctgtccccattcccgacagctgggctcatcttcctcctgctgtcatttgttttgtgatggtcctattgtcttgtttggcccccacgcgtccaggaaccaggggtctgtgtcagcccattctccttgtttgggtcagctgggggcggtgaacctgccgggacaagtctcttcctcccctgggatctctgtggcgtgacgcacttgggtcgcattgtgcttttttgccctgaatacctgctctcggagtgctgggaagagcacgccccccgcaggtccccgcggctggggtcactcccaccaggcagacttgccccacccccaagaacatgcctataatggtcgagttatttttggtcagaatcaagttaattactacttgtttttttttcttgcctttagtgtcctgtcttgtgcaagccgctaattcaactcccccaggactgtgctttctccagttctgaagtctgagggatgaaaggaaagtttgggagtgataatgtgcgggttttggatttgcctaggtccctagataagggtgagcagaaacttccccattgcagaatcctgtgtgattttagttcttgtggtagggaagggttgcagctgggagaggaaatgcctcttattttgtgtatgtccatggctcagaatcctggtacagaatgtgagactttgcgtggtcatttctgtggcttatcttttcaccgcccaaacaagggaaacaggaactcctggtttgggtcattgtgaatttgaggttgttgtttaggacttttccttttggatttgctagagagaatgtcttcagcaggagtcaggtgcttactgcctgcaggaatctcagatgatctagtccctgtccttttattcatctgatgagaaaactgggctcttgaggagggagctgtcatgctcacatttctggcatggctggggccacaatccagaagtctgggcccttccttccctcagtgctgaaatccatggctggcttccacacaaacactcctgctcctttttttatgattaggttggttccttaagaaaacctaaggctgggcgttgtggctcacacctgtattcctagcactttgggaggccaaggcaggtggatcgcttgaatccaggagttcgagaccaacctgggcaacatggcgaaacctcatctctacaaaaaaatacaaaaattagctggacatgtggcacacacttgtcgtcccagctacttgggaagctgaggtgggaggatcacctgagcctgggagttgaaggctgcaatgaactgagatcgcgccactccactccagcctgggcaacagggtctcaaagaaaacctggccctctgctgaccacagatactgtgaaagacagtggaagtggccatgacttatgtattgcataacctcccagagcatgctgtcaggggtaaatagttgcacacagaggatgggctggagtagttctgggtactttcaataaggagaaacaccagtggtaacacaagctgtccttttgtaaataaagaatatagtgaaagagtaaggatttcaccagagttcaagaagaaaagacagcttgatgacaggttctcacacacttagcaagattattctctgtgcagcctggggtctacagagagggtcaaccttggttattttggccaaaaaagctagtgtatggcttctctgagtctgtcttgaaaagtgtcatagggctggatgaaagggagagtttgtctttacttttaatctagtcccattggagccgttactctatgtagtgagtgctaaagtctttttcagaaactaactgttgatcttcagctgcattgtctggctgatgagcccagctggcccatctgacaaactttattccttggaatactcataaaccacaaaatttgctctggcaaagcagagagcgtaaggtgtcagagaataaggtcattgcctaactttgttgagtgtaggtccaaagaatttagcaaaaaacgtttcttcccctctgttgctatttaaaaaaatttttttttgagatgatcatgctctgttccaggcttgagtgctgtggtgcgatcttggctcactgcgacctccacctccaggttcaagcgatcctcccaaagtgctgggattacaggcgtgagtcaccatgcccggccttcttcccctgtgttcttacgtactacttatattttgatgcttatcacaggacattcccatgcttatcttactcctgtgttgagaaagacagtagactgttatgtggtgataaatatcgtcttaaatcctcataataaggcaacaggtctaattacccagtttataggaaactcataatcattaccagttttgagaaaaagttggaggaattgacaatgttaaatcaggagaagaccgggagagggatctagaaccttcttaatgggtcttaggggtagcacatcactactacaccttcagatactactgtctaccattacttaattgctatgtgttgaagctctgctgggtactgtatactcattctagacaatgggtgctatttattatatccatttgataaagatggaaattggggcctagagagtttatgtaacttgctgtggtcaagagcatagcacagctgaagtcagaacttggtccatttgactctaccaagagagttatcttgaagctataagtgccactgtaactaacttagatttatctatttggcatagaatagatatttattatttagtcattccataacttaaaactcctgtcttgggatcattttatctctaggataaaactcatactttttgataggaaaaaagtttatttaaagtagtttgtaaaattactgtttattgtaaaagtaatatgatcatggtaaaaaatttagagtatgtaagttgtagagtgaaaaataaccttctgtatctttctagatattttctaggcatataaaaagcacatgtatctgtgtgcatataaaatacgcatgtataaggctgggggcagtggctcatgcctgtaatctcagcactttgggaggctgaggcaggcagatcatttgaggtcaggagtttgagaccaacctggccaacatggtgaaacctcatctctactaaaaatacaaaaatttagctggttgtggtggtgcgtgcctgtaagtccccgctactcaggaggctgaggcagaagaatagcttgaacctgggaggtgaaggttgcagtaagctgagatcgcgccactgcacactctagcctgggcaacagagcaagattctgtctcaaaaaaaaaaaaaaaaaaaccagcatgtatggcgtaatcacgaatacttgaagtttttttccaagatggtactgtgtaaactcttatgtaccttgtgtttttcacttaatatgtcttggagatatttccatatcagctcatatagtgctctcttcctgtttataatgtttatacagtactccctttaatggattgatcataatttatttatctaatcaatccttattgatggacatttcatatagtttctctctgttttattgttttcattttggtttttgaacagtgattcagtgaatatcctcattcatgcatctggatgtactttcgcaagcactaatcttagatggggattgctgtgtcaaggaggatattcagtttaaatgctgataattattgtgaaatggcacactaaagagagtgcactgatttgacttccactgacaatgtttgggcatacaaaacattttgctttggcctctgcaaatttctgttgcctcaaattgtatcatcctttgcttcagccaagcctaatatctcttccatgaacatgtaatttcctttcacagccttttacttgtgcacattttatactgtttcttctatatacaaattttattaattgagttcctttttatgttttaagatttaagaccccctggctgggcgcggtggctcacgcctgtaatcccagcactttgggaggctgaagtgggaggatcacttgaggtcaggagtttgagaccagcctggccaacacggcgaaaccccatctttaccaaaaatacaaaaaactagccaagtgtggtggtgtgtgcctgtagtcccagctactagggaggctgaggcaggagaattgcttgaacctgggaggtggaggttgcagtgagccaagatgaggccactgcattccagcctgggtgacagagcaagattccatcttaaggaaaaaaaaaaaaaaaagaaaatatttaaggccccagtcacatagacctagccactttggagaaaagccgggtctgccttttacctgagcttggcctttggggactctgttgctcagcagggacttgaggacagaagaaagtcaactgatcgctgaaaagaatcttgaagcaaaatacatgcataaaatcagctcatgatctgtcacttcctgctctgtccccagtcatcaagataaatagagctctcgttatatgccaagtcctaagtcccgctctcttcaggctgaatctatcggtcgatccatcaatctgagcatttgctgggcaacaactgtgtgcttattccagagaccagctctgtaaatagtcatatgggtggtgagggctatgatagaggtgtgtacaagccgctgagggtgtttttagtactgtgcatgggattgatgtactgtgaggatagggtggtggttttgcaagaaggcttctgaatagagtgaccaaacttgtcctgggtttttgcctgagacttttctgattttaaaactgaacgtcccatgccttgggaagccccctcagtcccaagcaaaccacgacagttggtcatcccaggggcagaagtaaaacaatggaatgggtagttaggaatcagcacacaattaagatggacagacaatccactcagccagggtaaaagtcctcagctgtttatgaacctgctgtccagaatatgtacagcctgttgttttgtctttatttaccctctgtctggaaagtgcacattcagatgcatcaggatgagactgcagtatgttcatgagattattttgtagcaaatgttatgtggaaattcatagaatgaagaactttctaaggaaataatacattttaaaaattgtgggctaggcgcagtggctcacacctctaatcctagtactttaggaggctgaggctggcagatcacttgagcccaggctgaggctggcagatcacttgagaccagcctgagccacatggcaaaaccctaccctgtctctacaaaaaatgtgaaaattagctggacatgatggcacatgcctgtggtcccagttactcaggaggctgagatcaaggctgcagtgagctgtgagcatgctataatctaacaataggctttaaaatgtactccttgagaggcggagcatgcagtgagccaagatcgcgccactgcactccaacctggctgacagagcgagactccgcctcaaaaaaaaaaaaaaaaattgtagcccttgagtgcactattctacaatttcagcgaccaatacaattttgagggatacatctcagtagagatggatccatgagtccatttttaaaccatgactgatttgcttttttgtatttcttttggtgttccttcatctttttctcttggggaaagtctcccactaatttgttcttttcctttccatatgttgacgtctttaaaaggtacagtgggggccagccagccttggtagatgggctaggcagaagaataatgtaatttcagtattatttgaagcatatggcaaaatagtgcttctaaatggtgcttctaatatgcacatttaaagaaactgtttgggccaggtgtggtggcttatgcctgtaatcccagcactttgggaggctgaggtgggctgatcacttgaggtcaggagttcaagaccagcctggccaacatggtgaaacctcgtctctactgaaaatacaaaaaattagatgggcatgatggcacttacctgtagtcccagctacttgaggagaggctgaatcaggagaatcgcttgaacctgggaggcggaggttgcagttagccaagatttcgccactgtactctagcctgggtgacagagtgagactccatctcaataaataaataaataaataaataaacaaataaataaataaaaattaaaaattaaaaaaaagttttacatatcataattttgctgtaggtgtgataaatgacttcatgcctttgcaaataatatataaatacatttaaaagtgattagtgtgtccattgctggtggaaatataacccaagaaagccattgcgggacagcttgggagtagatagttgcacttagcagaagcaaggtagattgagaggacttgaggcactaaagatcttctggggtagaaatcgcaatgcattatatttctcaacattataagtgggactgtaaattggtgctccttccactggaaaatggctaaactgctcccatctgcctcacttacagcaagtgagctaaatctttattatctaggatgaaaaggtttgcagtgcatattgttgaaggagaaaaggaagctgcacgatgggaatgttaacaatatgtgacatatacgtacctattcatgtaaatgtgaagaaaatgaggacagtggttatctctggggaagaggctagaaaggaaactttattccttttttttttttttacaagaacacattcatgtatatgaagggagaaagatcaggttttaagttacctatggtataacaattccatttttcttctcctctttcttcactcccttgatccgccttcatctgctccttctccccattcatctccttttcttccttttattgctagtttaacaagaggaaagccatgtttacatcaaagccaagaaactggtcatatgtgcacagtgtgtgatgcacagtgggtgatgtgattcacaatttttagatgctagtggaggagttaagccaaggaggtcagaatgtggttgaatgagttggggttgaaaatcagctgggagcagtggaaggagccgggctctgtgcagattggctctctgacttgagccagccctggagcctttcagggccctcagctatatccctttgtaaaacaagggatggtttttatttatttttattttttattttattatattttatttttttgagactcttgtcgcccaggctggagtgcaatggtgtgatctcggcttactgcaacctccgcctcccgggtccaagtgattctcctgccttagcctcccgagtaggtgggattacaggcgcccgccaccatgcccagctaattttttttttttgtacttttagtagagacagggttttgccatgttggccaggctggtctcaaactcctgacttcaggtgatccacctgcctcagcctcccaaaatgctgggattacaggcgtgagccacccgtgccccgcctaagggatggtttttaagatccttcttaaaataatccttttttaaaagaccctcttaagggtctttgattcttaaatgattccactgaaagttaagtcaaattatctctgtttgcagatgacatgattgtatgtttagaaaatcccatcctctcagcccaaaaactccttaagctgataagcatctccagcaaagtctcaggatacaaaatcattgtgtaaaaatcacaagcattcctatacaccaataatagacagagaggcaaatcacaagtgaactcccattcacaattgctacaaagagaataaaatacctaggaatacaacttacaaaggatatgaaggacctcttcaaggagaactacaaaccactgctcaaggaaataatagaggacacaaacaaatggaagaatattccatgctcatggaaaggaagaatcaaaatcatgaaaatggccatactgcccaaggtaatttatagattcagtgctatccccatcaagctaccattaactttttttcacagaattagaaacaactactttaaatttcatatggaaacaaaaagcccacattgccaaggcattcctaagccaaaagaacaaagctggaggcatcacgctacctgacttcatactacaaggctatggtaaccaaaacagcatggtacttgtaccaaaatagatatatagaccaatggaacagaacagaggcctcagaaataatgtcacacatctacaaccatctgatctttgacaaacctgacaaaaacaagcaatggggaaaggattccctattaataaatggtgttaggaaaactagctagccataatcagaaaactgaaacttccttacaccttatacaaaaattaactcaagatgaattaaagacttaaacataagacctaaaaccatgaaaaccctagaaggaaacctaggctataccattcaggacatatgcatgggcaaagacttcatgactaaaacaccaagagcaatgggaacaaaagccaaaattgacaaatgagctctaattaaactaaagagcttctgcacagcaaaagaaactatcatcaggttgaacagttaacctacagaataggagaaaatttttgctatctatccatctgacaaagggctaaatctacaaggaacttaaacaaatttacaagaaaaaaaacaaccccatcaaaaagtgggcaaaggatatgaacagacacttctcaaaagaagacatttatgtggcctacaaacatatgaaaaaagctcatcatcactggtcattagagaaatgcaaatcaaaaccacaatgagataccatctcatgccagttagaatggcgatcattaaaaagtcaggaaacaacagatgctagagaggatgtggagaaataggaacacttttacactgttggtgggagtgtaaattagttcaaccattgtggaagacagtgtggcgattcctcaacaatctggaactagaaataccatttgacccagcaatgccattactaggtatatacccaaaggattataaatcattctactataaagacacatgcacaagtatgtttattgcagcactgttcacaatagcaaagacttggaaccaacccaaatgcccatcagtgatagactggataaagaaaatgtggcacatacacaccatggaatagtatgcagccacaaaaaaggatgagttcatgtcctttgcagggacatggatgaagctggaaaccattattctcagcaaactaacacaggaacagaaaaccaaacactgtatgttctcactcataagtgggagtggaacgagaacacatggacacagggagggaaacatcacacaccggggccttttgaggggtagagggctaggggagggatagcattaggagaaatacctaatgtagatgatgggttgatgggtgcagtaaaccaccatggcacgtgtatagctatgtaacaaacctgcacgttctgcacatatatcccagaacttaaagtgtaattaaaaaaagaagaaagaaagttaagggctttgatcataacaatgaataaaagcctactgctggccgggtgcggtggcctgtgcctgtaatcccagcactttgggaggccgaggagggtggatcacctgaggtcagcagttccagaccagcctgaccaacatggtgaaaccccatctctactataaaaatagaaaaaaattagctgggcatggtggctcatgcctgtaatcccagctacttggaaggctgaggcaggagaattgcttgaacccaggaggcggaggttgcagtgagccgagatcgcaccattgtacttcagcctgggcaacaagagcaaaactccatctcaaaaacaaaacaaaacaaaacctactgcatatacagtatagtacttagatccttgtcctgattcctccatgcctgcttcttggtaaatgaaaattgaccacatttcttttctttttctttttttcttttcattgatctaagaaaaattggccacatttctcagactggtgactgtataccacctgggacgtctcagacaacttgtccatattcttacccaaggtcactagtcgcacatagcactcctatgtgggaaggagagaaagatccgcaacaaagtgaaccaactaaaggctgagcatgggagctcacacctgtaatcctggcactgttaaagattgaggcaggcggatcacttgaggtcaggagttgaagaccagcctggccaacgtgatgaaactctgtctctactaaaaatacaaaaattagccaggagtggcaggcgcctgtaatcccagctactctggaggctgaggcaggagaattgcttgaagccaggaggcggacattacagtaaggtgagatcgtgccgttgcactccagcctggactagtgacagagtgagactccatctcaaaacaaagcaaaacaaaaacaaagtgaaccaactagaaaaaggtacccctttctccataatgatacagccccacttaggtatttcagacctggattttaaccaaaggtaacagctctgctcccattctgcccctgaccaaggatctttttctcctcctttgacttgcatttctctcccacccatctttctcccgtttctaaaaagtgtcatgcttacccgctctcctccccagatggtggcagaggcaggcattggtccttgaagctgccagtcctcacttgccctatgcctcaagttctggggtttgctgaagcattctatttagttgtgtaccagtgtggtttcttaggtctggtaaagctctttggccctgctcacttcagttctgttcaggtgcccaccatcatggttctttgagacgtcctctaagtgaccattgtgtattgtccaacatgagtaaccgctcttttcttctgaaagccctgtgcccttggctttgcacagttcatcaaccctattcacctatttttgaatgtgatttttgtttgtgtttagtccaggacccctcccaccccatcccgatgggtgttactcatgtagacttagctgtcatcttcacattcgacatacttcttctctgtgctcagtcctgtacaaggagcccctcactccacaattagagatgagacttaaaagctgaatgttcctaccgcttcatatcttctaaaatagcttaatttaaaaacaaaagaatataacaagtgttggcaaggatgtgagaaattggaacactgtacattgctgatgggaatataaaaatgctgctgtgggaaaatgtttggtggttccttaaaaagttaaaaatggaattagtacaccagctagtgccttagtccgttcatgctgctataacaaaagatcttagactgggtaatttataataacagaaattcatttcttacagttctagaggctggaaggtccaagatcaaggtggcagcaggttgggggtctggcaagggctccctgcttcaaagacggagtatatgctacaccctcacatggtgggaagggtgaatacctccctcagacctctgttagaagagcgctaatccaatttaacacctccaaaggcctcacctcttagtacagttgtgtgatggggatacgttctgagaaatgtattgtcaggagattttgtcattctataacattatagaccatacttacacaaatctagatggtatagctttgtacacacccaggccatatggtatggcctattgctcataggctataaacctgtacaacctgttactgtactggacactgtaggcaactgtaacacaacagtaaatatttgtgtatttaagcatatctaaacctggaaaagtatcaggaaaaatgtggcataaaagctccattataatatgggtccactgtcatatgtgtggctcattgttgactgaaatgtcattttgttgcaaataatgatactatcacattgatgattaagttttaacatatgaattttgtgtgtgggggtgacacattcagaccatagtacccagcaacaattaatgtatgaatagacaaaataaatgtagtatatcctttcaatggaatgttatccaaccataaaaaagaataagttactggtatatgctgtaatatggatgaaccttaaaaacattatgctaaatgaaaaaataagctagatacaaaaggacatatattgtatgattccatttatgttatgtgaaatatttagaatagataaaatcataaagacaaaaggcagattggtgaatgccaggggctgagggagggagaaatgaggagtgactgcttaatgagaatagtgtttctttttggggtgatgaaaacattttggaactagatagaggtgatggttgcccattatgaaatgtactaaatgccactgaattgtacactttaaaatggttagttttatggtatgtgaattttacctcaattttttaaagttcagaaaaaaaaagctttgagtctgtgaaacaaacaaaccccaaaatcaaccaaacaaaaagtaagttaaaaaaattagggatgagtttccaatatgacagtcactggccacatttagttggctgttgagcacaggaaatgtgcctagcccaaactgaggcttgttgtgagtgtgaaatttacactgatcttcaaggctttggtatgaacaaaataatgtaaactaggctggacgcggtgactcatgcctataatcccagcattttgggaggctgaggcaggaggattgcttgaggccagcagtgtgagatcagcctgggcaacatagtgagaccaccatctctaccaaaaaaaaaaaaaaattataataataaataaagccaggcatggtggtgcatgcctgtaatcctagctattcaagaggctgaggcaggaggctcccttaagcctggaagtaggaggctgcagcaagctggtcccaccactacactctagcctggttgacagagtaataccctgtctctaagaaaaaaaaaaagtaaactatctcattaatgatatttaatagtgattacatgttcaaatgacaatattttgaatacattgcattaaataagatagattattaaaatttttaaaaagttgaatgcccatggagacataacagagaggcttaaatccataccaaaatctgcaagataaaataatatcattttaaagctgggaagaaactttcaaatataatctttacttaaaaataggttttggttaggatgggaaagctgacaaagggcaacgaagggggaaactagaaagagtcctcgctttgtgtaggcacaggggaaaaggctggcttggctggggaggattattgggagctggacaatgtccagtcttttttacgccttcattaaacttttttttttttttaaccattatttaatacagaccttatctttaaaaacacaaaagcaggcgggcgcagtggctcatgcctataatcccagaactttgggaggcctgagacgagtggatcacctgaggtcaggagtttgagaccagcctggccaacatggtgaaaccccgtctctactaaaaatacaaaaattagctgggtgtggtggtgagcgcctgtaatcccaactactcgggaggctgaggcaggagaatcgcttgaacctgggaggcagaagttgcagtgagctgagactgcaccaaagaactccagcctgggctgtaagaaagaaactctgtctcaaaaaaaaaaaaaaaaaaagtaaatggagccaggcatggtggcatgtacctagtcccagctacttgggaggctgtggtgggaggatcacttcagtccagcctggaaaacatagctagaccatgtctcttaaaaaaggattgtgaaaaaaataagtgcaagtaaattagaatgattcataattaaccttgcaataagaattactggttaattcttatttaattcttagttaataagaataagagaggagcttgggcagcatccatagactgcagtgtttttatagctactcctatgatcaaagaagcagcagggagcctcttaaatggtcatttaaaaagctttaagttctcctgattgtatatctgtagtcaaaagaagtgtcagaggctgggtgtggtggcttatgcctgcaatcccagcacgttgggaggctgaagcaggcagatcacctgaggttgggagttccgagaccagcccggccaacatggtgaaacctcatcttactaaaaatacaaagatgagccaggtatggtggtgggtgcctgtaatcccagctactcaggaggctgaggcaggggaattgcttgaactcgggaggtagaggttgcagtgagccaagatcgtaccactgcatttcagccttccagcctgggtgacagagtgagactccatctcaaagagaaaagaaaaagaaaaagtgcaagagcttaaacgagatgtgtgaccacatttatcccagtttgcaaggacatacttggaagaggccactttattttttgccctttttacttaatactcatctttctgttttacatttttttcctgcagatcagcaatgtcttatttttcattttaccgcccatctgcatgtgcttgtttcgtcagtatgcaacatgcttcaacagtggcatctacttaatctggactcttttggttgtagtgggtaagtggagtcatttgggaacacggacttaatggggtggtgggatgggggtagaaggaattccacacacttcctctcccctttgaacataatgttttgtaaactgaagtcactctgaggtcttagcaaacttttttttcccacttgcttgaatgcaggcttgataacaaagttggcattactgtcacttgcgtgcatttgagacttcatttgtgtagtagctattagggctatgccagtgcaattttctgaacgtctgaagaaagtcaggtgaaacaactgaactctggggaggctggtttctaatggactaaaattaaagaaaaaaatgtagatgtttgatccctcattgttttgtgaaatacttgtgtcatttccatttcctcccacaggcagcctgggaattcttaacagtgaaggaatgttgacttttatttactgcctcttcccagaaaggctcagtggatgaagacagaatgcgtttaactgtggaattgttaaagttctgatgtgctgatatttgggccctagttgaaatcttctttctagactggaggcatgcatgcttgggtggtgtgagtttctttcttcagtttcttttttcagagagagagtgatctggtgactgtgttaaccattggtgaaaggactatccttaagcagtgtattgaatttgtgtctcttctgtggtgacctttttttattggttgtaattgattctaggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggtaagcttgcactaaacattattgcatttaccactaggtgcagtacccaatataacaatgtatatatgaagaaaaatagcacatgattgaactcagcctagtgatgagcttatcatatacttgttcaatatctactgattgtttttatgatctgacaatataagtaaactgacagattaaagagagaattttaataatgcagagtgcatcacctctctgtacccaaagtacatcacctctctgtacccagtggtttaagaattagcaagagtggaaagaccttcagtgggggtgacattactgaatgcttattcaatactctttgattttctgctacaacatttccttgagactaatccaactccaccagttttatacatatgaagtagaatccagactgatgaactggttcttggagctacagatactgtagttttcaagttgcctttttttttgcttcagatgagagctgtgcacctgcgtgcgtgcgcgtgcacacacacacatacacactcatatactgtatatatgttcaaactggaaacccagaatttcaggaagggatgcattttaatagccattgtgttagggttatacaggtattcatccagcaaatatttttgaacacttatattttactgtgcattttgctaggcactggaatatcacagtaaacaaaacagcagtcttcctctaatgagcttacactgaagttggggagattacaaatcaacaaacaagtaaataatataatattaggatatgttaggtactgtgatgaaaagtgaagctgataagggtatagtggtgacttagggtgctgatttagagtttggtcagagaaagtctttctgaggagctgtgtgaggtttgttactatctagaggcacagaggagattcagcccaatgaagatgagaaacgctcctggaacacattacccacattttctgtaggacactgttttgtcaaaatatacatatatggctaaatagtctgaaactatggattcagtgaagcaaacggtatgtgcccatggaagagttataccaggaaaagaaaataattcattacagttttactggcactctgaaaaggaacaggagctgtgaagctgctgaggactaaggctgctgctatctgtggactcaaatggagaagcgtctatgaaaaatgctggctgcaaggggcacattatataattctatgtgtgatatcctaattttagaatgaatgaactaaactctttctgagtatgtttttgtattagcacaaaaatgcctgggaggtgaggacacctaactacagccattggctgttcttgggcattgccagcagagaggaacagccgcttttacctttcatctgaactggttgactttttttttaaaaaaaaaaaaacaaaattaacacattaatctctttctttctttctctttctttctttctttttctgtctttctttctctttctttctttctttttctttctttctgtctttgtctttctccctctctttctctctctctctctctctctctctctctctctcctcctttcccttcccctcctttcccctcccttccccttcccctcctgtcttgaaagatacccaccagtcaccatgatgctttctctaaacctggtgtacgttagattgagagctgaggaatcgcttttctcagatatcttatttttcaagtctgagtaagaaattgaagaaatgggaataaacgttttgtgtatttgtttgtgacattcttgaggcctgggttgaaattccaagggacagtttttaatgtattccttatagaaaaccttttttttcttttcttttcttgattcttggaggtagggggaaagttgtttgagcaggaaagaagaaaatggggtgatgacattggtagttaaagcttaccaactttaataatgaaaacagagccagttggggtggtgcacgcctgtagtcccagccactcaaaaagctgaggcaggaagatctcttgagcccagcgtgggcaacacagtgaaaccccattaaaaaaatagaaaaaaaataatgaaagcatattgtgaggcagagttgtctgtgactattgggactttttcatcaccagcagcctgcagcatttctctggggaagatgtgaagatatagccactctgtcctcctttggaggcactgggtaccatatgtgtatatatccctggctttggaagcaatctgggtttgaatcctagctttacaacttgcagactgtatgacttgtcttgactctttctatttccctatctgtaaaattaggtaaacaatagtgttcatctttgagacgatcctgtagggcacttagcataatactaagcaacatggagagggctcagtcaaagttagctctcctgactgcctggggcatggagaggagagttctgcctagcatttctgagatatgcatacaaatcgatggagataatgtacattgacaattttaatgagcaaagaaataaaaggtacatgttaagggaaaagtaaaaaaggatttcaagtctatttgcacatcttcaattttccagtgaccagggagggcaagaaggccaagcccctttgcttgtacttcactccccatgacacgggacaggtggcagctctgcagtggaagtggcagaccagaccaaaaaattcatgtcaaaaccaggatttctgtagatcagggatttccggtttttctgcctgaacttaccaaatagtaaacgtttatctccttttctttctttctcccttccctccctccccccctcctttcttttctcttctcttctcttctcttctcttttctttcttttctctgagacggactgtctctctgttgcccaggctggagtgctgtggcacaatctggtctcactgcaagctccacttcctatgttcacgccattctcctgcctcagcctcccgagtagctgggactacaggcgcccgccaccacgcctggctaattttttgtatttttagtagagatggggtttcaccatgttagccaggatggtctcgatctcctgcccttgtgatctgcccacattggcctcccaaagtgctgggattacaggtgtgagccatcatgcccttcctttcctttcctttttcctttttcctttcctttcctttttcctttttcctttcctttcctttcctttcctttcctttcctttcctttcctttcctttcctttcctttcctttccttctctctctctctctctttctttctctttcttttcttttctttttttcttgatctagactttgctggaatattcttttttgtttcattttgttttttctttttttgagacagagtttcactcttattgcccgggctggagtgcaatagtacgatctcggctcactgcaacctctgcctcccaggttcaagtgattctcctgcctcagcctcccgagtcgctgggattccaggtgcatgtcaccacatgtggctaatttttgtatttttagtagagacggggttttgccatgttggccaggctggtctcgaactcctcacctcaggtgatctgcctgccttggcctcccaaagtactgggattacaggtatgagccaccatatctggcctttgctggaatattctaaacacacattaaaaacagttttaatgtgagatttttggagaagagacaggagagtgtggtggctaagtaagtttggatcagacaacatggctttgaataacaattaacctaaaaaaaaaaggctctgggaccctgttttgcttgtctataaattggagatgacaaaagtatcttcctgatgggatcagaaatacatgggaaaattacgtaaggcctatagtacaatggctcacacagagtaaagactcagtaagttctggtggttattatgaatggcttatggacaagtgggtttttttttttttttttttttttttttttttgagatgaagtcttgctctgtcacccaggctagagagcggtggtgcgatcttggctgactacaacctctgcctcctgggttcaaatgattctcctgcctcagcctcccaagtagctagaattacaggcacttgccaccatgcccagctaatttttgtatttttagtagagacagggtttcaccaggttggccaggctggtctcgaactcctgacctcatgatccgctcgcctcggcctcccaaagtgctgggattacaggcatgagccactgtgcctggcctgaattttttattgatatgtaatagttgtacatattttatgtagggaaattattaatgttcattatgtcaataggatataaatgttgggtttatagaaaaaaactttctttcatcttgcctaaaatgtcctgagactctttaggacatatactgaattgctgatggttattaataatttttagagtttttattttaagaaaaaaatgagaacaaggaactattataggctaattgtatctactttttttgttttgttttttggagacaggatctcactctgttgcccaggctggagtgcagtggcacagtcatggctcactgcaacctctgcttcctgcgctcaagtgatcctcctacctcagccttccaagtggctgggaccacagctgcctgtcactgcacctggctaatttttgtattttttgtagagacaaggttttaccatgttgcccaggctggtctcaaactcctgggctcaagagatactcccaccttggcctcccaaagttctgggataacaggcatgagccactgtgcccaaccttgtatccacttcttaaataatttattctgctatagtttttatgattttatctttagataaaatccactttattttttgaatcttgaatagcaagggagcagtctgggatctgcccgccctgctagcattcttcctggatgagttgaggctggaatcttaaactctctgggccttagtgctttagttataaaataacagggttgaagtagctctctgaggtccgtttcatgaccaaatgctatattgctgtaactatcaagggctggctgttctaaatagattatgttttggtagcttatagcagtggatcttaaccagggacatttccagttcttatgagacatttataaagcttgtggacatgtttttggtggtcattacgatgggaggttttatcatctataaatttcatttcatttcagaaatgaaatgaaattatcactgctttaaagagtagccaatgatagtggttttcaagcctataccctgtgtccctttttactgtgtaaaaaagccaatgatagtggttttcaagtctgaaaacaaagctttactttggttaaaagggacacaggctataggcttgaaaaccactactttaaagggtagtaaatgataacagtaacagctttactataaaaatattttgatgatggtactgggttgttagattttggattagagaatacaggaagcagtgatgctaagggtttcctgaccttgtgtttcagtgtgagaccctaatgggctggaaagttgaaaacaggaccagaggctgtcatcaatcacagtttagaaaaacaccctgttggggcctcttactcctggatatttctagctctcttgtacccagggcctctgttgactctggggtctgctgggctggctgactggttttctgctggccacatagcctctgtttacttctcccggctgcttgtgttcacaggatgtccttgttggccagcacattcctgtacaccttctggacttgacgtggggaggcatctgcagatggcctccctaaagaaagcatgttttgcagctgggtgcagtagctcatgcctgtaatctcagcactttgggaggctgaggcaggtggatcacctgaggtcaggagtttgagactagcctggccagcatggtgaaaccccatctctactaaaaatacataaattagcttagggtggtggcaggtgcctgtaatcccagctactccggaggctgaggcaggagaatcgcttgaacccaggaggcagaggtttcagtgagctgagatcgcaccactgctctccagcctgggtgacagagtgagactctgtctcaaaaaaaacaaaaaaacaaaaaacccaacaaaaccaaacaacaacaacaacaaaaacccatgtttttttcaagcttactgcctttaaaccatttggcagtactctgtggagcctttggtgattgcaacagcagctcagttacgttttccctgagagtatgatatcaacaacaataatattatttaaagtggtatttatatttaaaatgatggtaaggataacagtaataatgaattttattagtacataatatgtactgggcactgtgttaatgcttacaaaaacactgtgaggcagagtgtcttaatttttatgtgggaaaggctcaaagagttgagttacttgccaaaggtctcacagctactaagcaatggaggcaggatttgaatgcatatcggtctcactggaacacctatgccttgaatcactctgttaccctctctgacctgtgcgtaattcttaaaccgctgggtacagagaggtgatgcactttgggtacagagaggtgacgcactctggacatttctgattatgtgtttatcctaatgaaaaaggcccaattgccttggcatgcgtcaaacccagtggaagagttattgtgggtccccaagggccctgcacgtgatggctgtgggccctcaccctgaggctggagcaggcggcctttcctccagtagacgaagaacagcagccgaggccaggagaaaaacatgcctctcctgaggattagctgcctggagcctttcccacatatattttttcctctggtagaggttcagagctataattcctgttcattccagtctgaaagttggcagtttgatcaatgatttcctgtgccttgatgatgaatggctttcgtatttaaaagataaatttgtattttgagggttcaatgccctttgatttctttataatggaatttcattcaaattggcttcttaactgtgacctgttccaggggctcttggccaaagtaaattgtgctaatgaggaataacagaaacttcaggaaaatcatgtactcctaaattgaagtcatgaatgaggccttggaaatcatctagtccagccttttcgttttacagataaggaaatgggtcccagggagagaagaaagagcgtgtctaggatcacgtcgccacttccggctctttctactgaaatgacctccactgaggggtgtgaagatagtatcaattatttgtctaagacttgtcatttcaaaaacttgtcgatgtaaattctagtgcatactagacttgtaggttgtcagtaaatatagactattttttcttagtctattggaattttttcttaaaactttttttgggtgtgctagacatgtaggacaaattttcttttaaactaggttgctttatggtttgtgaatggtctctgttttacttatgaaagttatacatgttcactttgtagaacggggggtgacaaactatgtcctgtgggccaaaagggttctgttttgcaaatcaggttttattggcacccagccatgctccttcatttacttattctctgtaatgacagagttgagtagttgagaccttaggacctgcaaaacctatatatatatgtgtgtgtgtgtgggtgtatgtgtgtgtatatatatgatttattaaatataatttttatttaatataattacacatatttattaatgcacatatttaattatacttataaccatatagttatgctatatatagatatgtataatatagttatatataaaatatataatatatattctttacacatatatataaatatatttaattaaaaatatacatatataaaatttattttatttttaggttatagcttactgtaaactcaaactcctgggctcaggccatcctcctactttggcctcccaaagtgctaggattacaggtgtgagccaccatacccagcccaaacccaaaaacccttcatagaaaaaaattgttaaaccctgctgtagaacgtctgaaaaaatacagagaaatcgaacatctgaaaacatacggaaaaatcgcacgaagaaaacagctatccatatctcaccttcagtgaagtaggttgactgtaattttaccattctcatggccaaataattttgaaaatatctgattatttcctaaggctaagtttctcgaagtggaattcctaggccagtgagtgtgagtggcttttttttttttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagcgtttgggtccctgggtacttgagattagggagtggtgatgactcttaatgagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcctccctttctattccacaaagccaccattgtcatcctggcccgttctcaatgagctgttgggcacacctcccagatggggtggtggccgggcagaggggctcctcacttcccagtaggggcggccgggcagaggcacccctcacctcccggatggggcggctggccgggcggggggctgacccccccacctccttcccggacggggcggctggccgggcagaggggctcctcacttcccagtaggggcggtcgggcagaggtgcccctcacctcccggacggggcggctggccgggtagggggctgacctcctccaggacggggcggctggccgggcagggggctgacccccccacctccctcccggacggggtggctgccgggcggagacgctcctcacttctcagacggggcggctgccgggcggagggtctcctcacttctcagacggggcggccgggcagagacgctcctcacctcccagacggggtggcggccgggcagaggcgctcctcacatcccagacagggcggcggggcagaggcgctccccacatcccagatgatgggcggccgggcagagacgctcctcacttcctagatgtgatggcggccgggaagaggcgctcctcacttcccagatggaatggcagccgggcagagatgctcctcactttccagactgggcagccaggcagaggggctcctcacatcccagacgatggccggccaggcagagacgctcctcacttcccagacggggtggcggccgggcagaggctgcaatctcggcactttgggaggccaaggcaggcagctgggaggtggaggttgtagcgagccgagatcacgccactgcactccagcctgggcgccattgagcactgagtgaaccagactccgtctgcaatcccggcacctcaggaggccgaggctggcggatcactcgcggttaggagctggagaccagcctggccaacacagcgaaaccccgtctccaccaaaaaaatacgaaaaccagtcaggtgtggcggtgcgcgcctgcaattgcaggcactccgcaggctgaggcaggagaatcaggcagggaggttgcagtgagccgagatggcagcagtatagtccagcttcggctcggcatgagagggagaccctctctttttttttttaagacgaagtctcgctctgtcgccgtgagtggctttttgaaccttggtacttagcgcagaatttcttttcagcttgtatttctggcaatgcctgtaccttgctaacattaaacaaacaaacaaacaagaactccttttctaatggatttggttttgctttcatggattcaggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtaggtgccatcattcctgcctacccttagctgtccccgtgctgggaacacaccagttcggggcttctttgctgtcctgtagcagaagaggagttttattccttgtgaagagttagttgctgactgttggatggaagcaatttgatggtttggttcaaaatactggtaatctcattttcagtaggaggggagcagctgttgagcagatgcagtgcatcccactgatcacaagctagcttaccaggaccatctcagtacctagatcaagctgtctagacttaattctgtagaaaagaaaagtcctagaaaggttatcgcattcacacacagaaggaaaaagaggaagggggcagggaaagtgagtttgtatctataaggaaatatgcacttcaggtggactgcagttgactatgatactttctctgaggcttaatgtctcatttacaatctattaggtaaaggttttgctctttgcattagcattttcttttgggaacttgtgtactcaaatgcaaaaatcagctgggcatggtggtgggcacctgtaatcccagctactcaggaggctgaggcaggagaatcgcctgaacctaggaggcagaagttgcagtgagctgagatcacactgctgtactccagcctgggtgacagagtgagacttgtctcaaaaaaaggaaaaaaaaagccgggcgcagtggctcatgcctgtaatcccagtactttgggaggccgaggagggcggatcacgaggtcaggagatggagaccatcctggctaacacagtgaaaccccgtctctactaaaaatacaaaaaattagctgggcatggtggcgggcgcctgtagtcccagctacttgggaggctgaggcaggagaatggtgtgaacccgggaggcggagcttgcagtgagccgcgattgtgccactgcattccagcctgggtgacagagcgagactctatctcaaaaaacagaaaaagaagaaagaagaaagcccttcttttttttttttttcttaatagagacaaagtcccactgtgctcaggggttctcaaactcctggcctcaagcagtcctcttgcctcagcgtcccaaagtattgggattgcaggtgtgagccactgcagccagcctgcccttccttcttgaatcccttgcagtctggctcccctccccatctttagtctgaaatgttcattcaagagtcactaatgacgttttttaaaaaactaattttatcaagtagctcatatttttttgtagataaattggagaatatagacaagcaaaaaagaaatctgtcacttattcaggaaaattaatatttgatagtacttggctcatagtttttatgtactaaataaaaataaaataaccaaacctgccatttgataatgactgttagctttttggtgtatcttgtatcttcttacagccttttttattctttgccatctttaaaaaaaaatctagctgtattttttttaaataaaaattagctcattctcgtatgagttaatctgaaatttgactttctcacttaggaatgtattgtagtcctccttctctgtaaatcaatacagatctaggtcctcgttttaaatggccatgtaggattgtaatttacttttaatttattttaattagtcaacacatttcctgtttttgaccatttaggttgtttccagtttttcattattagaaatatctctgtgatgaacatctttgtgtatctttgtgcacttattacattatttccttaggctgtgctaatggccttctacttccaaatagaatagcttgttttcagtgctccctatccttggctgtctgaagaatctgacactgtcagcctcctccctctctgaattttcttcttttggcttctctgatcctgtgtaatacaggctttcatacctgactgttcctactctgctcctttgcttcctaaggtaggcattctccaagattgtgtattcaaccttttctgttcttgaaaatctcattcaccctcttgtgttcagctgtcatcactctgcatggttttctgcagtccatcctcgtctctttcctgaagtccagtttcatattcccagctatctgctgggtatcccagtcagagccttcctaaactgtaataggcaagattactgtcttggctgcatgccctgtttgcctacgatttccctcagtgcctttcccaaattctgtcttagagtccccaaatgattttaatggtgtcactattttctgactccattacacttgaaatcctacaatcattgggtccctcatctcctgccacctcaggtgattgctggatttcatggaatcgccctctgcaatgtttcatctgtcacctcctcccatatccattgctccaccctcacacccctccagaggaccattgcatttgctttctaaccagtctcttcttcctccaatctcttctttcagactgttactcccttatcctttacaaaaaccttcagtggcgcctcgttgtctaagcttcccttagagctttttcttcctctgtttccttctgcatgtcctatgaccaaccaatttggaccacctccttgttttctggtcttcagatctttgctcatactttcttctccccctgaaatgccctttcctactactactttccaaaatcctaccccttctgcaatgtgcatcctagacacctgctccttcacgaggcctttcttaaccccttcttatcccctcaaccagatgtaattgccctcttcctaaactctttgtgcttttacattgtacttagcgcattctctcttaaatatagatacttatctccttttcttctcatcttcctctctgatgttgtgttctcaaaggcagtaattttattttgtggaactctgaattttccatggtgcccattacctctgaaaagtcaaaggtctgtatcttgctaatgactgggcaagatacagagttatgaaatttcttgagactccctcagtttagtggagcatgggttatggggctagaaagtcctgagtttgggtctcagttcaggcttttactagcctggaaactttgggcatttacttcacttacttaggtcttactgtccttatttgaaattgaataataatacttagatctcatagtcttgcagtaaggattaaataagatatttagtctagtatctgtcacatggtagatctcagcaaatacttgttgcctttccttttccttgccactatgtttcagcaagtatagctaaatcatctgcttcttcctattgtatctgttttttagggatcttacctttattatccaggaactctccctaatgtgccttgggtgaagatgttagttgaagtgacttctctgccgtgtttgtggacctggagggactggctcctgggcctttggctccatttgcatcctcctctagccaactctggatgttaacacatcttaaagctctttggcaaacacataattaaattgctggtgacaacatctgaaatgatttccatttgtagcatgcagtccagtgatgctagcttatattaggcttgaagtgaatagaatgttctggatttagctctgtttcttgagaattcactgcagtctagtttcattgtaactcttgagtgtaataatatgttttagcttataattttgttataagaaaagggaaagggaaaggttttttgtttgtttgtttgttttgtttttgagatgggatcttgctctgttgcccaggctggagtgcagtagcatgatcatagctcattgcatcttcgaactcctgcacttaggtaatcttcccacctcagcctcccaaagtgctgagattacaggtgtgagccactgcacccagctgagaaaatattttaagttcataagacctaaagaagagcaaatggaggacacaagtggttagggcagattattatgcagtttaaataaattctacttcacaattgtgatctttacataaggaaatatattttcctttaatattctaatctttgtaaataattacataagaaataatttgtttcatgcttaaaatgttctgccctggaaaagctagccatcactaaagctaattggtcttcatcatcacattaacaagtggtagtttcatggcaggtaaactttcttccattagggttggtcttctacgaattgattattccctccactctcctatgtccatttcactcctgtacattgtcctctatattgctgctccctctctaaaggggcttgctttttttttttttggagacgtagtctcgctctgtcacccaggctggagtgcagtggcaagatctcggctcactgtaaccttcacctccaggttcaagcaattctcctgcttcagcctccccagtagagtagttgggattacaggtgtgtgccaccatgcctggctaatttttgtagttttagtagagacccagcctaaaggggctttcttatcagcctgtaaacacatctgagtctctactgccttctcaaacacccagcctggactaatccacatccacatctctagctactaccctttcacccttgctgtcatagccaaacttctttaaaagctccatcggctgggcttggtggctcatgcctgtaatcccatcactttgggaggccgaggagggtggatcacgaggtcaggagttcaagactagcctggccaacaggatgaaacctcatctctactaaaaacacaaaaaattagctgagtgtggtggcagatgcttgtaatcccagctattcgggaggctgaggcaggagaatcacttgaatccaggaggcggaggttgtggtgcgtggagatgtggagatcacgccattgcactacagcctgggcaacagagcaagactccatccccccgcccccaaagaaagctccctttatcccttacctctcatttactcttcaactcttgccaatctggtttctgcccctactttgttacccaaatccctctctataggctatacacccagtgatcagttttcagacccccctgtatcttatgtattattctctcggctgctcgcccaattagttctcctcaccatgcttgaaatgttctttgccatggctcctgtgataacacatcctcctggctttcccactacctctcggcagctccttttcagtctcttgcgtagactcctacttttctacacagctttgcatgtaggaatcccttaaggtgcaccctcaactccctgcttgctatggtctgaatgtttgtatctcccctgaattcatatgttgaaatactaattaataaggtgatgatattaggaggtgggcccttttggaaggtgtttaagtcagtgggggtagagccctcctacatgggattagtgcttttctaaaagaggtcccagagagctgccttggcccttctaccatgtgaggacacagctctagtaggtgtcatctgtgaggaatggccctcactagacactgattctgctggcaccttgatctcagacttcccagcctctagaactatgagaaacaaatttctgtttttatcagccacccagtatacaatgttttgttataacagcctgcatggattaagacactgtttttctccctttttacgtccccctgaaagatctcctctacttctgtggctttaattcctctacatatgtggatgactcctaaacttacgtctccaacccagtccttcctcttaactctactattatgtgtctagctgcctgcctaacctgtctaattccatgtatcacaggcatctcaaattcaacttgaccaaacccagattcctgatctgccttttctagctctgattctcttcatcatatttcaagttgcagaaaaggggagcaccatttacccagttactgaagcctgaaacctggcatcctcttccttccccaaacatgccatttcagcacatttttctttttctttttctttttttttttttttttgagacagagtcctactgtgtcacccaggctggagtgcagtggcatgatctcacagctcactgcaacctccgcctcccgggttcaagcgatttttctgcctcagcctcccaagtagctgggaccacaggcatgtgccaccatgcctggctactttttcgtatttttagtagagatggggtttcaccatgttagccaggatggtctcaatctgctgacctcatgatctgccctccttggcctcccaaattgctgagattacaggcatgagccacatgcccagccctgagcacagtcatttttctaccagtcgatgttgcaatgaagataaagttccaaatccttgacatgctccagccttcccctgtgagctgatcactcccacaagaagctcctctgccttccatcctcagccactctgaccttctgtttcttctggggaccctgcacctgccagccccagccccttccttatttatgccatccctttttctggccctcttgcttggctaacttatactcatccttcagtttgggctgagctatttatatgctgttccaggaccctgaacttctcctttatggcacccatcctgattgtaattatattatttatattgttttgtttgttgtctgtcccctctgctgaacatcgacttcacataggcagggacggggtctcttttttcactgctttgtcacttaccacaccagttcccagccaggaaaagaaaagacggttgtttccctgctttgataaaatacccagacaaaaggatgcccttattgctcttagacctctttcccgaatcttccctggttgtcacctgcaatgatgttatgtctgagttgaatgtttctcactgcacgctagtttgctcagaggtaatagaggaggaactgttttctcactttctctttctctttagcctttattcctaaagcttgtttctagtcatttcttttaaccagcttcctgagaagtatttccattgtcttttctgaactctcccttagaccatgagaaaacaaaagtttatgctgattttgggtcatgacctgacactgaaattggtggtgttaagtacattgccgagtaactcagatacattgatatttaaaaaaatactttttctgattataggagtgattttattgttaagaaaaaattgagaatataatcaagggtctagaagagaagaaatgggagagattcagacttttctcttgtagaataaggtcctgctgtacatgtgatttttgtccgccctttttcacttcacattgatattttgataaaagccctgagaaatgggagtgaaacctaatggaccgcagctttggacaagccccgagtgcaaataaggctggtcagcagcttctagcaggatctgcttcttctagaagcagagaaaggtaacaggctgccctgagaccaggctctacagagcctccctcctgcctcgtacatgccaagccggccctgtcctggcacttacagtgactaacggccgggcacctccctctcggttgatgccctccatgcaggacatctccaacacattgctctccgttctggtgtgttccttaagccaaactttctaggtttaatttcactggatgttcatagatcctcgtgtcccagactaattgtctatgtatttgttgatatttgttcttgcctattttcattttattttttaaattcaaggcaagaggcctatttattttgtattttatagtgcctagcatggaatttggtgcccaataaatactttttttttttttgagatggggtctcgctctgtcgcccaggctggagtgcggtggcactatctcggctcactgcaacctccgcctcctgggttcaagcgattctcttacctcagcctcccgagtagctgggactacagatgcatgccatcatgcccggctaatttattgtatttttattttttaatttttaattttatttatttattttttgagacggagtcttgctcagtcgcccaggctggagtgcagtggcgcgatctcggctcactgcaagctccgcctcccgggttcgcgccattctcctgcttcagtctccggagtagctgggacttcaggtgcctgccaccatgcccagctaattttttttgtatttttagtagagacagggtttcaccacgttagccaggatggtcttgatctcctgaactcgtgatccacctgcttcagcctcccaaagtgctgggattacaggtgtgagccaccacgcccggcacatttattgtgtttttagtagatacggggtttcaccctgtcagccaggatggtcttgatctcctgacctcgtgatcccccggccttggcctccaagagtgttgggattacaggcatgagccaccgtgcctggccaataatcttaaataatctaaaaataatgttctgcccaaattacaaattaccaaattagggtccatttatgcataattttatccattaattcaggaagcatttaacagtgcctggcacagttgccaggcatggagtatacattagtgaataaaacaggggtagttcctctgggattctaggctagtttgtttgtttgtttgtttgtttattgagatggagtcttgctcttgaagctcaggctggagcagtggtgcgatctcagctctctgcaacctccacaatctgggttcaagtgattctcctgcctcagcctcccaagtagctgggattacaggcatgtgccaccacccccggctaatttttgtatttttggtagagacgggatatcaccacattggccaggctgatctccaactcctgatctcaagtgatcctcccaccttggcctcccaaagtgctgggattacaggggtgagctcccggcctctaggctagtttaataccagatgttacacagataataaattcatagtttcaacttgtgatgagagttatgaaggaacatggcagggtgccctgagagaatgcgctaaggcaggggtgtccgctcttttggtttccctgggccatattggaagaaaaattgtcttaggccacacaaaaaatacactaatgatagctgatgagctaaaaaaaaaaaaaagaaaagaaaaaaaaaaagaaagtcgcaaaaaaaaaaaatctcataatggttttttttttttgagacggagtcttgctctgtcccctgggctggagtgcagtggcgcgatctcggctcactgcaagctccgcctcccgggttcacgccattctcctgcctcagcctcccgagtagctgggactacaggcgcccgccaccacgcccgactaatttttttgtatttttagtagagacgaggtttcaccggattagccaggatggtctcgatctcctgacctctggtccgcccgcctcggcctcccaaagtgctggaattacaggcttgagccaccgcgcccggcataaaatctcataatgttttaagaaagtttacaaatttgtgttgggcctcattcgaaaccatcctggtcggcatgcagcctgtgggccacggttgtggacgagcttgcactgaggggagacctatagtatctggcattgtgtgtgggaagaagcctggagactgagccctggagagaaggagagggtgggtcaaggtgagagatgagctctttttgagagggaaccagcccaaaggcgaggcattcaaggtagagagtggtaatcgaaagcgagaaatggaaattgttatctctttgttttagtaactgggaatgtaagtctccccatgtcatcggcctctattctttctaaaaacttttcaagggatgtatttagccttcctacaagagtattttgatttgtttttgaacaggtctttctgaacctgtcccacttttattgatgctttcgctgatgtttgtgaaaggcatctgggaagggcactagccagtcaggcttttaacacctgtctgtgggttcaacaaagaggaattaagcttcttctcaattgcagatgtcgtgttgtattctgggtcccataggagatcttgactgacccaggagtggtcccctccgggaagaaggacgctcagccaccagctgcccccaggtgttcgtccccaggggtagaactcacccactttatgagcaagtctttgtcaaggaaagaagacggcaattgaaattttcattgagctgttagcatttttttcagaaaaccattttgtcccagtgtgtgtaagaagttattccttcattcaacacatgttgagtgccttctgtgtctggcacatttccaggtgctgggatacagcagtaaacagattccatgtcagtggataaacacacactggaaacacataagtgaaacacagagggtgtcagggaggttataatcactacctagaaaattaaaggagggaaggaggccttagggagagtcacctgggaggtggagacaggtgttgaaattgttaaaaatagcatcaggaaaaggcttactgagtgacatttgagcaaagatttacatgtgagggaagagcattccaggcaagagggcacagtgagtgctatggtcttgcaggagcatgcttgggatatttgtggaacagcacaaatcctgcagtggcttgagtatgggcagtgagagggaagagtacacacgagaggaggtgaaggggaaaagggaagatcatgcatccggggccttgtggccactgtgaatactttggctttccctctggttaaacaggaagatgctggaggctgttaaattggctgtaggggcaagggtggaaggagactctgatgagatggcggtagcatggatctagatggaggtggtggaaagaggtcaggtttgagatattttgaagggagagctgatggactagatgtgggctatgtgagaaggagaaagattgggagaagaataggttatggacttgttaaatttagatccatattagggtgctcgtgtcaaaaatgtagttgggtgtatgagtctggagtcaggagagaagcctgggtgggaagggtgtctgtgagccatctgtgtacatatggtatttacatccatgagactgtggagtgactgtgtgttgggtaagaacttcagtgtcttggggttgtaggcatgagaggaaccagcgaaggagacacaggaaaggtggccagcaaggaggtggagacaaggtctgacgatgagtgactctctggacccccgtgcaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtggtaagcccctgctaatggggaggtggccggggacaggtgtgtttgcacttgctgttgggctctgttcaccctgcaagtggtgcacaggtgtcctgtgggttgctggcttgcttctctcctcaggtggacggtcagatggttcagaagccactgaaagcacactttgtaaaaagctgaattgactccagggagcaggcttagccggaacgaaaggcctgattgtcatgcttaggtctgcagtcttttacctctaactccattattaaagcctaaaggagcttgagaactgaacctgtaacctgagctctagctaggtgttgggggaggggagaggtaggggaaagctggggaaagaggtgatgtgagggctgggagggtcctcagtgggaaccccacctttagggcctgagagaccaagtgcaaggaggggccgcactggccatttagagacattctcttccattatttctataagtggggacagaagaccagagagctaaagtgaattgtttaatgtcacccacctgtttctgtagaaaacaaccttggagttcagtaatagcacattggagcgtctatactttggaatgctcaggatacactaagttaaaaaaaaaaaagcgggttacaaaatacatgcagaatccgattctgagaaagctgggggaaattggagtggctttcttcctaggaactgcttcagcctcaaacccagagtgatctttcctttctgtcctccaggacttctgattgcaaaagatcacaaggaggagaaatctgctgtaggttatcccctataggtaggaggaacccagagaggaattctagtggtgaagaaatggaaaaactttgttagatctagattcaggaaaaggttgacttctatccagagataggctaaaaatatacaatttgatagaattcacttaagttcccttgctcatgtgaactttgatatatttgctatgagacccaccctactctaaatttaagacttggggacttcaaggagtgtttgtaaaagacaaaattcaaacagcacaagttggagtttaccgtcttaggatccattgctcgatattttttagattcaactcaactaatactagtgaatttatatagtttatatatttgttgggttataatttccagataacaaaatgtacagattttaagtgtatattgtgaattttgagaaatgtatacactaggtaaatatgacctcattcaagatggtcatttttatctaagtcccctgtcacacatgatttaagtcaaattcgaaatttaaactatgtaataattttgactcaaacttaatgtgtttctgaatttggtatatttctgctttgtttttcaaagttgaaccatattttctttccagttataaaatgacatattttttataacaaatttaaacaacatagaagtatagaaagaatggctctcataattctatcccccaaagaaacataattattaacagtctgatgtatatccattgagattttatatgtacacacacacgcacacatatatatgtctacttttaaaaaaaatagcatcattctatacacgatgcaaacttttttttttttttttttttgagacaaagtctcactctgttgcccaggctggagtgcagtggggtgatcttggctcactgcaatctctgcctcccggactgaaagtgattctcccacctcaccccctgcagggagctgggactacaggtgcatgccactgtgccaggctaatttattttgaatttttttgtagagatggatttttgccatgttgcccaggctagtcagaaactcctgggctcgagcaggtccacctgccttgggctcccaaagtgctgggattacaggcatgagccattgagcctggcccaaactttttttttaaccaaatacttaaatctatactacatagatctaatgctatacagacatcattccataccaatacatatatataatcttcatttttgtgtctaataaatgcttcataatatggacactttataatttatttaaccaacctctctctgataacggactttgaggttatttctaattttccacttttgcaaacactttataatgaacatctagattgatttgagtttctgaatattttcatatgttaaattaatattatatattgctaaatccagagaaactgtaccattaacactgtttactgaagtctgtaagagagcattttttacccacactttcacatatactggaaactcttaaatctccattaacctgtttgagaaaaattatattttgtttttattattatgtctttttaaaaaattagtatttttgttgggcatcttttcaaatgtcaatttgtgatgtgtatttccccttttaattttctttgtctggtctattgagtgtttctatttttaaaagttcatatcagccgggcgtggtggctcacgcccgtaatctcagcactttgggaggccgaggcaggtggatcaccaggtcaggagatcgagaccatcctggctaacacggtgaaaccccgtctctactaaaaatgcaaaaaattagccggatgtgcatgtagtcccagctatttgggaggttgaggcaggagaatcgtttgaacctgggaggcggagattgaagtgagctgagattgtgccactgtactctagcctgagcaacagagtgagaccccgtctccaaaaaataaaaaataaaacagtttatattcagcatctaggcttggcacatagtagacagtcattactagctacgtaactatgtgccacttatgcatatttgcaacattttcacaagtacagagaataatacattgaacccccatataggcaacacccagattccataactatcaacacgaggccaatctggttcataccattctcacctacttcccaccctgaccctgattaatttctttagtgttctttgtatgtagggatttaaactttgtcatatggtacaaatattccctgcccccctgcagtttctcatttgtctttcagtatattaatatttttgtgccatactggttttaaactttcatattgtcacatctgttaatcttttctataggatttctggattttgtgtaatttttaaaaagatcccctcctccccaacatcaaagtttataaaaatattgtctttgggctgggcgcagtggcttacgactgtaatcccagcactttgggaggccgaggcaggtggattacctgaggtcaggagttcaagaccagcctggccaacatggtgaaaccccctccctctctactaaaaatacaaaaattagctaggtgggcctggtggtgggtgcctgtaatcccagctacttgggaggctgaggcaggagaattgcttgaacccaggaggcagaggttgcagtgagccgagattgcaccattgcactccagcctggatgacagggtgagacttcatttaaaaaaaaaaaaaaaaaaaaaggattacatgcttttaaatggtctattgttcgataaagtttaatataaatttaaaactttgtacaggtacagtgaggataaattttttaaaatttccactaaactgcaaaagtggtttaaccaacataaaattattcctgatgaaggacataaaatatctgtaaccagttgttaaagtgagaaggtgggttctaatcagatgtgctcagttacttccatcttagcatctctgttgtaaatccttgggcctcagtcttcttgtttgaggcccaaaggcatttatttgcacatttgttcctattatccagcaggactatttaagaacattctaaaacgggtcccaaattgctgaagatttatcatcctgctattccagggattgttggtaatcttcatcctttcctaattagaagaggcccctgggctgcaactacagtcagcaaggtgcgtgggttagaccggaagaaggagcaggctaaactcagggcagcggagtcttcatgctcatcaggttctcacctcttgtctccctctgcaggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtgatggcaagatggtggctggcttctctgcttatcgcccctcatgcagtgggcttcctttgctaggaagacagccaagggagttcgaatagttggggtgtgggctatcttttcaaaaatctatttgctggggctcttaatttctttagtgttctttgtatgtagggatttaaactttgtcatatggtacaaatattccctgcccccctgcagtttcccatttgtctttcagtatgttaatatttttgtgccatactggttttaaactttcatgttgtcacatctgttaatcttttctttaggatttctggattttgtgtaatttttaaaaaggtcccctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatggcagagcagtcccttgggggatccagccctgtacaatgcatctcttcctggagaaagctggcctgctccagaccccaccattcccaggcgcccttggagtggactctactgatgacagacagaccctctgagagacaagaccctctgactctgtgatggaagatgccagagattttcctttggggtaattgtccttaaacaaaaccaaacagatgaaacacacacaggacttgtggctaaaaaggctagtttttcacttgcatttctcaactaacccaggttttacatgcatctgtgaatccttttactactacctctgtggagagatggagagacttcagataaacgtgaagctaatgagtaaaaccctctctgccaaaacctacactccactttaggcccttcttgaagatgagcacaatttttaaatactgagcacaatttttaaatactgacatcacttcctcttccccctcccaccccagctcagcagcctcaaatctacagagaagaagaattatggcatgaacattcccacagacccaccatctttaagacttgacctctgtaagtttaccaaagggctcctcacaattgtggtgggggttctggttcaaaatttggagcaaacatgaagtttttggaaacgttttctcatttgaagcctccagtatgctgtactattctggaaattaccttcaagagtctcacttcttgtttctgttgtgttttctgtgggcatcatgttcttcacgcttgcagtagaaggtgctttctcggtttcccagagtatccaacggctcacctttctcaagtgctggcagtagctatgcactcacgggctggtttgggtcgctggtgcagcagcgcaaatctgttgccttctgaatttttctcacctaatgtgacactggctacaatgaatcttctcttcatcgggctgaatgaaagattcaagaaccatcttcaaggtgcatggtgggaattatcaacctcagggatactcattttaactcaggcgtgtcctgctttgtaacattccattgttgggagagggcaggacaggtgtgttcttctgtgggcaggagtcatgtcactgtcctacatatgtaagagttgggaaggtgacgatttttgacacatccaggaactcttactctagttagaatttgtaccagatccaaggtgaaaaccccaataagcaactgaatttagagtttaaaaatgaatgactttatgctacatctgtggttatcaaattatataggttgttgagaagcagaacgctgtttgtagtaagaaatctttgtggaaccccagtgtgtgaagtaaattgtatgttattaaatttatttaaggtt

SEQ ID NO: 1628 - DNA, 80887 bp, Homo sapiens
cgctcagcccgggcgggcgatgcgggcggcgcgggcggccccctcccccggcccgcgtctccgggacggctgcgggcggcccccccggcggccggagggctccctggccccgatctgacggcggcggcggcggcggccacagcggcgggagcggcgcggggaaggagcagcggctcgcagccctcggcccgcgcccccacccagcgccagcccgaggggggaggcgcagcgccggagggtggcggtcctcggccctcccaggtctccgcgccgggaagccgctccgagccggggtaaggcgggcggggagagcccgggaggcgggcggggggagaggctgcagcttggccaggccggtttcatttttaaagggcttcggtgaccatgcaggcttgcccgggcccgggagccacttacagcggcccggcaaaggctcggatgcaaaagttgtttggtggcggctgctacgagctgagaactggagtcgccccagaggggtgtgtgagggtgcgttcttagcagcatcttaaaggggtagcttgtctttctggccagcttcccccgggtcctttccgtcgtgtgtgtgagagtgtgtgtgtgtgtgtgtgtgagagagagacagagtgtgtgtgtgtgtgtgtgtgtgtgtgtgtgtgtgtgtgtgtgtgtgtcggggagggatgttgcaaggatgctcggatgtgtctcggaaaaggaaactaaccctgctcccgcgcctctcccccaccccaattccaccgccaccgcttagagccacccccatcccgtgccctcccatctctctgcaaactgggagcctgtgagttgcacagagaaactcccggccagtccggctggaaacttctcccggcgccgggagggggtcgggaggtgagggggcgcaggcactggtttggggccggcgtggagtcgaacctggaactgagcggcgcgcaggtggggggagcagaggcggcgggaaggcgggaagagaggaccgcgggctcgcggggtccgcccgctccggagtaagttggccgtctgggctgggggcggcggcggccgggtcgccacaggcggcagcgccggggcaaaggatacagccagttcctgggcgccctgctctgtgtcttttaattaagagaggcagtgccgaaaaagggggcgcctcagtcccggccgggcctttattacgggcttaattattaattgctgccgtggcttgcacgcaactttgggaagacgaaaagcagctgcggggctgccgggtcgtcggtgtcctaggcacagggctcgcagccggcccgaagcactgactcgaccctggccccggcctcgaccccgcccgcggcccgccgggacccacccgggagctgctgctcgcgccccgcctcccgcgcccaactttccagggctcccgcgggcggggacccaggggccggataaagggcccgctccggagcggggggacacccgggccgccggaattaagaggcccgccgaggctacagtgagcgcggggcgcccgctggaccccgcccggggcagaggacgggaaggtgaccccgccggccaagctccctttccctcccggcaaccgccactctcccctgaaagcagatttcacccccctctgccgcccctgccgaggagggagagggaaccccggggtgggctgagtatcccccctagccccgggagcccccagcgccctccctcccgtgcccccaggggccccgcgcccgccgcggcaagtttcccacacggcgagggcgcagcaggcaactccaagaggaacctgctggcgagcccagccagctcgggaggcgctaattcaataagacagagaaatctgagttcagaaatcctgataaaatctaattttcgagttttaataccctggctatcagccccccttggttcctgaggactcttaaaagaaaataaagcacattgattctatttgtttctgggagctgcagtttcttaataatatcaggtgaagataaattttccacggagaaaacgatcctccgggatgcagcttcttactctgaaaatttccctgccgactcctcactctctgcgctcctcctcgttatccggggactcctgcctctcttcccccttctcttttttctttttggcagaacccgcctgcaatattcgtgtgctgagctcgtaattccccctgcgatgccagcaacgcccaattgattgactagttgtaaacacatttttcccctggcagattttgttgttgttagggttttttaaatttatttattttccagggaatgcgtggcatttaaaccaacaggactgcaattaatagatttgcgagttgcgccgcgcgcgccgctcgccccagcctcccggcctccgggcctcgctgcctccccgcgcccggcggcgtccagcgccctgcaagccccgagcagccgcgggtcctgcagctgaaggaaggttgcagctgcgccctccttgcaagccgcagcccggcgtcctggttgtcccagcagccaggagatccctacctgttagtgaacagttaggagtcgactgctggaagaattaattaggaacgtgctgtgctctgggcagcgcgagctcgggtagaggcatccaaacctttgccggcggcgctattttatttttactacattttctcaggttgcaaaaatagacaccgggcacgttctgtcttagagttttctagcaaggagcgccttcaaggccaggcaggctctgtaacaggttcccctttaaacagccagaggtgagacggggaaaatggtcctggctgggttctcgttcatctccatcagcagtccttcacccagagagaggggcaggggtcgccctaactcagatgaatgagtcccatgcctggagccctggggccctggctgggggctgctccgagcctgaggtgctcagggcgctcagggcagcaagtgtccgccacttcggtttgtcatttttggcaggagcgtttttctgtctgggtggagaatggagtttcacggaaacacagttaactcttcaggggccttgcaagtacaggaggtgaagaggatgtcaggggagagccaggtccagactggacatttggggtggtttgggaaatcaaatgcaatcatcgaagacatattaaccagaataattaatcatgcaggcacttttttactgcagtaacctttgccctattggccaatatttttggccagaatcccatgctggctggacttggattctccgggtgacgtatccagtgtctggaacacaccacagtactgcagtcgtgttatttcccaatgtaacattcatgtaactggtatctattttgatataatatattaattatatctattttgattttaaataattaacagaagcttaaaatagcacagcaataatcgtaattgtaacccatttatagacctaccctctaagaatgatttgcaaaatgctggccttgatcagaaaaatctgaactcacaaagcattgttacctctttggcagtcttcaatatccctagtttcttacagttaaaaaaaattaaatttgccatttcagattgtgcctatgattggggggctgtttctcagtgcctggctcttcatggttggccagcacgtggagcactctgttcatctgtacatataggtatgggtccatctgcacctatagttacatgctcatctttgcctttaacaactttgacattctgacttgacagtcatggtattttaaagcaaccattaaatcttggctcctggggatgcttttgaaagtctctgacccccaagccggggcacttctgctgaactaacactcccataaatgagaaaaaaatgcatcaccttttaaataacatgcccgatctccaaatgtgcaactctgatattaataaaaataacccagttttctcgggagactttgctaatgcagcctcattttttgcacattttgccggagagcttttgttcttatacgtctctattctccccctctttaatttgttgcaggtgttgttgctaatgagctctctctctctcctcccctcttacaatgaaagacaagtcagaccccaggtacctggatggattgagagctgagatctcagaaacttcataataagttgccgatggctaccagccaaggtcagctgggccccattagtgccggcccccaccaaagcagaaccaaatagccttctccccagtgaacacctcagtagcttttcattctagtccagtcacacagctgttgccaccttaagctcatatgaaagaaatctcttttattggtctgagaacccaagtccagtcccaaagagggaacatgtttccagctaacatgcccacctcctgattttattttatctttacaacgcaggctggagggttgttttgccgttgtgttgagcacgtcacccattaagagccctttaaagacctggattgattggaaggacaaaaattaaaagcaatctgatccagcctcatgcaggatccctgcggattttctccttatcccatttccatccactgtcacaatttgagaatctgcctgatttgatcagattcacctccaggggaggtgtgataccagggttaggaggacgtgaagttatgggcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgtaagtccacttactgctcttttgtttgcccaggccaagtgggaggaggtctggaggagatccttggggtggacgagcagagctggaggactgagatgcaaggctgactttcctgcctcttgaccaggtctggaccagacctggaccaggtctttgtcccaccttggaaatgtgtcaaaacagaggacaccctgaggacactggggtcatgtgacattgttctctggggtaggggcattctcggccagctggccactagttcagttccctcgggaagcctatagtattcagctccgcagccttcaggctaagccccacctcctgtgtaggaagtcagcattctgggcgagtgagcaagatgctacctgcaacatgatactgtaagctccctctgttcatcctttctgtggtgcaacctcttagcccactcaatccaatccagcagacggtaccatgaagctagagcatgccaagcactgagctggccctttgcatggggaggtttgacggaggctcagaggggattcacgcaggatgaagttgggggttaagctgggacagacagtgcagcttgggtccccttccacttccattcctacatgcaatgatggcagcccctgggtaagtcgggggaaggcagacattcaggcgttgtcccttgcctccctagctagagaaggaggggtcctaggggcacggagtacttcagtactcaagtaatgttaacagcaacaacaacagcagagatggttgcgtgcgagctgtctgagtgtgtgggccgagcctgatgccattgcgaggagtcctcccctcagctagccaggtggattctgtgttgtataaagcaggagcgtcaggggagggctctggcccagtgacgtctgtgggcttctgttctgtcatctgcaaaatgggcacactaagagcacacactcctagggtcattgtgaggagtttgtggtttaattaacgtaggtaaagtgttcggaataggacctggcacagagtaagtgcacgcagatgttagccgttgtcattctggtcatacaggtggggtaactgaggcagcccaggggtgacgggtaaaggcatctggccaaggtcacactccaggaggtggcgaagctgtgattccagcttagagtggctccaatgtctctgagctaagctgcttcccactgggcagtgctccggaggccgtccctggcagggcagggcagagctgggtagggcagccaggctgcagaagctcacaggaggggcttgatgccatcccccaggcagctggtacctctgcgtgtccttggaggagcctccaggtctctgggtttgtggtggggctgacccggtgcccccacctcagagtcctgaggacttgatctcatgggccggctctgctcacatcacagggcagtcagcctgagaaggtagcttcttactcaggcttgtcagtggtgatgaggctgtcactgtgggtggtggctgggccagggccagctggggagagagagagggagggagagagggaaggagaaggcggcacgaagccaggagctggggctggatagtctgtggccataactgccccggggaccgcagggccaagcaagggggctgggctctggaagccaggaggaaggccaggataggggctggtactcagtccacatctcaaagccggtgggagggttctccacacgctctcgggcacggtcaacctctgtctctcgtattagagtctcgactgtattttctctcttaaatattaatcactgccttaacgtgcttgggggagcagctaaatcataattctaggaccagctttgggtcgagggcttgaggtggggagatgaccctcagagtcaagtccgaggccctctccttgccaaagctgtctagggtgtcattggccctggacctctgccctgcccccaccctcagacagagaacccagtgcagtgggcggctgttctggggaggtggtcacccctcccagtcccagtgccggcagagcctcatcccaggcagccagcctcaagccctggggtctagaagagtgctctctcccatccccatcccctgctcctctcctgggcagacaggtggggaaggcaggggagaaagaacagtccctccacaatctcccacatgggcaagtcctcggcgtctcgccacctgtgtgatggacttaaatatttcatcatgggctgccatccagctctgctttgattacaaatgtgtgtccgatgaggacggggaggccgccgtggcaggtggacggcagccttttgcagggctggcttttggagggctggctttggagggctggcttttggaggggtggtttttggagggggtggttacttctagatagatctgggttcaaaccctgatgccacagtttattgtggcttcccctgggagggtccgggcagtaggatgctctgaggtaggtcctactctaatctcatttttgggaatagaaagtgttgcctaaatcctgccaacatcactccgttgagaaggcaggctgggaactgcctgtagccaaggcccatgcccacccaccaggcggcacagcctcccctctctccacttctgacctctctgagtttcactgtcttcctctgcccagtagaaaccataatgtaggagtgtcacggtgctggcgggacggcacagcccggccgtgctgccgtggtacgtgcggacacatagtaggtactcagtgtgcaatactagtcaccagcttatcactgttgtgattatggcctcggtgattttcctggctttgcttcttccccgggctcctttgcctctccccagccttggggacgccacgccttgtattgctagtctctggcagcatgtggaagatgcaggctgggggagcttcctcgcctgcagccccagcagctgttgttaaccagccaccagggggcgccctaatggcggccagatgcccactgcccccttagccttgccatcgcccatgggtccttgctccccttcgccccttcagtggcaggtgctacgtgtgtcccaacatccagcccacgggagcgcaagcccggctgcactccgagggtacaggagggacccaggggcggacggccttttcagatgcggggtgcagaccctctctctttcccaggcttcctgtccttcagcaaggccacctgagaactgaattgtaaattccagccttgcaaggaaggggaggaggctgaaagacaagataaatgaataaataaaaacctattggctctaaatgcacaatgagaattaatagggatgagctctcaacagaggattcttgggcgaggacaaaattgcaatgagggctgtgggagaagagaggcggcccccacccacattcccagggcctgcccctgaggtcagcccagcaaggctgcaggccgagaaggaggcaggaagggcgacgggcaaaggcatctcagcccctcacagggcaactgctgcttgcaggacccttggagatggggagggcgtgactggcattgggaggtgccccttagcgctctgcaagacacgtctcccgccagccacctgtggtccccgtgagaggaagggggaaacccttcctttgtgccttggagacaaaaactagccacccgagactcaggggtgagctgacgagcaggtgagagagagagagagaactactgcccaggcagcagggtgccaagggaatcctgccactcccactcagagcaatcgcctcagtgcagcagcgctgacctcaccttgatagaggtgcagaatcccagaccctgccccacaactgccgagccagactctgccttttaacaggaagtctctggagcgctggggtggggttggtccaggatggtggatgaagcctgccgttgacgaaggggccagaggtctgtgggtcccatggggtctgtgcaggttaagaggagaggcattgctgaggggagacaggagccaacaggagagcactagggggtcctgggaatggagggatggagctgggagccgagattcccagatgcgggccttgcttgccaaggcggggggtctgtgcttctgagcaggagccagtggaaggttccagagagaggcagcactacctcctgacaagagctacaggcctagaatctgaagccctgagctcacatcccagtgttgtcacttgggggctgggtggtctgaggtgagtcattcaaattctccaagcctcagtttccctatctgtaaaaggggtatgatcttcactgccttgcccacctcaccgacttcctgggagaggaaacgcctctcacaacataacagaaggtgcttggcagagactgtaagttcttttctagtgtgaggcttgaatattattgtttatccaatcttgataagcttgacatttctacattgacatgggtgaacattcaaatttcagccatgttggagtctccagcatacagaggcaccttggctttggtggacaggaaagccaagggcaggctgtgaacgtgcatctttgaacacacatcttactcagttagaacctgctttagcttctctgtgcctcagtttacccagctgcagagcaaatggttccattcctcccccagggggtctgctgggctgttgaatgcagacagcaggcaggtcctggagtccttgagccactcctcactgtgacattgaacaccacatgcagaatcaaggtcacagacactctgcctcctgccagaccttgaggatcatgaaatgtttccatccaacaatgcagagctgaccggcccgatggctctggcctccttccccctctgtgtttctggccccagcctccctcctctcgccgtcacaaccctccagtcggcagatgtttccaggtatgacctcatgccaggcacagttgtgatgggaaagtgagatgactagagataaattaagtgaaaaacaagagaaaaacactacagacattgaagacaatacccagctaaccacaaatggtgacaccggggcctgatatgataggagctggggaaggaggagggcgtgcccctccccatgaactctccgggcgctccagccttggcccgtgctgtctcctccacccgaatgcctgccccctccttcctttcttttcaaggcttccgcttctacctggataaccctggctcctttttcaaggttcaggttggaccctacctcctcctccaggaggccttctctgactcctttgcccagtggggtgaggaggccctcatttggtcatcatcctgcttactgactggcctatcagtgaagagttctggccctaggaatggagagtttagaatcccgtgctgtgtgatctctgatgtgagacctaacctctctgaaccttagtttctcaatgggagctattaatagaacgtgcataggagactgtcatgagcacggtgcttggcacatagtagttgctcactgcgtgctggctgttgggaccaattctgtaactttagatgtctgcttttcccctggactgtgagctcctcaaaggcagggctgtctcgctatctttgcatccccagcacctccctctggacttgatcagtgcccagtaagcatttcctgaatgaatggatgcatgggaggaagcatggtgtgatccaggaacgcttctcagaggaggcaggatcagggctgtattttttttttttttttttttttttggagtcaaagtctcgctctgtcgcccaggctggagtgcagcggcgcaatctcggctcgctgcaagctctgcctcctgggttcacgccattctcctgcctcagcctccccagtagctgggactacaggcacctgccaccacgccaggctaattttttgtatttttagtagagacggggtttcactgtgttagccaggatggtctcgatctcctgacctcgtgatccacccacctcagcctcccaaagtgctgggattacaggagtgagccactgcacttggccagggctgagtcttgaaggaaaaactggggtttgggtcaggacagaggagaccctggaagcccctgcttctctccactgcagtccctgttctgtgggatttgcgattggatgaagccgggaggtttgcacaactctgtccttaagtcagttgcaagtgacttcggcacctgagctgcaccagccgttaaagccactcagtctcttgaaatgcccgaggcagggcccagcctaggacaagaatagttctgtgaaatgacatcttgttgcacagtgaagtctccctcctgggcagtagacaatgagaagaccgaggcccggggcccagggagtgagacccttgcttctgacttcccttgagggaatgaggttgggtccagacaccccgtggaaggcaggcagctgtgtgaaagggcccagatgggacatctttccaaagaatgtcagagacttagagacccccagacctttccggtctgcgcatccccaccttcccaggctgtcttcctctatgcttcctaactctgatgtttaatccatttccctttttctcatttactgtgggtataatgacaagctgcctccaatcccacctgcgatggggcaggcagtggatggatggacagacgaacggacagacaggcaggccgcaccatgctgcggatgagacggatggatggacagacggacagacaggcaggagcaccatgctgcggatgagatggatggacggacgaacggagaggcaggcaggtcgaaccatactgcggatgagacggacggacggacagacaggcaggccacaccatgctgcggatgagatggatggatggacagacggacagacaggcaggccgcaccatgctgcggatgagatggacggacggacggacagatggacagacaggcaggagcaccatgctgcggatgagatggatggacagacgaacagacaggcaggcaggtcgaaccatgctacggatgagacggacggatggacggacaggcaggcaggccacaccatgctgcggatgagatggacagacggacagacggacagataggcaggccgcaccatgctgcggatgagatggacagacggacagataggcaggccgcaccatgctgcggatgagacggacggacggacaggcaggtcgaaccatgctgcagattagacggacagatggacggacggacagacaggcaggccgcaccatgctgtggatgagatggatggatggacagacggacagacaggcaggccgcaccatgctgcggatgagacggacggacggacggacagacagacaggtcgaaccatgctgcagattagacggacagatggacggacggacagacaggcaggccgcaccatgctgcggatgagaacttgggcttctggagggaggagatggggcccgggggcatcccgcacttctgggatgtgggacttgggataagtcccttgtgaccctgagccttggttttctcatctgaaactgggcatggcgctggacacaacctcgaaggacgtgtgtacaaataagacgagaccaggcgtgtgatgacctcagctgggagccagcacaaaaggaatgctcaaaaaaagggccgggtgcacggtggctcaagcctgtaatcccagctctgtgagaggctgaggtgggcggatcacctgaggtcaggagttcaagaacagcctggccaacatggggaaaccccgtctctactaaaaatacaaaaattagccgggtgtggtggcgcgcgcctgtaatcccagctacttgggagtctgaggcaagagaatcacttgaacctgggaggtggggtttgtagtgaactgagatcgtcccactgcactccagcctgggcgacagagcaagactctgtctcaaaaaaaaaaagtgtatttttatttttatcctttttaattctagaatttagcttgagggacagaagaggaccccataggccaaacccacagccagaggcacaggctgtgggctcagaagtgggtcttgcaggatgggaagggtcaggagagtgaggatgtgggcagaaggaatggttcgtgcagagacgcagggaagggggccaggtgattcgaggggaaagtgtgtgggtgacagagaggagacagtccactccccctgcccacctcatccaagcccctgtaggtctgttactgtgcatctgaccggtgaatattctgagacttctcagagcccactgagtgtaggagctggggttcagccttcctgtgtctggctcctgaccgctcgctagggttaggaaggattaggccacaggctctgaaggagcaagaggggcaggagggcaattgaggggcaattgagaggaacccagaacatggaagccctgtgccgtggggctggtccagagctcaccaggctggaccacgtggttgctgagccatggcccctgaccggggctgacctggccagagtccctgtggccagcactgatgcagggctccttcctagaggggccgggccatgaggaacaggagaaacggcagatgatgcgggaaccggtctgttcggctttggtttgcaggatccgatttgtttttcatcagcagcagatttgcttaagtatatgaaaatgtgtttctaattccccgagcacacaccaactgctggcgggggagggagcagtgcataggagcagagtgaatgccaccgggagtcagagtgctaggccctggctgctgagagagcgagaatacgcccccagcctcagtttccccaactgagcagccggggaagatttggctagattaaccagttcattcaatgttccctgctgattgccaggtacattctgggagtttagggaaatccagattggtcagagacaaaaccacacaaaacagtggactccagtgcagacagaggggtcctagatgtataccccgggctcagcatagcaataatcattttaaaaaagattttaaaacatttttaaaactcaggtgaagttcacataacataaaattaaccagttaaacaacgttttggtgggtgcagtggctcacacctataaccccagcactttgggaggccgaggcaggaggatcacttgaggccaagagtttgagaccagcctgggcaatgtagtgagaccccatctctcaaaaaaaaaaagtcttattgtgtctaacataaaacttgccttttaaactattttacaatatacaattcagtacattcacaatgttgtgcaaccagcatctctacttagtcccaacacgtttccatcgccccaatagaaaaccctgcacccgttagttactccccatctccttcccctgcccctgaaaaccacgcgtctactttttgtctccatgaatttagctatgctagacatttcatacgaatggaatcagacaatatgaggctctttgtgatggccttccttcactggcaaaatgtttccaaggtttgtccacattgtcgcatgactcagtgcttcattcctgtttatggctgcataatatgccatcctgtggacacaccatattttgtgtatccgtttcctaactgatggacatttgagctgcttctgctttctggctattaggagtgatactgctgtggacatttgggtctcagtttttgcatgtgtgtatgtcttcatttctcttggctgtctacctaaaagtggagtttctgggtcacaaggtaattctatgtgtaactttttggggagccaccaaactgttttctacaggtgctgcacctcttacgttcccaccagcaatgtacgagaatgccagtttctccgaatccttgtcaacacttgttattttctggttttgttttgtcttattaggatgagcctagtgggtgtggggcagtatcccattatggtcttgatttgcatttccccgatagctaatgatgtcagtgtgcttcttagtcatttttttgtttttgtttttgttgtgtgttgttttgagacagagtctcattctgtcacctgggctggagtgcagtgttgtgatcttggctcactgcaaccttcacctcctgggttcaaatcattcctgcctcagctcccaagtagctgggattacaggtacacaccaccacacccacctaatttttgtgtttttagtagagacagggtttcaccatgttgcccaggctggtctcgaactcctggcctcaaacgatctgcccgcctgggcctcccgaagtgctgggaccacaggcgtgagccaccacgcccagcctattttaaatttaatgaactccaatgtgtgtatttttttcttttgttgcttgtgcttttggtgtcatatctaagaaaccactgctaaatccaaggtcagcagtatttacccccatattttcttctaagacttttatagttttagctcttatatctaggtctttgatccattttgagttaatttttgtatctggtgtaagggaaaaggtctatctttattcttttgcatgtggagatccagtttccccaacactatttgttgaagagcctattcttcccccactaaatgttcttggcaaccttgtcgaaaatcaattgagcataatctatgcacttacttctggactctcaaatctctgggtttttttgtttgtttgtttgtttgttttggagtcagagtcttgctctgtcacccaggctggagtgcagtggtgcgatctcagctcactgcaacctccccctcccgggttcaagcgattctcctgcctcagcctcccaagcagctgggattacaggcactagccagcacgcccagctaatttttgtatttttagtagagatggggtttcactatttggccaggctgatctcgaactcctggactcaagtgatctgcccacctcggcctcccaaagtgctgggattacaggcgtgagccacagcgcctggcctcaaatctattcctctgaagcatcaagcattctatgtgcactacttcatgaaaccctcctggatattctgcactgtagaaacgattactctcctgttgtgcccattttatagatgaggaaactgagactccaaaactgagtgaagtcaaggctcaaactcagatcccagtcatttgatgactaggccacagtgaggcctgaggaggggaaaaatcccaatggttaccctccccttcccctccccaccctcattttcttctccctctttcaggctgggatgtggacttggattctcagagcagggtccttggaaggagatgctgtgacttctctctggcctccaaatacctcctcagcctccagtccacctccgtccctctcccacgcagccaggcactgttctgtcctcttccttgtcccacagtcagtgcttgcatgtagcaggtacttaataaatgctgaagataattatccatcatttcaaatagagacacacaacttagaaggcatgctgggattgtctaaggccagaaaaaccccaatgtcgataagcatgttacagtgaaattgactgcgcccaggaaaggggaccccagaagcaggtggctggtgtccccctaccctgccccaggccccgagttccccaatccaccactaggaagtcctgggctcctgtgaagacaatataaaaccactgattaggccaagtgtggtggctcacacctgtaaatcctagcactctgggaggctgaggcgggcggattgtctgagctcaggagtttgaaaccagccagggtgacatggtgaaaccccatctctactaaaaatacaaaaaaaaaaaaaaaaaaaattagctgggtgtggtggtgcacacctgtagtcccagctactcgggagactgaggcagaagaatttcttgaacctgggaggcggaggcagaggttgcagtgagccgagactgtgccactgcactccagcctgcacaacagagtgagactcggtctcaaaaaaaaaaaaaaaaaaaaactactgatgaggcacatccccccctctcatttcctatgaaggagaaactgaggcccagagggttggagtgacttccttgagccccccatgaggagcttcagaccctggaggctccaccccaggccaagggctctcccagaggtagactggagccatgaggacaggggccctccccaaccaggtctctgtccatctacacgtgccctggatctgacttcacgtgatggcatctggtgggggacacaggatgcctgcccggatgccacctgcagccagtgggggccggagctgcctcttcagggtcagtgagggtgatacatctacttcccagcctgcttaggtgagctcccgcctatgtgtcactactggtgactggcatggctcagagccagatcttgggggccctgaggggatcaagagcgtcccctaagcccatctgccagctgcggtcttctctgtggtggcagcatcacagaaagtggacagaaagagtgctctgtgccaggagggcaaggccgggtaggatggtggctggaatgctggcgatcgcagcaatgccggcgatcatggtgctgggttttggtggtgtgctggacgcctgggagcctcatgagtgagagactggggcacacgtgcttccgtagtgccatgcaccggtggcaattcagagaaagacgctgtgcaaagcaccccatgtgtgcagctttttgccctctcgtaacaggacggagccaggtcagagtgcagatgaggagaggaaggtgcagggaggtggagatgctgacccaagtttgcacagccaaaactaggatcggtctccagggcctccgtcactgtcctgtcctgccttctgtcacacaggagttcgaatggtcgttctgaaattgagagctagcggggctgggatctcactgggcggccacagaggggtcccctgacctcttggggtctcgttggcaggagggaattgtattggaatatccaggtgtgtggatccctgtgaatctaaccctggagtgttccagaactgcccaccctgtggaaagggactcaggcctgtcttcaaggacctggcatccttctgtcccagggcagtttgtcttgggtctctcagggaccgtttgggcctcttcagcccctcattccacttccctcctgctgcccaagtcattcgtccacttgactccaagagtcggctggggaaataaaaggaaatgaaacacgaccaggcattttcccttggccgaagcagaagtctgctgtcgggcaaaaggtgaagaagagaccaatgagagatgagcccacggtgctcctgccctccaccaaggcaggccatcctctgctgccagcctgcaacagggcagtgtccttctgggaggtgtccctccctctgggggatcaagagatggccaaaagcaggtggcagcaagtggagaaggctgttaatccagaacgcaccttgtctctgcccctgtccccacccaggcaacatccaaaacctttgcccacagttctggggctggcaccgtcctggggctcagctcctagggacggggctcccccaggcactggctgccaggaactgggtggccccgggcaagtctcttcccatttcggggtatagacttcctgcctgtaaaatgagggggtctgcaggtcaacctcagagtcccactgtacccccagattctgcttcagggagacggagagagagagaaagagaaagaacgatagagagatgcaataacctcccagcatccaggaagacccagaggggagaaatgcagggaacctacccagaaaaccctggagcgggagcttctcacttttaatggtcatggccccacttgagaatccatggtgctcttcctagaaccacgcatgtgcacacgtgtgtgcaaacactgggctcatgcacaggcacacacacacacatataaggttgcaaacactttcagggacttcccagatttctctgagtccatccgtggtcactttcggtcaatcatctggcctgagcaggttctgccttctgggggctcttctaccctcagggaaatcagggtttggttccctgtaattgtctggtccaattgtctgaggactttctcttttttttgagacagggtctcactctgtcacccaggctggagtgcagtgaagcagtcttggctcactgcagcctcgacctcctgggctccagtgatcctcccacttcagcctcctgagcacctgggatcacaggcatgcaccaccatgcctggctaatttttgtatttttgtagagatggggttttgccatgttgcccaggctggtcttaaactcctgggctcactttcttttttttttttttttgagacggagtcttgctctgtcacccaggctggagggcagtggcatgatcttggctcactgcaacctccacctcccaagttcaagcaatcctccttcctcagcctcccaagtagctgggattacaggcacctgccaccatgcctggctaatttttgtatttttagtagagacaaagtttcaccatgttggccaggctgatctcctgaccttaagtgatccgcccacctcagcctcccaaagtgtcgggattacaggcgtgagccaccgtgcctggccatagccagactttcttgattctatatccttctcctcagagcagaaacatcgagcatttgttgagtgcctcatgtataccaagcccttaacctaagctatagctcattgaactctcacagaagtcttaaggtagagcttgtatttagatccgttttgaatatgaggaatctcaggttcagagaatttaagccacttgccgaaggccacacagcttctaagtagaggaggctggcacctccagcctgggccgcccggcccggcatccaggttcctaaacaggctgctcagctgacacgagtcgctctggatctcagaaagcgcctgatagacggaggcggctgtcatctgtgtgtgtgtgtgcgtgcgtgcagccatgtgtgctggtgagcatactgtccctgtcagcctctcctcccccagcacaccccggcagcccagagaagggagggcccggaggagtgacggtgttccccaccccctgccctttgagacacaatggagtccgctaatccagttacttgataattcacttatttcatgtctatttggcagcgagcgtgctcccacgcaccagctctggggaaggcgagatggctttgcctggaggaacctgattgtttttctggggaaggagtgggggaaaaaattgcacccaacaatggacaataatgggcctaaaaatagagggtggagggtgcagggggtggaggagtgtgctgtctgccaagggagggctccaggcctgtctgcttggcacggggcagccctaccctcctgcccagttcccctcccctgcactgggttggccgcctctcagcctagaggaggggcactggaaggaggaggcccaagtgggtggggggctgggtggccttccttgctgtctctgcccgctccaaaatggaaaattgtcccacccagggggtcctggaggcagcagccacgaccttgggtggacgctgcgcctcatcagccctgactagccgtgatgcccaggaccttcccccaaggggctcaggcatcagctgagaactgcagccttgggtacagagtacgggttgtctcccagcaggaaagggaggtttcaggttttgtggctcttttccatctcccaacacttggggcagtcttctcgaaggcctcaagcccagcgggcagctatgaccccaccaggagcggagcgggcagggaccaggctgccctctaagccactcggctggctctcagccggggtgcacactggacttgcctgggagcttttcattccccccctgccgcagctgccccccagaccagcttcagcagcctctctgggcggcccagcaggaggaggcattaaacctccccaggtggtcccagtgcacagccaagtttgagaagcaccgattgaaacctctcccaggcctgccctggagcccttccagcctgaagcatcttgtcgtcttaaaactgaaagaccaggaggaagagaattccatggcctgcctcggctctctcagagcctctctcacatctgagctgcaggtgctccatcctccttctggcttcctgggtgccgaggggtgccagctctccaggcttgggagagggccacttaagccctcacactttgttcccaggctcttcacctgtcttcctggaaggagggggccggccagcattagggctgtcacgggcgctgcttaatgtcaagctgcccatctggctcctggcctccctttggccttctctcctgcgctccccaccaagctcctggctcagcagcgtgcatgcgttaacccattgcccccctgcagtgttttgtgtgtccagcctggccctttgctcagtcgacctagagcaccatcctcccagactagtcgagtgtccctccacctgtcctgagtccagatgaaatcccacctcccccaggaagccttctgactgccccagcccgtcacctccagggcttgtcatctgtgccactcatggggaccaggacacaggtgacttctctggtggacacagcagaacggtcaacattcccaaaagggagcaaattgcccgagtcaccagaagtgtgaccttgagcaagcatctggctcaggggctcttggcttccccacctgtaggtaaaataacaggaacagtgtcatcgtgtgggggcccttccctggaccacctggaccagcctctcaaacctggccacacatctgagtcacctgctgagggttttggttagttggttggttaattactcgattggttagtttgttggtttgtttgttagctttcaatttggagtagaatttctgaccttagggcccaggaatgttgccacacccctcccgtccccaggtattgtcatgttttcatgggtggccaaatctaagagctgcttctctggggcacgaaggatgttcacaaatagttgatgaataagtgaatgaataaatcaatgaaacttaccagcccagcctcactactcgcacccacccccaacgacgagccagggttcatccacagaggggtgtacctgtccaggtgtccccaggtgtgggcagacccagtaactttactctttcatcggccccaccgcctcttaactcctcagagaccagcaggaagaaaccctcggaggtcgcagcttctggctgttctcaggggcaggccccgtccatcgggtgctgtgtctactcctaagacctggttctgagtatggaacacctggagagggaaggggccgaggagggggagtcactcggctgtgtcaggctccgcccctgccttcctgaagcacacagtggggaggggacacacccgtcattaaccgaagaagccactggggaaaactgtgacccagtgctcccttgggactggggggcagtggccaggggtgttttccctgaggaaaagaaatttaagcagacacctgccaaaggctggagggagagctgtagacagaagatggctcaacctgaaagctccgcggggtggagggggcatccaaagggcgggagagactggccagtagaaaacgaggccagaagccggacatggtggctcacgcctgtaatcccagcactttgggaggccgaggcgggtggatcacctgaggtcaggagttcgagaccagcctgaccaacatggggaaacccagtctctactaaaaatacaaaattagccaggtgtggaggcacatccggtaatcccagctacttgggaggctgaggtaggagaatcacttgaacccgggaggccgaggttgcagtgagccaagatcgtaccagtgcactccagcctggacaacaagagcgaaactctgtctcaaagaaaacaaggctggaaagacaagggagagaggcagagctggtggcagagccaggcccagggtttggacttaagaaggggaaggcgctggggctctgaggaggagctggagacaaagggaagggtgtctggctgcaggctgagaatgggctgggggtggggaggctagaggggtcggtggaggccccaaccaaggcggggcaggggagaacagagtgagcctttaggagaaaccactgctggggaccaggcttcactctcagcccatccggaaacctctttcagctgatgcttcccccgacccccttccccaccctgggcctctgttggaagctggctgaggccctgttgatcagcaagaaagcccagggcagctctcagagaagaggagagggggcccagaaaaggcccccaggatctggggaggggatccgaggagaggcagctaccaagcgccccagccaggggggcctgtccctcaccccaccccggcactgaaaccctcacagccacttttttcctccctccgtgataaaatattcatggcggcagagtgggccctctttgggaaggctgcctgggtctagcttatgctctgcacaagcttttaaagagcagggcgctgttcctactctctaagcattttctaagtcctgaatcaataatgcactttcctgggcttctccggatgtagccctcttcctctcggtgcctttcccccgcccgcccccttatctttctttcccttttcttctctcccgttctttcatccttccatctctcctttcatttactttttaaaaaagtatgaaagtgttgagctgtttgggtggccagtgaagccctgagtagggagtgggcaggaagggaggcgccagactgagcccctgtgtgtgcagggaggaggaggaggagtgggaggaggaggaggagtgggaggaggaggaggagtgggaggaggaggaggagggaaaggaggaggagcagcagcggctgagcgctcccgctggccctgctagggaagtgtttgaggatcactgagctcctggtgtggggaaggaggagggcttagcctcacccggcctccctctctcctttttctaatcaattagaaagtgtttacagcatagccagagaaaaatagggaacctgggaccaagaaaaaatgcaaagcaccggccaaatttcagccccacactcgaaggagggagcagtggggtttcacctatctgccttctgtggtaatgaaacccctgtcgctagaggtatgcaagagaaggggagccttaccctgtctgagacagacgcccatgtgtctggtccattctgtcagtcgcctgtggggtgccccagggatgcacgggcactcttcaactgggatagaatttcctgccccaaacattcctggaaatctggctgtgggaagaatccacatatgcccagggcaaagcagaatgtgtcctttaagaaaacaataatacatttttaagttcctggagagattaacccttgtctagccagagccatggcaatgcctccccgcccaccacactctggtggttcggctgacggaggagatcagtcattcaggggtctgcggtcctgatgagcagtgggtgcccacaccaggcctggcatttcatccttgctttctgaccttggcttcccagttgaccctctcccgggcagctcgtccatcagggcagcccaatgccctcaggtcctccgaaaggatctcagggtgttctgtgggggcaacccgaattggtgtaagaagactaagcagtcgatctgctggaacagcatccccaaagcggagcgaagcccgcggatgcccaccgcctctcccccaggcagcgtcctacctggatagaactgcctggagccactgcagagggtcctcgctcagttagggaatgtttgtcatataccgctgtgtgcaaacagctgttgggagtgtggcacaaaggtgggtaaggcccctgctctcccagagttcacactcacagaaggttctggaaggaggaacactgtgggcagggttgaaaggcctaaagtgctccctttcctcccaaataatgcggggtgaggggcggtgaggagagccgctctgagcaaccaaggaactgagatgcattttctgggtctccttttgagccgaggcaggttcgagaggcagccagagactctgggttcaaggtggacctgtgcccaggccatgcccactgtggcccccctgggggaggagcaggggcggtcgccgtggctttgggaggctcattgctgggacaagcgagtccctggggaggcagcgcttggaggctcgcttgcctgcccctgcctgagtaattgcttggagctgggaggaaaattgctccaaccagaaaacaaaacagaaaagccgccttggccagctgcagctccagccctaaaatgccaggttggtttacgctgattcacgagcggggagggtgaccttgctgtctgttgtccagggcctgtgcacgaagagaatctggaaagggaaggagagagacacctgcacgctggggaaggaattagcagcacagagagcaagagggacagcgatcaatgaaaccatagaaggagaatgagaaacacacacacagagagcgagagggagcaagagagagagagagagagagagagagagggacagaaaacaagagggagggagggagggagagctcagagagttagagaccgtcagggccgctagaattagaatcagctctgaacagaatctccgtttccgctttgttaataatttattccctctgcaacttttcttaccaataaataggaagtaatctgttaaggagaattcccctagcaccccggctttctccctggagtcaggggaggaggatgtgtctctgtgcccttcctccctagcagcatgggggcctgaggaacacgcagaacttgagactttaggatgtcagggtcagaggcggacagcccactcctgcccggtcattttgtgaacggggaaaccaaggcacagatagggcaaggccctggccaaggtcacacatggtgttaggggcagtcccctgagtcctaattccatggccccacgggtcagggcacctattgatttatgcacctgcccaagccatagggtttcccccgaaatggcagaggccacatccaaggaggagggtggggctagctcggctgcctttccttgccttcccccacgattgcttcccccgtgctcgagtcctggccctctacctgggcacccacacccagggcctctcctgggcagcctccagccttccaccttgtatgcggcagcagcctcccgtcctggtgaggctgaggggctgaggatgagaagggttccgttggcaaatcagcaacagcagtcaagagacgtgccgcctgcctccccgtggaacccgagtctgcgggagcacagtgcggcccaggcaacagcgtcctttcccttttgggtgaagggcaccatttcccaatttgtctcagggcccagctcagtgggccatcccctggcttcttatcccacctcagctgctgccgagccgcatgaccctgcgacattgctcagcctctctgagtctcggtttcctgaggatcgcactctccaggatccctgggagcgtgggaggtggggttgaggcacacagggcgcccagcacagggccgaggtggaagacatgctccctaacggcggggcctgctgtttgctgaagcaccaggccagacagtggccatgaatgtgctcccagcatccttcacccatgagctggcaccaccgaggcacttgccatggtgcacctggcatcattcctatgacaaccctgtgaagccagtgctagtaacctcattgagcgttcattcattctccgaagatttcccgagtccctgaggagggccgggggctggggctggagtggggacaggatcagatgtggtcgctgcccgcatgaagcctcccctccaacagagaagctgaggctctcgggcaggagaaagatcttttcctcacccattctatgttagtggctgagggcccatcataacagacagattaataccaccaaagcataccagtggatttaatataagttttatgtgaaaaaggctttaagcctttctttttttttttttttttttttttttttagacagggtctcactctgtcactcaggctggagtgcagtggcacagttacggctcactacagcctcgacctcctgggcccaagggatcttcctatctcagccacccaagtagctgggaccactggtgtgtgccaccatgcccggctagttttcttttttgttttttgaggtttttttctgtagagatggcatctccctgtgttgcctggcctcatgggagctttcataaggaatgaagacccaaaacattggtgaacatctattttgtatgctaggtttaatggagaaatagtcatggagaagtacgattggcttaaaaaaaaggtatcatctcctggtgataaactggcgggaattttgcaagacctgtgtgtccaggtccctctctgtgaccctgcatctttggagatgagaatgttccttcctccgggcattgggagggcacctctcgaatgagcctcatgtcctgcttcagggaagaagggcaggggaaggtcaaagagtaaccttccgcttctgtggttttctcaaatcccttcagcttaaaaaaaattttttttttgagacggagtctcactctgtcacccaggctggagtgcagtggtgtgatctcagctcactgcaacctctgcctcccaggttcaaatgattctcgtgcctcagcctcctgagtagctgggactacaggcacgaaacgctatgcccaactaattatttattttttttaatttttagtagagacagggtttcaccatgttggccagactggtcttgaactcctgacctcaggtggtcggcccgcctcagcctcccaaagtgctgggattacaggcgtgagcaactgtgcccagcctaaaatattttaagaaggttttagcctgtaatcccagcactttgggaggccgaggcgggcggctcatgaggtcaggagatcgagaccatcctggctaacacggtgaaaccccgtctctactaaaaatacaaaaacttagctgggcgtggtggcgggcacctgtaatcccagctacttgggaggctgaggcaggagaatggtgtgaacccgggaggcagagcttgcagtgacccgagatagcgccactgcactccagactgggcgaaagagagagactccatctcaaaaaaaaaaaaaaaaaaaaaaaaaaaaagaaggttttagggtagcatgtcctgggcttcattgggctcaaggaaattgggggactcgcccaagcctgtggagctggggagctgctgagggagtgagccagtgcatccctccacaaaccacagagccctgcccgggacaccctggcgatttcatcccaactctgagatttcatcccagcgcaggcttgggtgcaaggccagctgcatgacgttgtctgttcttcttcctgagacttggtgaccattccagtgaccgcccctccacggcctccttagtcaggggcctggaagttcaaatggctgggcttcccacaggcacatttacctccattcttgctaacagttcactttcccattcaattatgttttttgcctgcagcttgcctatgatgtttacaacctggcctctgactttgactgtaccctttgcacagaaaataacataaaaggaaaagcatttaagtgcccatgacgaggcttgaaaagcatggcatgaaatggtttctccatagaatatttcatgccaggagctcaggcttggcatctgtgtaggaggctcctcctcacccggttctctggtgctatgggcctggctggctgccttcccttccctctgcccaccctcctttgacttctagccacactgcctgacctttcaggtgacttgcctatgtgtgtccagagagataggaaagctgtagacatgatgggcttggtttccccaagattcctcaaggttgggtcccgtggagtccaggggatgggtaagtgatgtgcggccatgggtacttagtgtcttatctgagacgtggagctgactgtagcacctgcctcctgtgggttgctgagagggtgcagggaggagcggctgtgaagtgcccaacccagcccgggcacagggctggcactcagtgaatgttacaatcatcacactcttctgagtcagccgttcccgggacagtccacgccatgaagttccagggtttctcatgcacaagcctggtggtctcagcctcatcccttcctcctgtggaaggttgctgggagtggagtgtccctgagttaatacgaagctgctgtttcaaaataatcgctcccatttggagacatttcctagggattctaggtaatgtgagacacagaccatctcacatggcaatcaataagaaaatagagactcagagaagtcaagtgactttgtcaaggtcacagagcctcaaaggagagagctgagagggaactcagggctttcagacgccagggcccaaaactgtatggaaaatgggtatgttaactcatctttctttttttttttcttttagacagagtcttgctctgtcgcccaggctggagtgctggagtgcagtggcgcgatctcggctcactgcaagctccacctcctgggttcacgccattctcctgcctcagcttcctgagtagctgggactacaggcgcccgccgctacacccggctaattttttgtattttttagtagagacggggtttcactgtgttagccaggatggtctcgatctccttacctcatatccacccgcctcagcctcccagagtgcttggattacgggcgtgagccaccgcgcccggccattaccgcatctttctagagaaaatcccaagactctttttaaaaatcagcggtatgatttttgttgttgttttaattttcatgaaatatttaaagaggcagctactacttctgatactatcaaagggcggctttggagccatgctgaaaggctagaggtgtgcctaacagtctctccctatattaggccactttgttctgactgctgtttttgtgattagttgatctgctgtcctggagatgggtggaaacgcgcagacccagaggaggctggcaaaccttcacccccactcagaggagacactcccagtctcagccccacccccatgacattatcagctgtcagatgctgactggggactggggtggggggactggggtaaactggtcttctaataccccggtgggtccccagaattcccccagtgaagaatagaaggtccaggtgcaatggctcacgcctgtaatcccagcactttgggaggccgaggtgggcggatcacctgaggtcaggagttcgagaccagccttgccaacatggtgaaaccctgtctctactaaaaatacaaaaattagccaggcgtggtggcgcacgcctgtagtcccagctacctgggagactgaggcaggagtatcgcttgaacccaggaagtggaggttgcagtgagccgagattgtgccactgcattccagcctgggccatggagcaagattctgtctcaaaaaacaaaacaaaacaaaacaagaatagaaggaaagtgagaggaagcaatactgtgtttgtagaggaaaaggaaggtcaggtcagcgccaacagtgcctttgctgggatgctccacactcctgaccagctcagtggaattctgagaccttggggagcaaaatcagagggggacaaggagaaagacagaaagagaaagagggagagagaaaattgtgttggccgcggctcgggatttatttattgtacttgctgttgactgagctcgctccacagcaggcgaggggcctgtaaacacacaggctgattcattagtttctgaccatctgcttcccgggccggggcgggggccggagtgccccataggttggagcagccagcttagagcccccatctccagccagagccagctgtgtcagtcttcccagtgacagacaggccgggtgcaactgggggctttgagggataccctgtcccccgccacaatgcccccaccccatagaacccatcaggggcctgggcagggcagggctaagtaaggcaggaagatgaagagagaccagggaaaaggtgaagtgtgggtggctcagcagttggggatgacgggaatactatcaacactcaataggagatatgtcaatatcactgtcattttattaatagcttattaatatgatgataataataataagtataattgagtgagtggttactgaggtccaggcccaatatgcaggcctcactacactgtccccaataagcacattaacaactctatgatggatgatgagagaactgggttcaaagattgattcaagtcaggagggcctcctggaggaggcacatgtgggagggctctgaaaaccaggaggacagacagtggccaaaggagcacaggctctgaggtgggaggggacgaagtggcctgggaaatggcacagcttcagtgctgggttgataagagctttctgggtaggtgacgcagtgtgacgccacttggtgccagcgtactgagaaaccaggctggtggaggagaccccagagacatcctctggggaaataggatgaaaaactcccaattcgtctctacccctctgagccattcctcccggcctgttccctctttgctcacctggcatgaggcttgtcttagtcagctccggccaccataacaaagtagcacacgagacccaggtggcttaaacaacaaaaatgtctttccttgttctggaggctgaaagtccaagatgaagttgttggcaggtttggtttctggagaggcctctctccctggcttggagccagccgccttctcactgtgccttcaaacggccttttctctgtgcacatgggccccagcgtctcatccggcagccaaacttcttcttcttccaaggccaccagtcagattggactagggccaacctgagggtcccatttaacctcaatcacctcttgaaagagaatctgtctccaaatacagtcccattctcagatactagggttagggcttcaacatagaaatctgggggacaccattcagcccctaggaagtccccaggggcagcagaagcagcactgggacttcaggaagggagtgatggctgggctgggggaaggggggcatgtgcctgggtgccagagcccaggtgcaagttcttggagcatctgcccatcactcctcctcccgagcggcacagacagagcccattctgcatccaggctcacagcacccttcccggctgctggctccctcacgggtcaagcctgcctcctccagcccagcacctgctacccactcaggccattgggccatccccacagcctctcagtccctcaccattccaggcaacagcacaggacagggtgtgtcttgcccagagtcacccggccagtgagtgaggaagctgggaacccccccgccccatgtccctctgctgtcctggcatggtgggcttgccagtggtgtggatatctctgatgataacagcagactcctcctcagaggtgccatctgctctcgagaaggctggggccagtcctaccctggcccgggcctcagtccccccatctgcttaaggagatattggactctatggtgagctcctgccaccctgaggttgcataggggcctgaggacagagctattttggtcaaagagggatttgtggaacctgcctcaatgaaccgagggtcagccctgccaccgaggagccccaggcagccaggggacctgtccttcaccctagaggatagaagcccaaaggctgcggctgctgcagtggcacctggtgggggccgcggggctgtggctcagcccctcagaaggcggtgggccccatttcccccatgggggccaaacagctcatttgagagtgagaggttttaacttagatccaagccattttgtgtctgagcaaaccagacacctgaaacatgcatcagaaagggccacaagtggtccggagcactgggtggttgttagtgacagtgttcgtttttttctttctttctctttctttctttctttcattcattaatagactttatattttaaagcagttttagatttacagaaaattgagcagatagtacagaaagtacctaaaaccccatgccaccctcccccacccaccatctttccctgcctattatccacatcttgcattagtgggggatatttgaggttttgggggatttctcttttttttgttttcgtttttgtttttgttttttgagacaaagtctcgctctgtcgcccaggctggagcgcagtggcgcgatctcggcttactgcaagctcctcctcccgggttcatgccattctcctgcctcagcctcccgagtagctgggactacaggcgcccaccaccacgcctggctattttttttttttttttttttttttttgtatttttagtagagacggggtttcactgtgttagccaggatggtgttgatctcctgacctcgtgatccacccgcctcggcctcccaaagtgctgggattacaggcgtgagccaccgcgcctggcctttgttttggggaatttctttagagacagggtctccctctgtgatccaggctacagtgcagtggtgctgcatagctcactgcagcctcaaactcctgggctcaagcaatctccagccccagcctcccaagtagctaggaccacaggtgtgcaccactatgcccagctaatttttaaatttttttttgtagatacagggtcttgctgtgttgcctaggctgatcttgaactcctggcctcaagtgatcctcccacttctgccccccgagtagctgggactagaggtgcatgccaccacaccacacccagtttattttttattgtttgtagagacagggtctctctgtgttgcctgggccgatctcaaactcctgggctcaagtgaccctcctgcctcggcctcccggagtgttggaattccaggtgtgagccaccatattagtcatgtctgatgaaccattgttgatacattattattaactaaagtccataatttacatgagagttcacttactgtgttgtacaggtctatgggtttttttgtttgttttgttttgtttttgtttgtttttgtttttgtttgatacggagtttcactcttgttgcccaggctggagtgcaatggcacgatctcggctcactgcaacctacgcctccagggttcaagtgattctcttgcctcagcctccccagtaactgggattacaggcatgcaccaccacgcccgggtaatttttttgtatttttagtagagacggggtttctccatgttggtcaggcttgtcttgaactcctgacctcaggtgatctgcccgcctcggcctcccaaagtgctggattacaggtgtgagccaccgcgcccagcctgggtctatgggttttgactcattcataatggcatgcatccaccactgcagtattatacggcatagcctcactgtcctaaaaatgccctgtgctcggcctagtcatccctctgaccctggggaccactacgttagtgacattttcagatccctctggcctgtttccatcagtgacacttctcacaccaaatgtatgggttttccacaccaacaacctagtctccagctctctggacaccactgggtgtccgatgattccgttcaattgtaacactgcccagagctggcgtcagaaccctcaggtgaagggctcagtcgcaccacactgcccccacctctgacgcaattgcaagttcctgcctcccgtacttctgtccaattggctgtaaattgggggttcccacgacccctccctcaggtttgatagtttgctagaacagctcacggaactcagaaaggcattttccctacatttacctgtttatcaagttcaggaacagccagatagaagagactcacagagtaagggatcggggagagacccagagcttccaggccctctttgagcacctcaatgtgttcaccaatcctaagggtacaggtaaaaaggctcaggggccgggcgcagtggctcacgtctgcaatcccagcactttgggagggcaagccaggtggatcaacggaggtcagagttcgagaccagcctggccaacatggcgaaaccctgtctctactaaaaacacaaaaattagccgggcgtggtggtgcatgcctgtaatcccagctacttgggaggctgaggcaggagaatcgctggaacctgggaggtggaggttgctgtgagccgagatcgccccactgcactccatcctgggaaacatagcaagactccatctcaataaaaaaataaaattaaaattaaaaaataaaaggctcaggaaggtgactcagctaaggagatatttagagagtcgagaatgtgaatgggaatttttgaggcggacagagtggaagggcacatgaaggagacagaatgccatctgcaaaggctcagaggtacaaccaggcaggggcaggaggacagctgtcccggggaggcccaggcacactgtcaccaggtgtgggagggcaggttggggttggtatattacagagtcaggactctgtattccaggcaacggggagccatggagggcttcaaagcaggggactaacacccagccttcttggttgtctgtatttagagcaaggacaagtatgcattttttctttggaagccatgggattgcacacctctgcacgcattgaggaaatgggcacaaatctcccagctgtgtctgggcaccggagcacaggccctgtagccacagagcaggtttctcggttcgcaggcaggggctaggccgcgcagaggcttcccaggccatcccgagcatccagcacccacccttcccttctcctctccccgctgcaggagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtaaggccgggggaagccctggatgtcacctgcaacctgggatgctatctgttacctgggacgttattggatacctgggatgttacctggtatgtggaacatgaccgggttcttgggatgttacctggttccctgggcgttacctggtatgtgatacatcgttacctggttccccgggggttacctggtatgtgatacatcgttacctggttccctgggggttacctggtatgtgacacatcccctggttcttgggatgttacctggtacctgggacatgacctggttcttgggatgttatctggtacctgggacatgacctggttcttggaatgttacctggtacctgggacactatctacttcttgagatgttacttggtttccaggaggttacctagcacctgggacattacctggttctcaggacattacctgatattacatcatagggactgcctaggatggctggggctgcacagacccaatgcctgagcttttccacggaagaaggtgcacatgtcggaggaaggaagtgcatgtgttggaggtgtggagggcaggagtggagcctgtctgggcagagctgggctaactcctggtgctgactgtgagaagtgctctgaggctgtccactgactcagtgaatgggctctcatgttcaggggtttccgagaccgccctcaggctccatgattcactagaaaatctcacagaactcagcaaagctgctatattcacagttatggtttattacaatgaaggatacagattaaaatcagcaacaggaaaaggtgcacagggctgggtccaggagataccaggtgcaagcttctcattgtcctctcccagtggggttgtgcaggcagcacttgattctcccagcagtgacatgggacaatgcttgtgaactatcaccaggcagggatgcttactgaagcctcagtgttcagagtttttactgggagatgatggtataggcattgctgatgatctggctggcctttggctccaatccctccagaggtcgagctgatactacatggcccaaggcataggctctctgatgtggcccaagacccgcaggcaaacatggacactcttcctagacaggacagtccaacggcttatggattagaggtcacctagcagaaaccaggccggagtcagatctttctttggaatgtgcagggtgtggacaacccaggcctgctgtggcagctctttcttgcccagctctggagaggaatgtgttttgaggaaactttgaggaaggcaaaagactgtcataggagatgaaagcagcctttacctcccaaaaactgtttagactgtggatgattaaatggttctgtgttgtcctgggtcatttgtacttttggcagataatatgccagtctgtgggggcaatgccatctaccctgggccatctgtagaatggggatggtaacaagcataagtctcttgctggattgtggtgagggttaaatgagttaaagttgatgaagcacaccgaacagtgcctggcacataatacgcactaaaaaaaagtgtttaataaaaaaattggacaaaataatggagtgagagggctggggcgggctgagggaggagagagttgagacccaagggtgctggggcagtccgggccaggagcctggcttaggcaggtgcaggcaggggctgcacctggggagcccagctgggatgatcactgtgggcatctctccactgcaggctttcaatgtccacccaaatctgtaattcctgacaagtggaaaaagtgatttgccgtatggcaggtagagcataatcctgtttttgtaaaatatataatatgccttgtatatcatttctgcgtcttgaacagacattggctgtaagtgtgtacaggaccgggaaaaacatcatgggttggggagaaaggctggaagcccgtttgccagccatgtgctgtggtgatgcctgtgccgtgaggctgggcaggccgctgtggtgctgctgtttccagcttgtatttgcattttgtttcactttgacggtgtgtgtggattccaggtgggcaaaggcaaaggcaggtcgttcatgaagctggagtcagcttcaagtctggcagatgggagtgaagcaggtgcagacaggggcccgtggttctgacacccgtgatctctaacccacctccaattgggacaggatattcaaaatcaggaatgttctggaaaccaccccatatataggcactgttgtggaactggtgtccagactttcagcccctgggcatctccgtgacctctgccctcgggatgcaattgtctggttgttactagacacctgccaatccctgcagtcccactgggcttagcagctcagggctgggaaccagctccccaggccctgcaggctcctggcttgtcttctgaccttggactgctcagggaaaccctcatcttcaggcaactgttcaaggaccctgccttacctttcataaggtggctcatgtggggccctcatgtctgggccagctgtaggatccagactgggactgtgatgctcagggcctggtggtgccccttcaaccccagcagggtgacctggggttcaaaccctgcctctctgcatcctgccttgatttcccatctgtgacaagaggcctgaggctgcctggagcccatgtctccctggaggtggttccgcttggcacccagcctctgcgggcggcggggaggagccgaggtggtggcgagagtgtacaatcaattcagagagagagtaaacactcttcaggcggcagcttggcttgtcgttgaactcggttgggttagacggttcagcgaaggactgaggttacctccccttttccctcttcagttccgctgggaaagtccagccatgctgagaagccagagacacaggactggtggcaaagggggatgtgggacccgaagttcctgagtgggcaccagggacccctgggggttcccaggctctgggattttacaccgatcctgttctggggattccctcagaatttcgtgactgccatgttgcccagtggctccgctgtggcccactaacaagaacagcaaacgtttatcgagcatttgctacgggctcatttgctattgagcgctgttattaacggcttcatgtgtattttcttgtttaatcaatagccgtttaattccccaatggttattgaatggctcagatcccacaagccaaagacacggcactgagcaagccagacctgatccccaccccctggagcgctccccgcgggggcagcgctcccccagcctcgtgttttcagatgaagaagccaaggactctgaggtcagagaatagaaggagattgcacagcgccactacatggcagacagctaacatctagacacaagcatgtccaggctcaagacagactcagccaccgagctgtccctagccctggcccggtggctgcctcatttctggttccagctctgacttgagcccacctggagctcaggtagcctgtatgatggagcgatcccacgggactcccctttgaattgaaggttctttgatgggtggtggctccctgctctgccactcaagtcagtgatttccagctccaagggggaccccaatggcaggcagcaatgtaggcaggagggggaggacagaggcacctggctgcagaggaggagctggagcagctgcagcagctgcagccagcccagggccctgggaaggagggactggtacaaatggtgagggggacaagaggtggggacagactgagctgcagccccacagggggcaggtgggctgccggtggctctgagagaagcacaggcacccgcaagtcccagccacgccccctccctgcctcccgcggagcctgctccacgtgcccattcctggaaggcaggcagggggtgggagctattttctccttccacacatggggaaactcaggtgcggagcctggagagtggctggcttcagactgtgcagcaaatctggggcagaatctggatttgaggaggaatgagatcatccctttatggtgcttggagcgggaggggcctccgcccccaccctccacacaaccattaagagaagcggggcccaaacctgacccagcatctcacaggagaaccatttaagacagggttccccagccccaccactgagagctttgggaccgggaggcttggggtgaggtccagaaggctgtgtctttgcaaagctcctcaagtgagctggaaaggtggaagctgctgcatccatggagatggatgactgtaacctgttggaacctcagttttctcatctgcaaaatggagaaatagtaatgacttcagctgcctgttgtgaggagtcgatgaaatgctatattcaaagagcttatcccagtgtctcattcctctggttagacggtgggagagggaagtgggggaggcttggggtcagggctgcctagatatgaggccattcctgcacccaccccaggtactagaaggagtgtggaagcatgcctctgggttcacaggggttgcaatcccaaatgtctgcagaggctggaaacacaacttacgtggaagccaggcatggtggtgtgcgcctgtagtcctagctacttgggaggctgaggcagaaggattatttgagcctgggaggttgaggctgcagtgagttatgatggtaccacagcactccagcctgggtgacagagagagatcctgtctctaaaaaaataataataataaattcaaatgaataataaaaataatgagaagaagataatgtacatgggtacctatggtaccagcggaagcgatagggaagggtgtggcctggggagaaatggagacagcaggcgcctcacaagacagtggaccaaacattccagatcttctgcggttacaaaggaaggtgcacagaagtatctatgtaaagtctcttgctttcaaaaatattggcacctacttcaaaaagttgtttaaactctgtgcaaggaaaacaaaatacccctgcagcccagggcagctcacgagctgccagggagcacccctgctctgaaatgctcagtgtcctcctgcagccgtggtagcagctgcattcgatgggcccaaggcagggccaacacactggagccagggcaggggcaagatagcaaaacagcccagccagctctgcccactccagacctgggagtcagagggaagggggcatcatcccacgcaagttcctctgcccagaaaacccaggaagctccaggaaggcagcccagcgggtcctttgccagcaggaacaggaaaggaggaatgagttccccattcctggaggtattcaagcccagtgggtggtgtttgtgggagatgatgaagggaggtcctttgcaccaaattaaggtcttgtgtgcccattctgttcaaaaggaataaatgtggattaagggaacaggaaaggcaggtaccatttattgggaacccatgggttacgtgccaggcattgcatcctcaccccctttctgcccaggagcaggctgaagtccttgagcgagaggaaacccgtgagttccaagaggctgagctgggcctggacgggcagatctgagctccagactggccaagcccggctcctgcagacccagcttccccagaccctgtgggggtctagctgctctatgtccctgggcctcccccaacctgttttttcctcaacaccctcccctctttcttgccttcttgttttcttccataaacgtcctgtccctattgatcgccccgtaactggagatggacggacaccggactagaatagaaacagcagagggaagaaaaccatggagggtgggcaggtgggcgcggggaggggagtgcagagacaggcgatttcagccaccctattcctgtacccaccctccctgcatctctttctcagctgctctacaggaaaaacaggggcaagaagggaattctgtgatgttattctgcctgcactgactccttgaaactctgggaaggcagagacaactccctcagcaatattaactgtcattcactgagaattcccatagcccaggtagcatcccgagtcctttatgtgcatttcctcattaagtcctatcctgtgaggatcattgtccccatgacacagatgaggaaactgaggccaggaggttgagatatagatggaagggctgggtgtggtggctcgtgcctgtaatcctagcactttgggaggctgacgcaggaggatctcttgagtccaggagttcaagaccagcctgggcaatatagtgagacccccatctcaatgaaaacaaaatagatggaggtacccatgaggatggctattattggaaaagcaaaaaataacaagtgttggcaaggatgtggaaaaatcggaaccttcatgcattgctggtgggaacaaaaacggtgcagccacaggggagaacagtatggtggctcctgaacaagttacatgtagatttagcaattccgctcctaggtatagacccaacagaactgaaagaagggacttgaacagatacttgtacacccatgtttatagcagctttattcagagtagtcaaaaggtagaaacaacacaactgttcatcaacaaatgaagacataaaatgtgacccatccatataatggaatatgattcagccttaaaaaggagggagaacctgacacacgctgcgacacagatgaaccctgaggacatgatgctaagtgaaataagccagacacaaaaggacaagtaccatatgattctgcttacccgacgtccccagagtcgtcaaattcatagagacagaaagtagaatggtggctgccaggggctgggggaaggcggaatgggggttagtatttaatggagacagcttcagtttgcgatgatttaaagttctggagagggatggtaacggtgcttgcacagcactgtggatgtgctaatgccaccagactgtacacttaacaatggtaaggtggctgggcgcggtggctcatgcctgtaatctcagcactttgggaggccgaggcgggcggatcacttgaggtcaggagctcaagaccagcctggccaacatggcaaaaccccatctctactaaaaatacaaaaattacctaggtgtgggagcgggtgcctgtaatcccacctacttgggaagccgagacaggagaatcacttgaaccagggaagtggaggttgcagtgaactgagatcgcaccactgcactccagcctgggcaacagagagagactccatctcaaaagaaaaaaacatggtaaggtgataaatatatacgtatattttagcacactaaaaaatgaaggaaatagatgggtgggtggtctccatgtcagactgtccaggtgcaaattctggattaggtgtgaccctgggcaagttgtctaacctgtctttgcctccttcccacctccacaaaatggagacaatcaccctggagtttaagtgagaccatccagagagaggagccacaactgtcagggatacagagaaagaacagcagatcacagagggcctggaggttcttctactggggcctatgggctcttaggagcgcaaagggtgggtttcaatcatccatggactccctgaaatatatgctaagtgttgtgtgtgtgcagtcagttggtgagagcccctagtttttgttccattctcaaagggggtccatgatcccaaaatatttggagagtccctggaaaggcagctttgtgttctgcttttcattttttaaacccaactcttggccgggcgtggtggctcacgcctgtaatcccaacactttgggaggccgaggcaggtccatcacctgaggtcaggagttcaagaccagcctgaccaacatggtaaaaccctgtctctactaaagatacaaaatttatccaggcgtggtggcgtgcacctgtaatcccagctactcgggaggctgaggcaggagaatcacttgaacccagaaggcggaggttgcagtgagccgagatcgtgccattgcactccagcctgggtgacagagcaagactccgtctcaaaaaaataaataaataaataaaataaacccaactctttggggacacccagctctttggggacagacattttgttaagtacagttcacacaccttcaactgcatctcccaggccccctgagctactgcttcccaccaaaaagcgggcatgcacgattccagaccacatcagcctccactgagaagtgccggtgttgggaaggggccagactatgctgaagagttggggggtggtggggtccactgccaaggcaggtggttgacccctggacctgcggtctcctctggtctttggctctgctccactgctgggtggggcggagagggcaggaggggcatctcggccttggccagggtcacaggaggcttggggagccctgcaggtgcttgggagagagtcacgcacagcaacgccttcccagcagcactaggcagaatcggggttccctcttctcttgcctaagaaggcatttcctctgcgagctttctcgccatcatattaattcactcaacagatgttttttctcagaccttgcagggatgaattaacacatatttctaatgggcactgccttggtttcttggagcctccataactaagtaccactaactgggtggaggtcaggagtctgaaatcagggtgcagctggcttcgctgtggaacctgcagaggggaatctgtcccataccctccgccctccgctcgctcctggtggggccggcagcctctggcgttcctgggcttgcagctgcgtcactccagtctctgccttgtcttgcggctgtccgctccctgagcatctgtcttacacgctgtctccccgtgtctcttcctacagggacaccaatcacatcggataagggcccgccctcctgcagcatgacctcagcttaacttacatcctcatccacatccacaaaaccccgtttccatgtaaggtcacattcataggcactgggggtcaggatgtcaacatatcttttcgggagacacgatttggcccacagcaggcacctatgacatgctggacacaagcagggtgccagggtccaagagcatggaggggctgacgctcccgtagtgggagagcagaaatcaacaaacccagtacccccaagtgcccacaggtgcacggtgagaaagaaaccagggcaaggccaggcacggtggctcacgcctgtaaccccagcactttgggaggctgaggctggcggattgcttgagcgcaggagttcaagaccagcttgggccacatggtgaaaccccatcacgacaaaaaatacaaaaattagccaggcatggtggtgtgcgcctgtggtctcagatacctgggaggctgaggtgggaggattgcttgagcccaggaagtcaagcctgcagtgagttatgactgtgctactgcactccagcctgggcaacagagcgagaccctatctcaaaacccagggcaatatgggagtggagctgggaaccaacctgagacctggacccaggggtcagggaaggccctccagggaggggggctttgaaggagaaacctgaagggggaacgggggcacggcatttgtggcagggggacagcaggcaggacaggtgcagtgccttctaaggactcagtgtgatgtggctgtggtgggtgagtaagattccaaagaagagcaggcagggccagatcacgccagccctgcagccccgggaggaagttggttttggttgaagtttggtaggagggctacaggcaggggagaggtgtgatctgatttccggtgtttggaaatctgagttgggggtggcggtgctggaggcctgcaggagactgggcgggccctaccaagactgacagcagcctggccgggttctggcagggacaggggctgtgatgtgggccgcctggaggtggtctttggtggcagtgttgctgagtagctgatgggagcaggcggtgggaggcatcatggaggactcccaggcatctggctttgagacactgggtggatggaaattttgccttgtcaaatggggacagaggtgaggggattttctggaggggaattttttttttatttcttaattttttatttttatattttcatacagcaaagtggaccttttgggggtacaattctaggaattttagcacgtggatagagtcatgcaaccaccaccacagcctgggcccacaacagcccgtctctccaagaactcccgtcccgagacccctggaagcccccatcctgctccctgaaaatctgctgtaagtggagtcgtgcggcaggtggctttttcaaggggtctccttcgttctcactgtgcctctgaggcttatggcgtggccgcctgcgtggctcgggctcctcactcctgagtaggactgtgccgtgtgcactgcacaccgtggtctgtttacccattctccgtggaaggacgtttcggtggctcccagtctggggcgattatgagtagagctgctataaacattcgtggaaaggtttttgggtgaacataagttttcgcttctcttgggtaaacacccaggtgtggacggctgggtcgtctggtgagcgtgtttaactctatgagaaactgccaggccgtcttccagcgcggctgtgcactggaggaagcctgacttctattttggacctgttggttgtgagcgttttggaggcatccggagcatttgggcctctgagtgtgaagcgcaggcgagactgggcgcggggagtcctgagctccgcggtgacgatgacgcccgccgtgggggcgtgcgagacttccgagaggagagccggggagccgggcgggctgcagccctgagatcagagacagggggaatctggcagggcggtgccccaaagccacgcgggagcggttcctgcagggcagcggccacctgtgtccatgctgcggcgggtccaagtggaggaggccagcgtgggcccatggacctgggaagatggaggtcacagtagacgcacccagagcagagcccgggagtccgggatgaaggccgtcgtggggtggtttcaggggtgaatgccaacacttttaaaagagtgaaataggggtaaaaaagagggggtgtaggcaagcttttgaaaacgttttgctcggaaggggagcagagagatggggtgtgagctgctgggggaatggggaggggagagggctcttcctgaaaggcgggaggcgcggcagcgttggcgttgggatgggaagaatccaccaggactgaagatagctgtggggagggcgggagggacgctggggacaggagccgaggaagtgatcggggtgggcggagagctgacaggacagagggcccaccagcatgtgtaaggaggaaaggctgactgatttcatatttaggtcagaaaccctgcttctaacaccttctagagactccatgtccatcttgacaacccagggtggcccaccctggtggctcacagaagtccctttgtcctgagtaaagagtggcacatcacggtgccagcgagcagcctgcctgagattccagctctttccatttgctcttttctggcaagtctcttccatttctccaggcctcagtttccccacctgtaaaatgggatcccgctcttgtaaagattgtctgagacttgcccgctcaagtcccagtactcaggaggtgcctgaggaaggggagccattgatcccttgaaggagtcggtattttgtcacctgaacacacagaccatgttcctccgtcactcgcctggggctgagtggaattccttggctttatctccagctctgtcctctgtcccttcatcagtcaacagtcatgcaggaatgagaagctcagttcatagtaggtatagccaaaggtactttggaggagagtgctgctgccaacagcggacgggggactgagccccacccagttctgcctgggccactccctctgggtctgtggccatgacacccggcaggctcctgtccccccgaccccagctctgtggcttgctgggcctcaccagctgcgattgggcaggacagatggggttggagaggggaagttgagtggggagaggacaggccacatccaggctcatcctcaggccttgttctgcccctgggctgggctgcctccctccacatctcagcagagggagcgtggggtgggtcattgtagaggatccctggcccttcatcccatgtgaagcctgttttagactcacagatgctcccttagatgtacccgccaagtcacacacacacgcagccattcactcatctgtaacatgcccctgactcacacataaacacacacctgccccacccacacatgtgaatccgcttccagaagcacccagtcatagacacatcacactccacatggctgccttgcacccctgctcacagacgcggacccacagggtgagcggaggcctccgcagcagcccggggttcaccagaggccttggcttgactgccctgggctcagggcttctctgtgcttctcccccatgttgaggcacccacttcatgcttgggttcctggaggcctctttccactctgtgggacaaagccccctctgggcttctaaccatccctccatcccactctcagcctgaactaggtcccaaggtggaccccctatcagcagccttgccccctagaagagaggtgcaggctggcgtcaggatttggtttcgggacatgactggcctccctccctcccttcagtcttgccctttctgtagttttttgtccctaaacacaaacccagtcacttctctgcacaatatctctagtggtcttctactgaccttagactcaagtctgtgctctgtgaccacagactttccctctcacctccttctgtagcctgggctctgagactcccaagatcagccaccccaaaggctgggtctctcgggctggcctaggggctagtccttctgcctggaacatgacctagccctccccagccttcctgtctggcaaactcctcacccctcaggacttggctcagagagcacctctctggagctcctgaaggctggagacctgtgcaaccagcccctcggtccccttctccagccttggcggcttgtgacaattccacagccttgccatagctaccatagctatgcacgtacacgtctgacacccgcccccataggctctgagctccaagggagcagggatggggtctggcttgttctcaccttagcaccagcacccagaaccaggtaggcgtgctgtatatgtgtggaattcattcattcattcagtcagtcagtcattcatttattcattcatgaacaaatgaacttacatgaacaaagaagtcttactatctggaactctttccagagaagaaagagactggaatataggcgctaggaggcagagaggcaggaccagctgggcttgctagcacccacccttgtcgcctcccacccttccaccatcacaccctgctccttctcctgttttccttgtgtgagaaatgggcctctctgggctaccacctgggcctggtccttccctcgggggtgttgggccttcctgcaggggaagaagaaaccttgctgaagtcagctaggctgcttaggctgggggtgccttcgcaggccctggtcatacccaccgtgtcacccctaagccgcacacccaagcctcccagcacccgcccgtcagcctctgtgttgtgtgcaaggaagctgcctctggctttgtaatgggtaataggatttatcaatagactgaggaggtgaggtatgttaaagcacttaatagaaaagggcttcgcacagaagcccaaatttgatttagccaatgaactcaattgccggcctgattgcgttccaggaggcgcagcagccagcatttgtccatgttaccctggaaaagccaggctgcgccaggcgaccaacccagaccacccagacctcccctctgcccccacggctctgttgttggttcctcgctttctcaggatctcaggtttgaatggcagtcctttgacccaaacagtcccaagttctccagcatccaacagcctccttccctctagtgcccaaggcttccccatcccatgaattagctagaagtgcagtttgctaccatgttcctttcaccatgatcctcaaatccgtgtgtcccctggtcacttgtcacctcttactcaagctggcctctgcaggcttccctcctgaccatttgtttcttctctggctgctgcccatctccccacactgcttgcctgagccaaggacacatctctcccaaccccccaaagaagaccaagatccccaggccacagtgtttcatgacgtcttgactcaggcctgggcatagcagatgggaattaccatgtagaaaagaaggacttgaggccgggcacaatggctcatgcctgtaacctcaacaatttgggaaggcagatcacctgaggtcgggagctcaagaccagcctggccaacatagtaaaaccctcgtctctactaaaaatacaaaaataaattaaaaattagccaagcatagtggtgcatgcctataatcctggaaactcaagaggttgaggcaggagaatcacttgaacttgggaggcggaggttaaagtgagctgagatcgtgccactgcactccagcctccagcctgggcgatgacagagtaagactccatctcaaaaaaaaaaaaaaaaaaaaaaaaaaaaaagaaggacttgagaggatttccattagccatcaccaaccttgaggccgtccatcgtccatccattggccacggccacccaccggctggggaggagaaacctcttggccatgtaagcccgcagccccctcccagggcagcatcattcctcactgcagtccaggtccccaaccccagctctgtgagtcctcagaaagcgagggcccttgttgcttcagcctcctccttcatcctgcagaacacgccagcctcccttgtgagcatctccaagccaccgtaagatctgggatttgctttaggttattttgcccataacccagaggctcatgaaaaatgttttttcccaaaacaaaagaacactcttcacccaaagataaatgcgctatctggcaagagaaattggaaaacattgctggctgtgttaaaatagtagtctaactttagcccccaaggtaccagagctctgcgaggccagtctcagtatacacgacatgtaataatgtggggacgggtggtaacataccaggaaagaaggaccaggcaatgtgattaatgaccaggaacccccatggtcctgcaaagaggtgctttgagacaagttggggactagctctcccagcccagcacctgcccaccccagttcagagccattgccgtgaacactctgaaatccccgtggggctttgcctttgcagagagccagccctggggcctcctcctccctgcccagctccagcaccatccctggctcgctcacccaaactcaccgcttcctccgtcattccccgcaaggagtggatgacatcactctttccggcagccaggagttgacctacattccacccgccctcctgtctgggagactctccaaaccccccgctcctctctccctgggaggagggaagggccccgctcacgatttttgtggagtgacggtgccaggcccgggtccagatggtgcccccgcagcagctcccaggcactgcctgcccctccctgcagcgcagggcacgctcctgcctggcacgggccagggcccctgtcatccttcatgtggctgtcaggcccccagctgggcctgccacgtttcccagagaactggtgttatctgggctgggctctcccctggaggtgaggcccggtgctgcctactaacagttgtggtctccaggggcttactagggactcatccattcaagaaaaagggaaacttagctgaaaaggtggctgtggctctgtccttgctggcagcagggccagcttccagcaagcaagtgagtgcgccccatgtcaggccgtgagagaagtcagggtctgagcagaggggccagacagccacacgggtgagccgggtagcaggtgggcctgccagatgaaatacgggatacccagttaaacctgaatttcagataaacaagggaatcgttgttttttagggtaagtatgtcccaaatatttcatggaatatacttgtactaacaaaatcattagttatttatctaaaattcaaaaaaaattttttttttttttagagacagggtcttgctctgtcacccaggctgaagggcagtgcagtggcacaatcacggctcactgcagcctcaacctcctggactcaagcgatcctcctgcctcagcctccgaagtagctaagatgacaggtgctcaccaccatgccctgataaattttgtgttttttttaatttttttgtagagattgggggggggggtctcactttcttgcccaggctggtctcaaactcctgttctcaggtaatcctcctgcctgggcctcccagagtgcccagattacacgcatgagccactgcaccaggcctaaaattcaaatgtaactcagtgtcctgtatttttatttgggaaatctggcaaccattgtggcatggggctctgtggggaaatgactccaagaggccagtgggggccaggcatggtggcttatacctgtaatcccagcattttgggaggccgaggtgggcggatcatttgaggtcaggagtttgagaccagcctggccaacgtggtgaaaccccatctctactaaaatactaaaattagccgggtgtggtggcgggcgcctgtaatcccagctactcgggaggctgaggcaggataattgcttgaacccaggaggtggaggttgaagtgagccaagatcgaaccactgcactccggtctagatgacaaagcgagattccatctcaaaataagtaaataaataaaggataaatatctggcaatatgttactgaatcctccaagaggccagggggtgtgtcacctcttggggcgccccaggggcctggagaataggttgattatctctattttggggagctgcaggctctgagagaggctctggggtgggtgttggacgggacagcatgaataaggggccctgcccttggggtcaggcacctcagggctgccaggtaaggccgatcttggcacctgggagcccatgtactctcatctccgtccctccctctatcacctgttggctgttgacaatagcaacaataataatagctgacgtttccggagggcatgctctgtgccagacccagtgctgagccctcgagggtaccagctcagcttgcccttccctgacccttgacagtcctgccacatggaaacagccacttcctagggttacaggacaccgactgattccccaaggctggtcaccttcctgcctttgcctagcttgaggggtcagaggtttgaacccgactgtctggccaccgcgctacctggtgctgcagcccagccgtgacactcaccggcctttaacccagcaggtgctccatgccggttgctgcacacagagctcccatgcattatccccttcctcccttgcttctttctgcaaacattgagcacctactgtgtgccaggcagtgtgttagacatttaccaaaaattaaacccagagaagtgacttgctcaaggtcacctagccaatcagtagcaaaacctgggtaagaatctggctgctgactcagcctctctctctctctctctctctctctctctctctgtgtgtgtgtgtatgtgtgtgtgtgtgtgtgtgtgtgtgtgtgtgtgtgtgtgtcccatggagcgttcttgctgccgtctgaagagctaaagccgtaggattctgcagtggggcaggggtggagagggaacagccctggtggcctgggaggggtccgctggcctcatgggctggccagcatgccctatctctatgttcattattaaatcatcctttctgatggatgagctgaaaagtgctgtgtcgggggatcaggtggcccaggtgatggttttctggtgagattgatggttcctgagggtcaaattcagagagcgatcgcttgggaaaattgatcccacagaagaaggggaaatatctgggctggagtgcagcaggagcccagactgcccgcccaggtccagatccaggcagaggctggtgccaggagggcacgtggcaaagggggcttctttcttcttctgtggctgcatttccttggctgtggctgggccacagaattggtaagcagggccatgggcagcaggcatgggggcatctggcttagtggcccctttcctggccttctttgtccccatggaatggacgcgaagccagcactgagagagacgcaggcagcaggtggctgtgagatccagctctagtgccatgcagccccgagtgccaagcctgcttcttccacccacagccctggcccttgacccatctgagcctcgcattctcacctgtaaagtgggaaggacagtgccttctgcgttttcacgaggatttgtttaataatgcatggcgtctgtccacgtaggagcactcagcaaattatttctatgtgcttgcttatttatttcatttacttcatctcccgagggccttccagaatagggcagagaaatcacagaaggcaggcagcctgaggcagggaggggaagggtgtgcctgtgtctgggggagctgtggggtggctgcagttccaggagcctgagtctatccaagagccagcacactgagactcttcaggctctgcccactgcctgcccacttcctaaagtggggttcaccagctgtgtggccttgggcaagttgcttaacttctcttgcctcatttccttgtctgtgaaatagagatagtcatagtatactctgcataaggttcctgtgaagaggtgataacttcacttgttgaaagctctgaggatccctggctctaggagctcctgagtataagaaatggaaaactggcatgtcctaggcacctgtttgtctcatgcaagagctttatagaccgtctcccacttgatccttccaacaactccatgaggcaggtgttactgccatccttattttacagattagaaaacaggccaagtgaaattcagcaactttcctgaggtcacacagtcgttggcagaacatcccaggccagtggggcccaggggatggggttaccatctctcagtcacccagaaagacaaaaggaaggcacacaaaccccagtgggcaccgctctgtgccagggcttttgtttcaccccaaccgtgatgagtgtgggtgatgtggccggtgtggtccatatcgctcctcagggccagtgtcactggtgtgcgtggcagcctgtggcatacacaagatattgtttcccgctcttcaggtgagaaaagcgagactcaggttggctaagaatttgtgcaggccacacagctgtgtgcaccatgagctgggcagaagccctgcccaccagcaccatgggggctcccggctcctgccacacaggccacccgggagtgcagacactaagtgtggctctgaatcgagctgcttggattcaagtcctgcgtctgccccttaccagctgtggaacctcaggcagctcacttcaccaccccaagtctcagtttccccatctgcacaacgaagataataatgacatgtcattcaggggattgctgtgaagggctaatgttctaattcgggtggcactctcagaacagttcctcatgcaaagtgagcactcacgcatcagctgtctacccaggagacttcctttgaggcacaatgtgatagcgttttgtttttttgttttttttgtttttctggtttttttgagaccaagtgttgctcttgtcccccaggctggagtgcaatggcatgacctcggcctactgcaacctccacctgttgggttcaagcgatcctcctgcctcagcctcccgagtagctgggattacaggcgcatgccaccacacccagctaatttttgtatttttagtagagacgggatttcaccatgttggccaggctggtctcgaactcctgacctcaggtgatacacccgcctcggcttcccaaagtgctgggattacaggcgtgagccaacgcgcccggccccaatgtgataggtttataaaaataggaaaacaaatctctgaagatttttaggagagatactgcaagaaaagcctggaagctgtaagcccttccctgtttccacacatcccgatcattcattcactcacagctttacccagatgtgattcacacgttgtacaatccacacatgtaaagcgtacaattcagtcgcttttaggttattcacagagttgtgcaactatcaccacagcagactttagaacatttccatcaccctaaaaagacactctggccgggtgtggtggcacacgcctgtaatcccagctacttgggaggctgaggcaggagaatcacttgaacccaggaggcagacattgcagtgagctgtgatcgtgacactacactcagcctgggtgacagagcaagactctgtctcaaaacaaaaaaaaaaaagaaaaaaaaagtcatctacctatcctagacattttgtgtaaatgaaattatacaagatggctgggcacggtgcttcatgcctataatcccagcactttgggaggcccaactgggaggatcacttgaggtcaggagtttaagattagcatggccaacatggcaaaaccccatctgtactaaaaatacaaaaattagctagatgtggtggtgggtgcctgtaatcccagctacttagcaggctgaggcaggagaatcacttgaacccaggaggtggaggttgcagtgagccaagatcataccactgtactccagcctgggtgacagagcaagactctgtctcaaaaaaaaaaaaaaaagaaagaaagaaagaaagaaattatacaatatgtagtctttcatcactgaccgctttcacttggcataatgttttcaaggttcttccatgtcatagtgtggatcagtatttcattactttttctggctgtatagtattcattgcctgcttacacattttgtttttctgttgatggatattgggttgttcccaccttttgactattattagcaatgctgctatcaacattcatgtacacattttgtgtggacatgttttcgtttctcttggttatatacctaggtagaattactgggcaactctaagttcaccttttgtagaacttccagaccactttccaaagcagctgcacaattttacattcccaccagcagcgtatgagggttctgatttctctgcatcctcaccagcaggtgattatccgtctttttgactctgcctatcctggtgagtgtgaagtggtatctcattatggctttggtgtgcatttccctgatggctgtaatgttgaacatgttttcatctgcttcttggccatttgtatgccttcttcggagaaatgtctgtgctgatcctttcctcattttaaaaactggattatttgtcattttattattgagttataagtgttcattagatgttctagatataagttcctttttagctatgtcatgacttgcaaatttttctcccattctgtgggttgtcttttcactttcctgacagtgtcctctgaagtacaaaaatatttagttttgatgaagtctaatttatctatttttttttcttctgttgcttttgcttttggcatcctgtctaagaaaccattgcttaattcaaggtcatgaagatttgctgctatgtttccttcttctttttttttttttttttgagacagagtctcgctctgtgctcaggccagagtgcaatctcagctcactgcaacctctgcctcctgggttcaagtgattctcatgcctcaggacctcccaagtagttgggattacaggcacccaccaccacacctggctaatttttgtgattttagtagagacggggtttcaccatgttgaccaacttcaactcctgacctcaggtaacctgcctgcctcagcctccgaaagtgctcagattacaggcgtgagccaccgcacctggctccctacgtttccatctgagagttttctagtttgcagctctttgatccattttgagttaatttttatatgtgatgtgaagggtccaacttcattctttttacgtgggtctcccatattatttatttatttgtttacctaataatttctttaaattaatatactttaaaaatttggtttcacttaggcagtatttttgtgatcccaggtcttatgagtctgacattaaaaaaaacatactgtgtattcaaaaacaaataatagcctgtagagctgttttacagtccatgcgcccatctcccccagtcatctcgtacatcccactttgggagccagtgctgatcatgatgagttttatggggagggagagtgtagcaggggctgatttgaggtaggggttgtgaaaggcctccccaaagaagtggcatttggcctagaatctgacaccacctctaaatattagctctaggagaaggggcagagcctgtagtacattccaggcagagggaacagcatgtgcaaaggcccagagaaaagcaagatcagaacatctgctggacagagacatggagagagagacaaagagacaggagaagacggagacatggagagaggggcactgagagagccagagaggccaagaggtcatacacaaacaccatgtccacacacaccgacacagaggcagtaccacccacagtgacctgcaaaagtcagagagaccagaagcacctgcattgaccaggtgccatgtgtgtgccagccttgccagcctttccccacacagtgccagctcctccctgcagccctgctagacagggcaattctctcctttggaagaggaggcactgtgcttgttctggggctcagccagcgagttgaagaggccgggacatcttctcctgttcccgaggaagacaggactgataggaggggctggccaggatggagcctgggcagagccagctggggagggacgtctggatttgggtcaggagaaaccaactgtatgactttgggcgacttctccctaccagcaccacccagcctgtccagctctgacatccaatggctacctattatcactgttacaatatgcttcttggattcggccggtcttctatgcatctttactaagccaaggtcaatgttatcacccaaagttgatggcaatcttttctttcggtagctgatatctaaaaatatcccttcctcaggccagcagtgcggagcacagccccggttccgtacagctgaggtgttcctctccagccagctcaggggggtgttagataggaattcagaagttgcgaattaaaacctccccaggtcagattttgcagacaaactcttgttagacaaagtcagacaggtttcttccctgcaggtcttgtcagagcctttaatctgctgagatgtattatgaccctcagtggagtgaggtaggatcaaggagcagatgtcaggggatttggagagcatcatatgcttgaccaaaaaggtttaagcacagaaactttctgtgccaaggaccatctctgggatctggcatctccagaaagaagggccgcccgtaccaataggtgcctgctgtccccctctgtgcctttcccagagctaagcacatagcagtcctgcagcacgcatgtggcaatggagggatgagaatgccagggaaagagtgaacaggctttttaatgctctatttatttcagcttggtgttccagtaaaacctcggcagggttagtgtccaggctctcaggggaagatggagttaaaatcacacagacttcagcggtggctagtgctgctggccagggctcttgctctgcctcagaattctgttccagagaattccagagacgtccttcgtcctgggaactgagcatcacggcacagtggatacatgtaacctaaagcggtgggttcctgagtgccccctctcccacggcccacccaggacctgcaggattctctcctcctcctgggaggaaaggcgtcagctcagaaactcactgccttctccactctggcctgacctcatgtttctaaataacatttctaaaacatggactttaggccagtcgcaatggctcacacctataatcccagcactttgggaggctgaggtgggcagattgcttgaacttcaaccaggagtttgagaccagcctgggcaacacagggagaccctatctccacaaaaaataaaaatgaaattagccaggcatggtggcacgcgactgtggtcccagctactcgggaggctgaggagggaggattgcttgagcccgagaggcagaagttgcagtgagccgagattgtgccacggcactccagcctgggtgacagagtgagactcggtctcaaaaagcaaaaagactccattgcctggatttaccataatttccctaaccattctgcaggataattcgaggacagagagaagaccccaaggaggaaggcagccctggttaccaaagctggcagatgggggttagctggaagccccagggctggtggacgcaggggccgctgtttccccacccagatccttgctctggaaggcggcccccaggggacccttcattcccactcagacagggacagaggcgggacagagccgagggaggagggctcagatgaagcacctggcaggactgagatatgagggaggccggatgcgaggagggagctctgcagcctgtggtgtccaggaggatttggggagtgtgaggtgagaaaacaaaaagcgtcacccctcccagtggaaggggagcatgaagagagaagaaaatgccagttacacatcctcaaaacaatctctgaatggacgagagccagtcagggggaaacggaagttgcagtgagccaagattgtgccacggcactccagcctgggtgacagagtgagactctgtctcaaaacacaaaaagatgccgcacaccccaggcgggacgggtgggcccaggtgccctgccctggtccaggcctctattcgcaggatctcactgatctctccctgcccaggcttttgtctcccagacaaaccagtctccatgaagcagccacagcgttataaaatatggcccagagcaggacacgcctaaccagtcaaaggcttgcagagtaaaatcccgcctccgtctcctggtctggcctcctccaccccccagcctcattgcagacctcacgggtggaacttctttcagccctagggctttcctcatgctcttgcctctttctagaaggttctccccttctggcccggcaactcttgatcctccttcaggtcttagtttaaaactgttcttcctggaaactgtggactcccgtgatgccttcttctttgcacaacccgtgggctcttttaacagttgaacactggaagaggtgtgtgattcgtattgttataattaatagactttatttttagagcagttttaagtttacagaaaattgagcagatagtacagaaagttcccatttccccacccccctgcacagtttcccctattttggagtatatgtgttacaatgatgagctaacactgatacagtgtcattcactagggcctgttatttacattaggactcactctgtgttggacacttcagtgggttttgccatatgcataatgccacatatctaccattgtggcatcataaagaatggtttcaccgccctaaaaatccctgtgtgccacctatttatcctccctccctgtcccctccaatcactgattttgttcattgtctccctgctagacccgaagcaccatcaggtcagggagccatctgctttgttgacattatactcactgttcccagctcagagcccctgccacataacaggtgcctgataaatatttttctttgcatattttaataaaaataggattctactaaacccattgctctgcaatttgctttttccaaatattgacaatatatcttggaaatcttcccatatcagaatatagagcacactctgtctctctttcactttttattatggagaatttccaacacaaaagaagatggtgtctgccatgatgaacctctgtgtacctctcacccgactgcagttaccaactagtgaatcttcttgtttcatctgtacctctgcccatcagataatttcatctgtaaatatttctatgtgtatctctctctgcttttttttttccttttgagatgtagtctcgctctgtctcccaggctggagtgcagtggtgcaatggctcactgcaacctctgcctcctgggttcaagcgattctcctgcctcagcctccccagtagctgggattacaggtgcaccatcacacttggctaattttgtatttttagtagagatggggtttcaccatgtcggacaggctggtcttgaactcctgacctcaagttatctgcctgccttggcctcccaaagtgctaggaatacaggcataaaccaccatggctggcccttttgttttgtcttgttttgtttttgtttttgttttgtttgtttttgttttgttttgttttgttttttttggagacagagtcttgctctgtctcccaggctggagtgcagtggtgcaaacatggcttgctacagccttgaactcctgggctcaagggatcctcctgccctagcctcttgagtagctaggactgcaggcatgtgccaccacactggctaatttttttattttctgtagaaacaggatcttactatgttacccagtctggcctcaaattcctgggctcaattgatcctcctgcgtcagcctcctaaagtgcttggattataggtgtgcaccaccacgcctagcctgtgtggttctctaaaagataaggactttaaaaaacataaccacaatatcatcatcacacctagtaaacattagtatctaatataggcaatgtccaaatttccagttatctcataaatatacgttccatttgtttgcgtgtttgattttacaggatgtttgaaccaaggaccagaggagcttcacttctgccattaattggtatgcttttgaggtttctcttgctctaggtccatcctttttccgtatcaattttttctccacgcaactcatctgttggaagaagtgggtcattactgccggagtttcctcgagtccagatcttgcggatggcatcccctggtgtcgttcagggtgatgctctgtcctctgtctttcctgtgcgctcacagctgggtctagaggcttgatctgattcaggttcagttgctttggcttcgggtgggggtgtgttcttctagagacgctcactgtctgctggcctctcagtgggaagttctgggctggtgcggctcagtgcctggagctatgcattcatcagggactgcaaattctctcgtgaaatgcttctataaaaagaagcttcccctcatcaactttcggttaccccgaggtacagtttatataggacaggcaggataaatgcttgattctttccctttatttaccagttttcagaataatgagtcgcctataaatatttgaatgaatggatgaataatacacctgtgaatgaactgacgggggtgtgggagttgggggttctatctgttgccctcaagggcgtggctgtgggccacaacctgacagcagaggtccagcctgaagccaggtgcctttctacacaatgaagtgcagcccatggccaagtctctgtctacaccaggtgctggcagcagcctctgtcacccatcaacccacatcagtcaaaggctagggtgatcagaagctgcattactaagaatctagcatctgggacaaggcagtatcatcactctccccaactgagatgtgaggaatccttgaaaccagcatcagagcagagaggagagccgcgcagtgactgcaggtgtggcctttggaacacggcgttgatctctctgcaggaaggggaatcaaggagtttctggcctaaaggttgggctggtggcctccagggtttcttcctgggcagcccaacaccctcctgggcccctcctgggaggcgctcctttccccagaggccaggccaggctgcccacaagctctctgacatctctgccctctcggtgtctccccaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtacgtgccatgccccggggccacgagcccacatggctataatcttccctgcccgtcaatcccaggagctgtggatcatacacacgcacacaaacctgcacacaggcacatacgtgtgcacatgcatgcaaacgtgcacacagaaacatacgagcatgcatgcacaggcatgggcacacatatgaatgcaaaaacacgtgcatgcacagaaacacacgtgcgtgcatgcacccccacacacacaccttgttctacagctcccaaacgccaggtctcataacaagtccctctagcatacctgcatcctgctgaatgctaagctgcccttccagccctggtccacagggaaacccgagaggagctgctcagcagcattcctgcaacccttcgccttcttgaccctgaaggctggcaggtggcccccatgggatggcagggagtgatggggtgggacccccacttcaggtgaggggatcagtagcatcatccctgatcataagcatctctggggtgtttggagcgagccaccaaggccaagtgctgcgtgttcagcactcacctccatcctcagagcaacccctgggaactgagcttccgttatccctttttacagatgtgtcctctacggcctgcaccagagtccccccgcacgtgctctctgcccacccctctcctgtcctcgcccagccatgccagggagccatcctcagggcctgcccactcacatctgcatcatagacccccttctgaggaccacccacccgggcgcgctagcgtagtccacactgtctccatgaaatcagaatgccaggaagcccctgggctgcaagtggagaaggccacagactgcccctggggtgggctctccctgacccccaccactgccactttacggccgttctcaagtgtgtggttggtgtccgaggccctcctaggcactttgtgcatctcgcttcaccctcacacagccccgcagggtggagtccttattacggtcccttctccagatgagcagactgaggcccagcgaacctcggggccctcccaggtttcacagtgagttgcatgccaacgccagggcttagggcagctactggatctgatgctcagaccaggcctgggcagtggcctcctgcaccccatctgggcatcctccctcgacgggtgaaagatttatgtgactttaggctgatcaaagctgagagccacgtgcagaggccatgacaggcatgtcacgcgtgtgctacagcaggcggtgagacaggcctttgaaggggtgacttggcaggcacccgacagcactctcgggtcttcaaaggcacaaagagcactccgggggctgacagcccactccagccgctgcctcctcccagcttcctgtccccatctctttgtggtccaaaccctttcctgaggtctctctttagtggccgtcactctctccctgactcacaaatttgctgccctttcgtctgtcctgagggccgctctctcttccctcctctctgtctcagttctctccaccatcacaccctccttttttttttttcttaaagataagtctctcactctgtcgtccaggctggagtgcagtggcgcagtcatggctcactgtaacctcaacctcctgggcttgagcgatcctcccacttcagcctcccaagtagctgggactgcaggtgcacaccaccaggcccagctaattttcgtgtttttttcagagaaaaggttttgccatgttgcccaggctggtctcgagctcctgagctctagtaaccctcctgccttggcctcccaaagtgctgggattacaggcatgagccaccacgtctggccatgtctggcttttttcttccacttgccccctgcgcctggagggttctgcccatctctggccacctgagactcttacctgccagtcacacctaggaggatccactgtccccaccctcacccccagtcaccacctccagtctagccagcgatggatagacaggcctgtaggggctgggcagctgggtcttccttacttaggggagactcctgagctggccccacctcctgcttccctgggagtccccgggaattgcctttgaggcccccaagccccaggaaggaggggtttcttctggcatttgcagggtcacaggtgaggctggaggcgctgctgtcctcagcacccaagtctcctgccttctctggggtgccagcaggaaacagcccaaagagacacagaggctaattttgccctcaccctgcccctaccgtgacccctcctcagtaagtggcaccgacacccacggggccaagtgcaagtctgggggtcaccttgactggagaccctcctcccgccacgttctttgaacttccctccatccgctccaagtctctcccaatgccatcctcagccctgcagcagccctcactcccgatgccttcccacctcctcaccactctgcccccacctggccagcccatcaccctccagggcccaacttggagcccccaggacctccccgtgccctgcctgatgtcccgcctgtccccacagagcctcacttggtcaccacccagtcctggcccttgcttactgtggctgcaccccgaggtgtcctcagggtctagcaggtggctgcccagacatggaggtggaggaaggagtgggtggggatgggcttgtcctcccaggcctccctgcctgtcctgctggccacagccttggcttgcccaggagaagcccatgggccacacatcccactgccaatcccacagcgtcctttctcgggaacaccgtggggaaagctgtggcaccagctccttccttttgcaactctgatgaatctcacccagggatttcaaggcccctggtcacaccaggatcataggcctcccccatcccctggacacacagagacacacctggattcaggtcaggcctcgcccactctcggctatatttctccccaagccgtgtgtcctcagctgtagaatcaggaccataaggaagttccctcatagggttcttgtgaggacggcacgatttacgcaggggatgctgacaccgtgcctggcacgtgggacgcactccacccgcggcagccgctcccatggcttctcagtgagttttccagccacactgcacttcttagacaggaacactccatacgatgtccctgtcctgcactggagggcccaaaaatctgaaataagaggaggagtgcgtgtgaagctcccagtggagcgtttggcacctgtccagcatgtccccaagggcaagtcacggctctgagattcagtgtctccttctgcaaaatgggccaatagtggttcctccctcccagggctgaagtgaggatgaaatgggataatccacccccgtccccacaccctgcaggtcatcatgattgctagcagttgtgtggtggagcaggtgctcttgagggagcgacacctccaggtgctcccctgccctgctggcccctctgcagggaggtgacacccaggccccttcccctggggcagccagctcacgcccgtctctctcccacaggtgccactgcaggttcctttggcagtaagtacacgcctggggagggtggccagggcccccactgcacgagcctctttgcatgtcctggaaaaagctggagagaaaaaaggggcttcagtgtcccctctgggacttgggcctattcactccctcctctaattacaccccatctgcttctccacctctcccccctccacctccccccctccacccatccccacttcacatcatatgccatgtgtcatgtgtcattttgctgtggcctgtggcccagcaactctcaggctctcccaggagctccatcagtgctgctttggaaaacgggacaggactttttgcaggtctcttggcccctgggtgggctccctgctcctcctgccacccacgccacttctctcacctggatctgggagagcagtctctcctgccagtcaagagtggggtgaccttcccccaccaggggcagaatccaccccctagcctaaccatgggggcagcctccctctgggcagcctctgcagccagcttgtcccagggctctgctcgtccaggtcagctcaggtcccaggggagtcggaccagggaggggcatctgcaggaggtgggggtcctgagagttccccaggagggcgagggcgacatggcgcccacaggttatcagtaaatgtcatcgagactgtccccagacactcacagggtgccaggcacggtctctcctttcagccttgcaaacccctccccctgggaggtcgccatctgctctgcgaggcagcaggagaggactggccaatgtcaaagagccagccgggagcagaccccaaatctcagagatgcttctggggtgcaccgtcaccctccaccagggctctgtggggccccacatcccacccaagttgtccctcccggacccagggggcccctggctgggaagccagtgagccgagagggcgccagaaagaagctggaccctgcagggacgctggtctgcacagccgtcgtaagttgcttctctgtggtgtccccaccccggcaaccccccaaccctctcttgcttttcccatctctcaccaggcatcagcaggtcccagaaagaccccgaccccaaaggccctgtggccactgcggccaccacagccatgacaggggcccctactactcctgtcccctccacgtccactgcctgggcccccatggcgcccagcaccccacagcccacaggtgggtgccagggtacagcgacccctgtcatcccaccctctcctgcttctagcctgggtccctgcctctcttggggtgggagggtcggcagccctgggcagagagcaggggcttggctcttagaatagagacgctagaaccctagagctgggaggccacaggccaaaggggcttgaggacacctgggtcaacctgttcctgagcccagccaggggattcagggatcagttcagcttccaaagtcgtcttcctcctgcccttcaagccattgcttggaagggctcccagaccattgtggccagacggctgcaggaactgagaggaaaggtgctgggggcagcgaggccatcctgacatgcagccaaagactggccttatctcccaatggtgcttctgcctccgtggtccctggagccccgcccacaccctgtccccacctggcccccagggcctctctgtccttagcccctcagcagcacaccggtgggatggatggagcagggttagcccagaaagcaaatgtctctgatcagcagggcaaagggagcctctggagctgagtttggacaccgtgggctgctgggaatgtggaggctgtgtgtgtagtgcaaggccaggccagggccagacgtcctgccccctcaggggtctgccacagacaggcatggaaacctgattctcgctcccctccaacggagggattcacgtgtattcaaggctgggggtgctggagtgggcctctgctctcacctggactcacctggggagtatccctgcactctgtgcagtgcaggtgccaggggtctgaaaggatttatccttcccagagggcaccaggaagacgatgaccaaggggaattcttcctggtcccagccagggaggggtgctccaatagcctgccacaccctgtcccccgccaccctgcagggaggacctggtggggactcctggccccttgggtagtgccctggccctccatctctctgatccaaggagacctgccccactgatccttcccccttggggggtggcatttctaaagggcagagtcccctccatcagctcctgcctcggcctgttgctgggtggacactcaggctccccagacaggggcaaatgctgagagaaagacctcctccttcctaggccatccagagcagctcccctgggggcagcacaccccacctctttctacatccttccttttctgcaggaggcatttacaggaggcaggggctagccaaaagattggaggatttccgggaagcctcctgacccaggaatcctctttggggtggaagacatgggtcactctgagaattctggacttcagacataggttggcccagccacaagggacctgtgctttgctgctgagcctgtggtgggcagacagaagcaaaaacagtggtggtgggtgctgtgcctgtctccaaacaggggtttggctgggaggccagatactctccatatcacatgtgcaagtgcacacatgcacacacacacatgcatgcacacacacaggcatgcacacgcacatgtacacacacacacacacagaggaatccatttgcagagctgcttctgacttggtgccagggcagccgtgggaggctgggcagattgtgcaaagttgggaattaaagaggaaaagtcagaggccagagtgggaaatgcaggggaggtgagggtccccaggaccccctcagtgagcagaaggcacaccctccctctcggcaagacagtgctgctctgcaccctcagccctgtatcaagaagcaggacattaggggaggaggtggctccaatgtgacagccagtggcccctacagcccacatctaggggctcctccctcctcttcagcaactgaagcccctgtccagagcccccattaatgaaaacgatcattgcagtagctgagggtgagttctcctgggctgtgctcgtatcattgtatcatcatatcattgtattctgggctcacagctccgtgagatggaggctgttattttcctagtcccacaggtgaggggatcgaggcttaggaagaagcagctggattttatgatatgtaaattacacctcaatcaagctgtttcagaagaaaaaaggggcagctgctcaaggtctcagaattatggagaggcacgggcaggatttgaactcagggctcgccaactcagccacccaaagctattgtcctgaggcctccaggggctatgaggtagagctatcttttttttttttttttttgagatggagtttcgctcttgtcgctgaggctggagtgcaatggagcaatctcagctcactgcaacctccgcccccccaggttcaagcaattctcctgcctcagcctcccgagtagctgggattacaggcacctgtcaccatgttcagctactttttgtctttttagagagacagggtttcaccatgttggtcaggctggtgttgaactcctgacctcaagtgatccacccgcctcagcctcccaaagtgctgggattccaggcgtgagccaccgcacccggccaagtagtgctgtctccaaggcctggcttgcagggcttcccagttccaaaggagcagaccgggcttccatggggccttggcacagcacacaggccatggcgagaacttgcttcccacacacctgagtgtgtccctgggcagccaagccaggactctctccctccccaagaccctggtccctgaaagatcctgaatacccccgagtgcctcccaacaggtgcttcgggctctttgaacagagtccagctgggcctctgaactcctgggccagatgtttctcccgcctgccaatgtcaagctgtctggaggacagcgctgcgggcggaaaacgccgctggagacactaatcctttcctgggctgggccacggaggatggagggagacaggctctgaagcaaatgccttcagggctggctttctcatggctctaattaagcccttgccaatttgggcctggcggcctcatcttcccactgaacatcatattaaagtcaattcatgtccaaagctccccgctcccagctggaaagtcttccgcacttgttagctggtagcttttccttttctttccccacagccaccgttgtgtataatcccttcaagaagcggaaaacagcagcgctcccctgtccctctgggtttgtcctttgaaatttgggcacagggcagttctttgccagccctgcctgcctgccttgctggctgtgtgtcccgttagtctacgggctgagcgttgtgtcactggttcatgctggggtccctggtgaaaatgggccaggccaggggtcaggaaggtagaagggcagtgatcagggaagcaggtcagatgctggggaaggctccggtccctggattgcggctggacaggaaggacaccttccaggacacttctggacacatgtaagatcttggccggaacacatgtcccacttcgcagccattagccagagacatcagctcagagaggtctgggcccagaggcgggacctggtctagctctgtccttcagtcagaacggggacggcacagggagtgtagaagggtctcgctgaagaatatgcagattctcaggcatgggttcacctctcatctatcgggctttaagtctgcatgtgccctccacaggctgaaatagtgtagatgctgcctatgtagtagatttggacccaattcctttggccagtgtagacagagcctctccttatagtgctgctgcttctaaggggcctgtggggtgcggggctgtgatgcctcagtatgtacccagcttccctcagcaccaccccctcgcataacttggtttcttctcttcttccccccaagagtggaccaggccatctacggctgcccctctctcgagcaggtggtcccaggtggcctcccgtgcagaaggtatgggggggcaaggcctgtgatgggcctgagaccccggggaagcgccctcttagactcgtaggcccctccctctgtagtggaagtagcaggtgtgcatggtggggacctgaggttggaggggggccgcaggaaccaactgagggcacgggtgtagaatgtcggtgcctggggagctctagggcacagtggtgagggagcggcctggtagagcaggtctaccagctctgcccccaagctcacctgcttcaagaggttccatgtggcacccccacgccaagcccttccaccagcactccctccgagggcttcggagtctggtagaggccccgcctcccacgacaggaacccccctctccagctgcccttgctcacaggacacctgggcagttgctggatcagagagtcagagggggcttcctgcaggagcgggggccatgagacctcggagggtggactgtggtgggtgaagggagaaggcagcacattccaggccgcagggccagccggggcaaaggcttggcagtgggatggcagggagcctgacaaagtggaaaatgtgtgggttaaaggagggagggcggggtcctggaagacactgacatcctcctgctacgtgggaggagacacagggctcatctgtagccatagacagacatgccaaggaaacgcgcaggcctgcccgactctccagaagggaaattgtccctggccccagctcaccaagcctgggtggggaattagggcctgaggtctagggaacaggtgagctgttccttccagctcacatgttcaaatttcctccagccccagctctgagcagcgagcagggctttgagcgccctctactggcaggaagctctggcgctggaagcatgtttagagagggtctgaggctcggttcctagaaacctggaggacctgggcctggtgtcctctgtggtgatggagacagagctggcgggagccatcgcttccctaccctgggccaaccagggcaccacagacccccagagggaagccaaggtagtgacgatcccgggacagtggcctgctcacccacagatagggcgttggggtcccagcgggattctgggcagtggaaggcaggtgccgtccgtgttcctggcttgacagcacttgcgagtgggactccagggacagcgaaggattcacttcggctggagcaggaagagtgtttcagaaaggaagggagatgccaaagtccttaaatgccaagtttagtctctgggtttgatgctccaggaagtttggagaggcggtggggagagcaagagacgggcgtggtgtgcaatgtgatgtcaatctatctaaaaacagtttggcttccaagaaggtcttagcagggcgcgggggtgtcaggggttacagaagtcatttggaggattaatccagccagatgtgtccatggtctcagagaggggaccaagggcagggctgatttgcaagcttgggatgtgctgtgtttccttcaggaaggggccccacctccctgggctcttcgaggagaggggctgtgtgatttgaggccagaggggcctctccctccctcacatctgagcaggcgacaaggctgcctgccctagagctggcccagggcggctcggaagcctttgctgggctcttccctgggcagtgggaccatgacagacgaaagaacctgtttctcatctctccaagctgtgggcacccctgccgctgcccctgcccctgccaagggctacaaacttttccagctcaagcccaaatctcctcaagtgatgcctattgaagaattccaaggtaagaggatggacctggggccccatcagccctccctgacacctgttccccatccgccgctggaaaaagacggtgcaggatagaggaccgatgcctggctccgaaaaccctcctggagtagctgggtcaaggttaaactgagtctctcttccctacaggcctccctccccaagggagctgggagcaggtatgagtcagaagccaacttgggcacagtgggcaggccacacagcaggcagagcagatgccagaaatagcccatcccggctcccctgggaggtgtggccctggggctcgtgttggttgaagcagaatctgggacacacgggtcaccgatgctgctctttgggacacttagaggatgcctcatctcctcattatctctggagggacaaagtgaagggggcaggactaggtggcccacaggtgggagtgcccaccatctctcctgggcacaggctgtttctctagtctcccatgcccttgaccactgggtcagtccctcatcccatcacaaaagggaagctgggtcctctagagatacacagatggtgtttcaagagggtggccgttgtccttccttgttcgggggcagccacattggctttcttgctggagggtgggtgggtgggtgagtactgtgtcccttcgtaggaacatcaagggatgcccccccattcttagggatggtgaccttcctcaccaaatcctccattgacaatgtgggattcacctccaatccctgagagccttgccccaggcagtcacgggcttgtctggtccttggagcggagctggttaggcaggggtcagcctgagaaccacgtaggggtggggtgcaggaggcggcaggacatggtggtggtggtccttggtatgaaaccatgtgcttccaggagcagcgagtcagaagccgggccaggaccagggggaggcatgcaggttcccagggctcctgctttaaagtggcactcactcttagcatcctgcaaaacaatcaaacttgcagaaagctcaggctaataagaaagggtctggcaggtgggcgttttcctcccagccatcttccaaagcagcatgggcaggagctcctggcccattgcatcttgtccagcgtccatccatgcattcatctacccgaggataccacggcgagcgccgtgaacccaggcgtcgccctcccccagtgcacagccaggtggcatgaccctgccctccttgcatgaatcactttctaatcaccccggcatgtgggcatccttcagcgagcgcttggccctggtgcccagccaggcattagcaggagctgcccactggccctccctggttccctgcccacagggccaggtgggaatccctgggctcagcctactcaggttctcctctgggctcaaagcagggaggcctctctcttcctgaatccgatggaagggtgggaggcctagggcaccttccggtaccttttccaaagatgccttcctccgtccctgcatgacctggggtgagtccttcctcgccctgtccctcagtttccctgaatgctcgctgaccattggtatttctcccacttggccggcccagactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattggtgagagggcacggacacggcacagggaacttgctggaatgcgtgcagggtgcactgccctgcgaggtggcctctggggccccctgcatcagaatcacctggggagactgtgggaattctaactccagggccctctccagttgagcatctctaaggacagaaagctccagaaactgctctattagtaacctacccttgcggttctccggtaagttttgcactggagttgcaaaacttaccagtggcccttccctctctgggcaactggaggggacactgacccttcctggctccaaagagctgtgactctggcaggtggcaggcactcagtggcagaggccactgagcatctgtctggggctggtgtgtgggggggtccccctccatagctcctttccagaaaggtggaggagcagcctatccctcctcctgcaggggcccagttgggggccaaaagatcgccttgctgcgtgcatttgtgcaagtcccttcccgttcctgggcctcagcttcctcattcatcaaattgggaggcagatcagatcaaaggttttcagctcttttttgtggctgaagcttttcttcaaatgctttaccagcccaggtccagctataaagctgctcttcacccctggtgggcacccagtctgctttcttccaagttctactcaaggactggcttttgggtagagaaggaagtccatcagggccctgggcctgggcaaagaccaaagccatgaccgccaaccaaaacgcaccagcctggaatggttgcccctgtcgtcagtagaggccaggtctcggcctcaggggctgtcccccaaccctgcccagccaggccccttgggacaccatcacccatcccccacccagcaggaggctctggctgcccagaggaggggctcctgcaaagctggagctgtcggtctgaattctggcggcagccttcagataattccatcaactctaagtgatcaaagccgctgacgtcacagggggccagctgcagggacagggcagggcctttggatccaattagaggtgcccacaccctggcaccctcctcctctccctggctctccctgcctccaccccgagagccagcactgagctgcaaggtttctcagggtggacgatattcaccctctcccacagagccccaaggcaaccaactgggcccaccccgggagcaggaataggctgttcctccactcccctgcaaaggagctatggaggggggccaccccacaacacagcagccccagacatgctcagtggcctctgctgagtttctgccacctgtcggagtcatagctctttggagatgggaaggacagcgacccctctagttgcccagagaggggaaggggctgacccaggccacaccagtgccagggcggggaaggtggggctgggacgtgtttgatcccaaggaaggaagccagagtcttctctccaggcctggccaccctgggaagtccccacctgccgtccagccgcgggctcacgtggacccagtgtggggagcatcccctggggagtgtggagatgctccctgcgaggccgggagagtgggggtccgagaagacggcgcccacacgtagccctgaccgcgcgcccgtgcccgtgtccgtccagagtgtaactgcaaccagataggctccgtgcacgaccggtgcaacgagaccggcttctgcgagtgccgcgagggcgcggcgggccccaagtgcgacgactgcctccccacgcactactggcgccagggctgctaccgtgagtgcgcgccgtcccccgtgggcggggcctgcggaaaggggacggggcaggaccgaggcagtgggcggggcctagtgggacggggcaggggcggtggactgggcctagcaagacggggcagggccggggaagtgggtggggcctagtgggacggggaagaggcggtgggcggggcctcgcgagacggggcagggccggggcagtgggtggggcctagtgagagcggggcagggttgggatagttggcaggggcctggtgagatggggccgacccgggggcggtggacggggcctagcgagacggagctggcaggtgggcggggacaggatgctgctgaggtccggggccgggccgaggggcgggtccaagagctcggggcggggcctgatgcgacctgaggcacggtggtgcctggtgggaactacgagaaagaccgagctggggttggttggaaaggtatttgcggggacagagggagggaggctgtccaagtcggcgttagccgcgggcacagggtgaaaggaggctccaggcgcgtggaacagcacgtgcacagctctggagactgcaggcgcgtctgaagaacagcaccgaggccagtggggcggggagagaggggcagcggtgggaggcagccgggggccagatctcgcccgggcgccgtcaccctccgaggggggacgtttcgcacccagcgcgcctggagcctcctacatccccggcccagacggcgcccccgggatctcgcacaccctgcttcgcaggagctcggaggttggcggggggaccgggccaccccccgtgctgaccgccccctccgcctgcagccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcc

SEQ ID NO: 1629 - DNA, 19743 bp, Homo sapiens
gagctcaatccctgggcagggaaaagggggtcctcggggctccccgctcgctgtcctttttctggacaggcagttccttggccacctggtagggccgcgttgcctggcaacggcggggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagtaagtcatcccccgccatccctggggtcttcccctgtccccctctcgcggccgcatcatccgtcccaggggaatccgatcccacactctgtccggggatttccctcttcgcaccgagcgctggggatttattaagcagccagggttaccacagcttaaaaaaaaaaaaagaaaagctctgcagctgtctgcaccctgtttccccaggtcacccgccgccgcaaacacaggtacacacccagggggcttcccggagttgagtcccaggaacccctccttcgcccctccgtcgggcccgcacatggagcgggttactcgatggtgctttctgagactccaccccctgtagatccaacccggggcctgcctctgtcgttgctgctattgtttggggccgactttccgaggttcttggctggctttgtctactgtgtgtgtcctcctctcgcgcctctttagcttcagaaaagaaaaactggtcccatccattgtcttaattgtttcagtgactttattatgaatggtcctcgcctctccttgggcaaacgggtaaatactggatctcggggtttgtactttagtttttctttactagctaaacatctttgggatgttgaatgaaaataaagattcgaaacaactacctatcttaaacttcaagcgcaaggtcaagtagtaagccatagcgttccttttagttgcttagaggtgtaaaaactttccatatatccttgatagaggtgtacgcttacatgtgaactgtcagtgtatattcatacattcaatagatatttgaataccattctgcttggtgctgccccatgttctggaaataaagcagtgtacaaaacagaacccctgccctcatgaagcttacattctttggcaagtcaagcacaaatgataaggtcctgtcaggtagtgataagcactgtaaagatgtgtatccgcacatagagaacatgtttatgtgttcgtaaactcttattttggaaaaccattgaaaatatgagtcattagctataggtagggtgcagataaccctcatcactttgtagcatacttaattcaagtttcaaacatctttctgttgttagattgttagtcagcttgtatgactaagcttcctctaagatcttcttgaagaagatatgaacacatttgttcaagtgtaaacaaatcagatagacagatgcaaccctatgaaattgagaaatacaaaaggagggaggcagaagaaaggtgatttaaaaggtgtatcttctgctgtaaaggaatttaactgtttccaaggatgttcatccgcacagcaactcaaggaaagtatgtatgtcagtatagtagacatcgaataccttagcagagagaatgtaaagaaaggagggagtagtaaggggagagacttatggggcaggtcatctggtggtgaatctgcagcagtcctaaagaaggtagtgtttggtttgtaagaggaaggaaggaaagggcattccaggcggcaggaatgaggcattcatcccatgtgcatacacgtttaagtcatgaacataattaattattgtttgtataatgacggatcagtacatgagctcaagtaggtcttctagagagtccgagaaagtaagatgagaccagtttgtggacttggaaggtcggtatgaggaagttggcttcaatctaggaagtctttaagatgctgttacagtttcattagcatagagtgacctgctgtggttcaggaacattactggatagaggcaagaagatgattgttgtgatcagtgtaaaataaaagtgaagagactgggctttggcacaagataggcctatctataaaagggggataatgaagcgttgtttaggttttttggaagattaaacacacataatcacttggcccagttcttggcacgctgtaaatgctcaaggtgaaaatataatgagttgggccgggcgcggtggctcacgcctgtaatcccagcactttgggaggccgaggcgagcggatcacgaggtcaggagatcgagaccatcctggctaacacagtgaaaccccgtttctactaaaaatacaaaaaattagccgggcgtggtggcgggcgcctgtagtcctagctactgggaggctgaggcaggagaatggcgtgaatccgggaggcggagcttgctatgagccaagattgcgccactgtactccagcctgggcgacagagccagactccgtctcaaaaaaaaagaaagaaaatataatgcagttatacaggtatgaaggagtaggagtctggattaatgtcgtggttgtggacatgagtattctgataaaattttgactgtcattttgcctcagttaacatttaccacaactgctaactagtaacaggaaatccttatatagctctcttatagttgacaaatggcttctatgaaattaattagtaacatcttccccttctgtactgttgttttttttttaatatgcacatcacataaaccatcagtcatttagcagtctttttagactgattgaagtgaatgaatgctgagttgaccctgcagttctacaagagccctctgtgggttaaaactggtgtgacggtaggaatgtaaagaagtctgtgtcagcactttgatgactccacccattggcagtctgtggatttaaatctgctcggtgccgtgcagcatgccttcgcgctaacctaaatggtggacagtctgcagcgcagatgacagttttagtgtagcactgttagaaagctaggtactaaacacctttgaagcttttgctctataattctgttatttagattatgaatttgcaggaaaatctgcagttatgtaatagttcagacattaattatcagctgttttataagattgtatgatataaaggtggacagtataaatctgaaaagcaatgaaatagtgatttaagaatgtcagaattgtttttcccattggactactgatttagtgactcatctagtgagacatttgtgtatagttccaaattctgataatatttgtgtaccgaattgtattgtgcatcaattgttaggagccttagaaagtattaacttcatctgctacattaagttaaataactgttgcctgtctttggactctattacctgtcctcaagaagcttactgtctaaaagcttcaagtgaatttttgtcaggtgcttacaaaatgcctaacagttagtattaaaagtatttgccattaaaagtgatggtgaaaaccgcaattacttttgcaccaacctaatagtggtcaactggaaactggatggtgtacaattaaatgattggctgcgggcaggcctctgggagctggactttttaagtatactccttgggcatctgaatacttgatttgttaacagttttgtgatagggagagttggagggaggttcagtagtctagttgaaacatatgtcagaaattgctacacaaaaccctaagactttttcctaccagtcaagatctgtactgctctccatcctgtcaagaattcttcccacaatgagtaggaccaagggttgcttaagcttcctttatttcatcccgtgctgctgctttgggttaccaatcctgtgagtttacttctacagtagcttttatttgtagcaaatttaacctattctaaggagtattgcttagttcacagtattaaaggatttgatgaacaattttatatctacctttcatttggtacacaactttatgtctaccttgcatttttgcatacttttattagcattaaatatcttattaacatttacttaaggctgagtgctgtggctcacacctgtaatcccaacactttggaaggccaaggccggaggatcgcttgagcccaggagttaaagaccagcctgggcaacagagagagaccgcatctctacaaaaaattttaaaaattagccaggcatggtggtgtgcacctgtggtcctagctactcaggaggctgaggtgaaaggatcacttgaccccgggaggttgaggcggcagtgagctgtagtcacgccagctgcactgcagccagggtgacagagaggaatctcaaaagttttttttttaacttagtcctcagagtatattaacaattatcataggtaactttattgagcgcttaatatatgctttgatatattgacttatttaaccttcctaactttctgggacatgtattagtctcatttataaatgaggaaattaaggtcagaaggtttaagcaatttgcgcacacagagctggtatgtagcagagccagcatttgaacccaggtagtctggcgtcatagcacagattttcagttattatgttgtgcttcattatgtcatctcacaaatttcatctgcctgtagaaagcaccgggctttgattagcattgttttatttccaagccagccacctacacctcatttaattggcattttcagtctatgattctccagcaagtttcatagtgtatccaagagactactttaaaatgccttcctaaaatcaagatacactgcctaaaacaccattcccaaagtattccacatacttttggataataaagggtaataactgcctccctcacctccaaaaaaaaggctctgttgtttaaaaaggcaaaaaagtttggcttcctgtggctcagtaggtctttatagtagttccctggccgaggcatttagtgtcctcgtgtcacttttcaagggagaacgacatataaatatagtatttccaaagcttgtttggccatagaactatttttcaagggacaattaaagggagtagtgtactgtgaaacacactgtaggaaaagttagttctctattttgtggacaattttctatttacatttcattttatttgcttatctattatgtcatctagcaattttagcagaaaagagaataagaatagactattccagttaccctttttttttttttttttttttgagatggagttttgctctgttgcccaggctggagtgcagtggtgccatcttggctcactgcaggctccacctcccgggttcatgccattctccttcctcagcctcctgagtcgctgggactacaggcacccaccaccatgcccggctaatttttttgtatttttagtagagacggagtttcaccgtgttagccaggatggtctcgatctcctgacctcatgatccgcccacctcagcctcccaaagtgctgggattacaggcgtgagccaccacgcccagccatcctttgcttgtttctaatcatcactcctgtctgcacaaactattcatttgttaatacattgaggaattttctgttaggcttaatggtctgtagtttttgttatttatgtaccatttgggggatttttttttttttttttgcaaagcctggctccatcacccaggctggagtgcagtggcgcaatctcggctcacttcaacctctgcctcccagattcaagcagttctcctgcctcagcctcccaagtagctggggttatgggtgcccaccaccacgcctggctaattttttgctatttttagtagagatggggcctcactatgttgcccaggctggtctcaaactcctggtctccagtgatccacctacctcggcctcccaaagtgctgggagtacaggtgtgagccaccatgcccagccatgggggatattttttaactctttgttgcactctgattttctgatacatccccagttgtccagacttcatctaggatgtagtaagtggttctgagttaatgtcttccaagtgctttctgtgtcctggagggtaattcctctaggcttgaacatttaaactcattcaagtgacttttattatatccatgtgtgtcttaggctggaatttccttttaatcatgttctaccctttccagtttaaagagcagcctctttgaaaaaggaaattgacactaaaaaataattgaagcattctttttcttttacccatttctctaaagacagtggataaagtccttccttcttcctgctttcaacataacaaaacatcttttggctagtctctgctctttttggctttagctttcctatttttttatggttctgaaccactttcttttggtcatttatctcttcctccatctttgatgtccctttaaaatcttattaaagagctcacagctgggcacggtggctcacacctgtaatcccagcactttgggaggccgaggcaggtggatcacttgaggtcaggagttcaagaccagcctgaccaacatggtgaaaccctgtctctactaaaaatacaaaaattagctgggtgtggtggtgcacgcttgtaatcccagccacttgggaggctaaggcaggataatcacttgaaccctggaggtggggtttgcggtgagccgagattgtgccactgcactccagcccgggcgacagaatgagactctgtcttactgtcccatacatgttacgaacttggaggagggagagatgaatgaaagcttgaatgacctcaaaaggccttatagggagaattagatctggtaggatagatgggatttacatagggagaagaactaggcaagggagccggggaaagctgaggtgggaatgttcaggaatggcaactagaatagtctgattagagtgaacattattctatagaaacagtaaacaaagcagttggagttggctctcgccattatttgtcaatgaaatttcagataaaggacctaaagctggcatttgtattgcaaagatgttgtaaaaatctaaatatcaatttgtatcaaagatatatatagatacatattttcataaatttgttaacaccttttttgttttgtgactagttcaggtaaatgctctgttgaatcttaagaatcaagtacatctctcttgcatatattaattctaagaagaatatgggaaccaggctatgaataatgacattctgacttattttaaaaaattgccatctccttgagtaaatgctcatctgatagtttttatatctcttattttcaggttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaatgccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtaggtgtttattaacaaaaactctgaaattgtaaagcctgctttcttcatgagaaagaaatgacctaaattgagttcctgaagctcaacttttgctttgacattttttaggtaatttatttgcttgaggtgcagggtaataaataggaagcgtggattaatgcagaggatgcattcatagcatataaagaatattttgattcttcttcacactggccttgttagatatgcaaagtttgcaggatgagctttccagactggattagctcagaggctgcatttagctgagtagtatgtgatgggcaatcatggctgtagaaatatggtgcccatgctccctgcccttcctcttttgcaaaagttttgtatgggaggggtgtagtgacatgttttccatttgatagaacttaaggatatcttcagatttagtcaagaaagacatataaagtaaacaaattattactcatgtctcatttttacaaaaactgggcacagtctttattttggtaacagaacaaacttacctagaatgtattctatagaatttaagttgcttaacagagcactagggttcccagtgcatattaccactcaaagcgttctgaggattcctacagaaaagaaactgatacctttgtgtagctcggtattactcagacttcttgatcagagaatctttcttgcagctaacagttgttaaaatcctgaagaacttgtgttccaagaaatatactgtgttctgaaatattcaaaaccacaaatatctgtactcctttttacttcaaagactgatacttactgactaaagtcttatttaaagtattaattgaaggcagtatccttgttcttaatgttaagccattcacaatcacttgttgcactttcttgttggaaagaatgtgtatgtttgtgtacacacgttcgcctttgaaattattgctcatagaatgtttgcaatggtcttaagagtattaagatgcactgttcatgtaactgactttacttctttaaaagttaacttttggggctgggcgtggtggctcacgcctgtaatcctagtactttgggaggccgaggagggcagaacacaaggtcaggagaccaggagactagctggccaacatggcgaaaccccgtctctactaaaaataaaaattagccgggtgtggtggcgggcgcctgtaatcccagctacttgggaggctgaggcaggagaatcgcttgaacctgggaggcgaaagttgcagtgagctgagattgtgccattgcacaatcgacaagagcaaaacccatctcaaaaaaaaaagttaatttttaaacgttgtttcattgtgttccacattgtctggaaaagtattctggttatcacagtgccatgggacctggttaggtttattataagagtcagtgaaaaattagcaaaaacatgttagaaagtactagaggttggatttgtaatgatttagaataattgtccagatactccatgagcctgggaagttacatttagcatggtgatgtgattccaacatagccattttaaaaaccagaagattgcacacccgtccctgtttatagcaactgagtttattgaagaccacgcattcctgtcttaaaaatccaactatatgcataaaatgaagactttttaaacctaggatgttggcttattagcagttataaattattttggagattatcagcctagtatgctagtacagttaaactagcattttttaacctttttaaattatcactcccccccgaacatttttagacactttttctgaattgcccctgcccatgaagttttaatgtattttgtgtgtctgtttatgtactgtgtgtatatctatgttttatacgtaaaagtaagaactttttgtcccaagaactaatatttgctgctttggaaggactatcactcccattgagaatgtgtgagtcagaataacacagttgagagttcagcttgccgagatcagggctactgagaacaaatagcaatccttccttatgtaaaattgagatatatctgggccgggcacagtggtcatgcctgtgaccccagcactttgggaggccagggtgtgaggatcgcttgagcccaggagttcaaggccagcctgagcaacatggtgagaccctgtctctacataaagtaaaaaaaaaaaaaaaaaaaaaaaattatcctggtgtggtggcacaggcctgtagtcctagctacttgggaggctgatgggggagccatgttctcaccactgcactctagccggggcaacagcgagaccctgtcttaaaaaggaaaaagaaaaaatagaggtatgtatgggaggaattctgagtagtttttgtcactgtatcattatcaggatgtttggcctgtctagaatagcagagtgagtttggtcatctttgctgttagggaccatatgttagaattcttaagactgaaaagaaaaaaggccaaaaattaatgggatttaaatttgtagaggatatacagaagaggtaagatagctggcttaccaacttctgagctagtaagacaccctttgaaacgtaagtgaactaattttagtgaattaatccaaaatcttgtggattcatccataagaggttaagcagaaatggattcgaaactagaagggcgctatcactagtaagagaagacaactcttgagggttgtgtatcccagcctccaaattacatatccagtgaagttttaaaaaaaaaaaaagaattggattcaagttttcttttcagacttttatttttaaacagtataatctttttttttttttttttttttttactgagatggagtctcactgtgtcaacccaggctgatgtgcagtggcgcaatctcggctcactgcaacctccactcacgggctcaggcagatccttctgcctcagcctcctgagtagctggaattacaggtatgtgccaccgtgcctggctactttttgtatttttagtagagacggggtttcaccatgttggccacctggtctcgaactcctgacctcaagtgatccacccgccttggcctcccaaagtgcagggattacaggcatgagccactgtgcccagccaagagtgtaatcttaaagcagagaaaagcaaaactgaagcaaagaaaggcctagagcctgtgccattacctctctcactcccagcttcttgctcctatcgtgggtcttgccatgcctctgcagtggggtcagcttgtctcagattgcaggctactggaccatgttggccatgggtctttgggccatcagaatagacatttgtacagttctgcaaagagagcagtattccacataatattttgcctatagagattatgctttttcttcttaaagtcaaaacattataaataatagctaaatactttgtcttctaacagaactctgaaatccttgtttcagaagcaactaaaacaaggcaagtaataagattttggttttcagaacagttttctccttagtggttacagtttaccctgttatcacagagtacctgaataaatttattttatttagctagttgacacaggttgaaactctagttcttttatttttcagacagtataatcaggatttgtggaaatgcaaatctcctgtcttctgtaaaatattgctcttttctttttttctttattttttaattttccctttgtgtttgtaggctttttcttcaggaaatcctgcacttacactaaactttgctgactactttgtcttactaggtgctgattggacatatctcaaagaagatgaacaaacagactttccctgagcactgtagtttgtgtaaagagatcttgccattcacagatcgcaaacaggcagtctgttccaatggccacatttggctccggtaagccattttaaaagtttctacttctgctcatttttcagttttgtgtagcacaaactactgtatgtgacagaatagcaactttatgccagttatctgttgcccttgccaatttgttggagaaaagctgctattataaagcctgatgtggacttttttcatcagtgtcactcaagcaagttggcctttaaagacagttttttactgcttaatatataggagttttcttgttttatttgttcattttcctaattgaacaaattatggctcctcttcctagcctcactctaagaccttggtgtgtcctcatgttactggacctgtgggctgcatttggcacaattactccctccttgaagcactttcatcacctgccttccgggacacagcactccctggtttttgtcctgtctctgactcttcattctcagttgtctttgctgatgggcacctcagctgtctgtctttctgcctgtttttcttctctcagcactttccctgggtggttgcttatcatctgcacactgatgatttaaacatagagtttttgcctgtatctctccccctaagtctaggcttatatatctaactgcctgctcagtacctctatttggatgtttaataggcatttcaaattggaatccaaccttttgttcctacctctgcagccctggtccaaaacaccatcatctcttgcccagcttattacacctgtagttaccttccatctggtcttcccacttccatccttgcccctccagtctgttattatagttgtgatagtgattgtatcaaaactttgtcactggctacttgtttctgatgagtaaaactaaaaccctctcagtgatccacaagacgccacacagcctggggccccttcctccctttgtcctcccgctgacctcatctgctgtatttgtccatcttgttcgcttcactccaggcagaatggcttcattcctcaggtacgtgaggcgccctccacctcaggacgtctacactggctgattcctctacctaggatgctgttccagcagatgtccacgtggcttccttcagtttcccattatcagttaggccttcctggccaccatatctaaaattgtaacaccccactgacataccttcccctcccattactttgcatcctccttccttgcgttattattttcctccttaataattatcactatttaatatattttttccttgtccttcctctagaatggaaagctgtatgaggacaggaacttatgtgttttgtttacagctatttctagaacaatgcctagtacatggtgggcactaaattttttaattttttttttttttttttgagacagggtcttgctgtattgcccaggctggagtgcagtggcacaatcttggctcactgtgacctttgcctcctgggttcaagcgattctcccacctcagcttcccctatagctggaactacaggcatgcgccaccacacccggctaatttttttttttgtatttttggtagagacggggtttcaccatgttgaccaggctggtcttgaactcctgggctcaagtgatccacccaccttggcctcccagagtgctggaactacaggcgtgagccactgcacccggccaaatttttaacaagattgtgctacacgtaccatattaactcaccagttctgttatcaaaatgtatgtacatttttctacatcactacaaagataacattcttaatggctatagaggtttctagtgtatgaatgtttcataatttacccccttattataatttgttttttttccaatttgtattgcattcctacactttttttttttttgagatggggagatgaggtctcactatgttgcccatggcagactcgaactcctgggctccagtgatcctcctgcctcagcctcctgagcagccaggactatgggcatgtaccaccatgcctggcttctacactttttctaatttgagtgttcagactttttaagagaaaagaataggaaataagcttgtagtatattttaggttagtaataaaaataaaaacatatactgagtgctattaatatgccaggcacagtctaagctgtacacacttattaagttactatattatggtggttgtgaaaataagttactaggattacaggtgtgtgccattgcacctggctttctgttagttaagattgggtataactactgtctttaagactgacagtacattggggaaaaccctgacgaatattgaaggcaaaattaatgatgcaagaagagacaggacactaacaaatgttcacaggttcaattccatccaaagattattcattgagcctttaccagggccaggcaaataaggataggtggaatgtatttttgcaacaaccatgtatggggagcatcatgattacttttgtttttacagatgagattggggcctggggaagttaaataatttgcccaagtcacaatggtggcttgtggcatagctcagaacctgacattctgtctccagaagccacatgtgtaagcattacacattaatgtctcctagatgggttctttcaggaaaactgttttcatttttcttgactaaagttagggctgaaataccccagtatgatttctctaggtgagaaccagtgcttgctgtcactcagttgtaatctttcttcctagatattcagttctttactcaaggtgtgcctgcctggagtcccttcccctaacctctgcctgcttggagtcccttccccaacctcctcctttgtgttttctgctccttagttgctcacctgaaaactgttattttttgggaaaccttccctgcaacccagatgtaccctttcccatctcattgcatcccacctgtccttatttgcctggcgctggtagatggtcagagaataatccttggatggaattgaacctgtgaacatttgttagtgtcctgtcatttttttgcaccattaattttgccttcgatattcttcagggttttccccagtgtactgtcagagtcttaaagacactttctaatcttaactattagaaagctgggcccagtggcacatgcctgtattcccagctacttgggaggcttaggcagaaggatcacttgagctcaggagttcaaggttaggctgggcaacgtagcgagaccctgtctcaaaacaacagcaacaacaaaaaacctaacgaataattctcaatataatacatgatcaatttttaaaaaacagatcaagaatttaaagtgcggtcaggtgtggacagactaaattcttttctgatgctcaaacaggaaaactgcaatctacctggattagaaccgttgtgtctctttgctaagcatggagtattggtttggccagctttggtgcacagggggatgcattgttatgtgaatgtatgagtatcatgctttcatttggttaatgtgtggttttatgataactctctgtgatggagaaacatcagtttctgagtgttagtagagcaaaccctctcccttgccaatacagtctgtcttctttcaggtgcttcttaacctaccagtcctgccagagtttgatatatagaaggtgtttgctccatgacagcattgcccggcatccagctccagaaggtgagtgctttcccttacttgggagggtgggtgggtggaacatgctggcagagggccagcgccccagaataacagttctagtcacgctctacacttcttggtattgtgttgtcgggggtggggggtggggagtaggcccctgctgctctttacggtgttactgtgaagccacagctaactaaaacatggccattggaatatgtcatattgaagtgcttactgcatttagtatgtaagtttgtctgcgttgctattctgtcactgcaaacaaattattcattccaaaaaatgtcagagcttgtttcagtagatgacatagatagattatatttgaatgtaaactctgtggatgatactttatacgaagacattattgaaccagtaataggatattcacttggagtcattcttccagtagccatgatgggtttttttcctggttggtctatgtgctctttcctgatagttctaatgtcatccgtttctgagataactacctggaaataagattgtagagtgggcaggaattagtgatttaataatgacgcaaatgtcagattttgtcctgacgttaataatgcactctaaccaagtgagctaactaggtacagaatatacaattttatatgtattttgaggggaatattctattctcagctgaaacaaacagcattctatataaaactacataaattcttgagctttgctctaaactggcagaagctctctaattctcataagttggtatgttgataccttgtgttctgttgtagctttttattagggaaacaacaatcatacacaaaaggaaagagaagggtataataaaccactgtgtgcccatcacttcagaaattattgactcatggccttttctgtttcatgtgtagttccctcacccacctccctcctcctgatggattattttgaaacacatttttgggaacttttaaatttttactgcaattgataatggatatgctgcttaggcaggaaatctggaagagattgaaactttaaaaatcttacccattgactttgagtctagccatttaaagcttttgagaagaatgagaagctactggatctaagaagagcactggagtagagtttttcatagatgaaagacgaggaggatttgaccagtgttgccgcatttttatttctcaagggcatagcattttttaaaaattcctattactgtaattttatgagagaatattttaacattaacaatgtatgaagaacacattctcggaatatactcctttctttaaattgaataaatttagctttatgaaacattcttcattacccttattttcctgtttcattacatttaactttgtgaaccacaagtttagtccagcctcatttggaatgatagaaaccgaagcccaaagaagtgaagtgctttgtctagggatatgtagctggtttattgcagaggtgggaccagaatgcccgtctctcaacgctacagtccggtattcatcccttttgactgtcttttccgaagctaacagttgataccacttgtcctccttttgcagatcccgactggattaagaggttactgcaaagcccctgccctttctgtgattctcctgtcttctaaataatcagtgacgggaagatggaagggcatgatgaactctgccatagaaaacttcctccagcctgaagagaaggatgcactggaggaagccggaccctcacgagtggagagaagtccttggtgattgtaaagagggcccctggagctcatttctgaatcgcactctccatttccagagactaaaggatgtcctttgaaatggctggactcagagagttggagtcgttttgagatgagcattagccccagctttgtaaccaatgaggaacacttacttatttttaagtatcttgacagaagcaatttgaacacagtgtcccgtcatttctagaaacagaatggtctcttctagagagcttggataaggaccttgctgggttgagttaggttttaatccttgctttggtttggaactgccttcgggctccagaacttaaattgcttggtccgtggcatctgatgtaccaacagagattaaaagtgtaaagcaacacatgggctgatgttttgttctcagaaaatagctgctggtctgcatccctccattcttgttttttatgcatatggaaaacattttcctaaaactctatattcttaagttgaagccaagactaaaatttaatgtgtcaaatgatctggtgactattataatgaataattgtgacttatttttcattctctcctgggtcatcaggtttcctgacccaactccttaatccgtataaagatgtcaaatactgtagttcacccacgccacagccctgcttcagacttaactgtggtagcctagatgagctatttgtacacagaggaaaaaaagatattttcctcttttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaa

SEQ ID NO: 1630 - DNA, 853098 bp, Homo sapiens
ggagagggctgcgcgcttctcgccaagcaagcgggaggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaagtaagtgcagcagaagtttgcgtcggttgccccgccgctcccccagcgcgagtgggaggcacatctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgctacggttgatgttgggcgcctttggaagctggtcattaattcttgtcatcgggaggtttcgcggagggcgacagcgcccgggagcagggtgacccccacagcggccggccttccggctggctgccctccccgctcgccgctctccccgcgccgctgcgggtcctccgagaccccggactgtcctgagctgcttcgagggcgggcgagaccctgtctgttcaaaagagaccctcgagaccctcgacattctgctcacttcttttcgggggcatgtttagctcttttgggctctctccttcctaatgggattctcccaaggaggttttcttctttaactgaccctacttctcataggggaaaaaagttcttggaatctgccctcgtcctagggtcagagccctgcagagggcaggcgaggacggcgtgggccagctcgcctaccctgctctcacctggggagggttctcaggaatttgatattaaatttgatgaaacgatcctaggaaagtggctaaggcatcttctccgagagtaggagtttctgtgcttcgggaatggaaatcccacttagcttctgataccaagtctacacttcggagagagagggagatagttaattaaaaactgattcaattgagttgaagacaaaagtcatttgtaatgcatcctggtcacccaatttcactccatccctcccatacactttatggggcccaactatgtatgtgccagacattgtgctagatgctcctgcaacagagatgattcatgtgtggtctcagcactttgggagcttacagtctgtgctagaagtggtttggaaagaaggtgaagatgcttgctctacagggaagggcaggtgctacctggttttaaccacaatgactcacactcgcagcccattaagtgtatggacaaatatttgcaagacggtatcctccttgaaggcgggatactgtcattcatctttgattcccagagaccaccactgcacctgcacatagtaggtcatcagcaagtactgttaaatgaataaatgaatgcatgaattatgcatagttaaaagtaacctaacgaaaactgtcatgctaggggaacatgtcaagaagagactgaaataaagggaattggagaaggcaagagggaagagaaaataaggttcatgaacgttcgaaagtgtatatccttaaacaagtgtttgttttctatctttatgcaatggaaattaccagcacccatctccgttctctatgaaatacgtgcatctctgaacacttagattgtaaatgccatttttagagcagagtctctgttaacttaccatgcagagatcacaatacccttctcatgtggctgtgttgataataagatgattggaatgtgtctaggtagtgaggcagatgggtgaaaaatactttaggattataagaattccttcacgtatctaataatattttgctactaatgtatgaatttatacccttgtgctttaaacgtacttcatttaaacctcattaaaatatgcatatattgattttactagtgaagattaaacacatatatggaagactttccttggttttattaattgagcccaagttactattgcagtacggtagaaggtgataaattccaaggtgagtaataaggattccatccccctccaccccctgccaaatttagtttcattattcattatttcagaaaactaaggcttcatagttttttaaaagtgcacaacaaggccagtcacagtggctcactcctgtaatcctagcactgtgggatgctgaggtgggcagatcgcttgagctctggagtttaagaccagcttaggcaacatggcaaaacttgtctctactaaaaatacaaaaaaaaaaaaaattagctggcatggtgatgtgcacctgtgatcccagctacttggcaagctgaggtgggaagatcgcttgagcccaggaggtcaaggctgcagtgagctgagatcgtgccactgcactccagcctggttgacaaagtgagaccctgtctcaaaaaaaaaaaaaagtgtacaacaaaactacttacttttgcactcctttttcagtgtttatcaatgataattataactcagtaatttgagtcaagagtttataggcattaatactggttttagtttttggaaacttttcagtgctatgtgatttggggcaatttgtagaatatttgtaaattttattttctctacttacaaaatgagattattgtaattacatgatttaattaggcactgaaaatcaaaatatgttgatgtagagcattgctttgtttggggctttgtattctgtagttaatgtcattaatttagtataccaacactgagaagcaatttgtaatttgtgaataggaaaaaaatagtatattttccattattgagtatcttgcagatatttaagacatcagagctctaggaagagtattgtgattgtggataatttatggtggcttaaaatttatattgtagaagtaaatgtaaagaaatactaaaaatggtagctaaatgttggaattctttaaccaaacattgagatgtttcttctgtggtagatctttgatttggattatttccagaactgcactgttagatcaaatgacaatttgagtgagtcttgaaatttggcaagaagcacactctaggaggcagaagtttattttggaaatttagttaagggacagaaatgctgaggttataggaatgtggggtcgtagattaccgagtttagaaaatatctggcctcattttgcagatgagaaaactggagccaaaatagtgaagggtctgcatttcccaggatcacactcaaatgcatgagtcccttatgttgtcgaccgtaggcttaagagaaaaatcacacattcaggatacctaaatccaggggcagtctaacggatcggctatcctatttttttttcctttttgagacagggtcttgctctatcgtccaagctagagtacagtggcatgatctctgcttactgtagcctcaacctcctgggctcaagcaatcctccgatctcagcctcccaagtagctaggactgcaagtgtacaccaccgtgcctggctactttttgtaggcacagcctcctgcctcagactcccaaagtgctgggcttacaggcatgagccactgcacctggctgggtctgctatccttgaatttgtcttttctctcattctctctggctcacaccgtccagttgctcccatctctgagagcggtctcccatgccaaccccctactttcactgctccttctgcctgatcaggtccttctgaggacagggcagcaaaggacttggttggggtcctgtggctcccagtttcagacacgggcctggtcctaggcagagctgtgaagtcagtgaagcttggactgggtgttccccacatcttctttcctacatgtggacaccaatgtacatcaaagaatcacagtttcagacacagaagggactgcgaagaccatctggttcattttagagatgagggaacttgggcccagaaaacgttctgtagttttcatgacacagccatggtcaggatctcctgggtggtattggtgctccttttgactgcttgtgctctcttctccattggatggtgcttgcatctgatcactccataaagtgagcatgtggactctggaaggaggcacctgtgtcaagttccaaccctgtctctccccacctatgcaactatgggcaaattactgaagttgtccaatacttccctttctttttcttttccttttttttagagactgggtttctctttgtcacccaggctggagtgcaccatttcaatcatagctcactgcagcctcgaactcttgggctcaagtgatcctcacaccttggcctcccaaagtgctgggattacaggcatgagccactgtgcccagccattgctttctttattaataattttttatttgttttgttttatagcttaatataattgcttttcctccagatcgtaagttttaagaagggaaggaaccaagtgtttcttgctcactacaggtctaagacctagcatactgtttggcacacaatggacacttgatgaaaatttgttgaataaaggagtaaatgaataaaagaatgagtgagtgaagtatgcatcacttagatagaactggaatcttaatcatgagagccacagccttctaaagattctaactgtgaagtactgtttcctttgctaacattactttatggatagacgtgaccctaatatgcctgctccctgcttctctcacttattccttctctcagtaagtggcagccccatttttgtcattacttgagccaaaaacctcggagtcatcctcttacagaaagcattcaacccattaaccaatcctgcagctaggccttcattatgtaatcccaatctgaccagttatcaccacatcccttcctggcagccgagaccaagctgcagtcatatccctgaattattgcagtgacttcccaacctctctctgcttccatccttgtaccacccccaaagtctagattccatacacagccacagcaatactactaacacataaggcaaataatgtgactcctctgcttaaattttataatattttcccatttctctcatagtaaaaaaaaaaaagcccttacaattacaaataagattctacatgatctacctgctctgactttctgatttctctacaacttccctctttaatcaccatgcttccaccacattgccatcttcctgttccaataacacaccacacttgctgtcatctaagtaactttgaacttatctttgaacttctccagataacctgcttgacttctccacttccttcaaatgttttctcaagttcatcttttcaataaggtctttcttggctacactattttaaattacatccatctaactttctatccttttttgcactaatttcccttttagctctttggctataagaaattccatacatttgattcacttccatcttttgtttctctcccctactagaaggtaaactccataaaggaagagattttttttttctgttttgctcatttctgaatccctagtggctagaacaattcctgccacatagaaggtagtctgtaaatatttcttgaataaataaatgggaataaaatagtacctatatcatagagtcttgttatgattaaatgaaaccatgcacattgagtgtttagcacagcgtctggcacttggtacatgtttatttagtataagacattattattatggtgtcatctcagttctcctggccttttagtccctcttctggccagaattgtggtcagaggcagaactcttctagaatccctaatactatttttggaaatgactttgaagaagtcccaatggctgtttacatctgctgctgaagataagtaggaaataaatgcatttatctctccaagatatggcataatcctttccgtgaaatactttctgtcttagggatgctggaaggttgcggttgtgcctttcatcctcagggtgagagagccacattctctcatgtccatgcaagtcgtcctcaaatgggttggccacctgtcttggtttttcacaactttcctgtctctcacttttgggtttgcctcttgctggtcttaacatagctgttctcactgatggcctcctgaaccagcaaagtttagctggaggagttatgaggtcgtatcaattaaccaatgaagcattacatgaacaacaaaaactaataataaaatgacccctgtaaagccctccctagggctagtaatagcctgtataaatagcctaaataaatacttcttacttgcttaataatagcctgtagctgtttaaatgccctgttgtctgggttgataggatattttcacagctttaccaggacattgtgagcagatattgcgtgtacgtgttaaagtttagtaccttattacatttatgtataaattagcatactatacagatcgtaattcctactagctcaaagcagtcaaattttagaagttgactccacaaatagcaccttcagtcctgagtgtttacaatggttttgctttaccagagaaaaatgtcatgttgtgcccatttttcatgctagaaatagaaagagagccttgggtttagtacttgtaggttaccaggtcttttcttagcctgctccatgaccttgtccaatttccattagattacagtggcttttctggagccaggaaaagttactacagcagcaaaaatggggccaacaaccttaaagtgcagcatatctatgagaaattcattttattgtaactgtaaaagagatgcagacagtacagttctttagggaagagggagagaagagaagtgaacagagaacttggggtgggtgggaggaatttggactccagttataatcatacaatgagacaatgaaatgaaagagggagtgactttctaaggggtacacattattttttcttttgcctagttcataaacacattttattctgaacactcttcataagtaggttgttgggaagtattttctaatagaaacaacattatatgtggaatgtaggtttccagctgccttggggaaacctatttaatttatggctgagcattcaaaaataatactatagtttgctttttcatatgggaaaatgagtcttaatttgtaattaataaaatcttaattgccatcatgttacaccatgaagattcaggttgggcatttttgtaagtaatctcttccttgactccttgctagtttacttaacagaacaggagaatacacacacacacacacacacacacacacacacacacacacacaaatatattgtattttgttgtgtatgatacatatataaaacatacttatataatcactctactgaacagacaatatcgaatccactttatttgctacttaaaaattaacataaataatattaagttaataaaatgtagcctccggagtagctgggactacaggtgcatgccacctcgcccggtaattttttgtatttttagtagagacggggtttcaccgtgttagccaagatggtctggatctcctgaccttgtgatccgcccgcctcggcctcccaaagcgcttctggttgcctttttttgccctctgtattctggtccctcgggctccttgatgcaaagtgtgaccagccctccccctagtggcgattagaacatcttccctccatgccctggttaatgccaggaacttgttttcacctgctatagtcctggcatgtgggctgggcgcttctccttctcagcagtctccagagatcgggagtggagaccctcctggcggtcacctatatgtatagagcagagagatgtcccagcaaagaaagtgcagtgtgggagtggtggagggaggatcagagagacactttgagtctgaagtttcttttctttgcaagaacgggacattgccctatgtacttcctgatctgcacctagctttataccatggcgtcccatctgcaaattccctgtggactaaaaatctgattgtaggtttcttccctgttctctgatttctgaaaagtacaaagacgacaagattttcggaaggtttttatttgagatacgctggctctctgcagggggaaaaaagccctgatttgaactgtttgccaatttctgtatcgtaaatatttctgctgtggccaattacaacatgacatcaactgacttaaaaagtcttaaaaacttaacagttggctctcgtgaatatgtacaaactggtccccatactgcactgttttcacggctaacaatgatgtaaaagaaagggtatgttttcctcttattctttctcctcctcctcctccccttttcttcttggtaaatgtagagaaaataaaaggtatagatcagggggtcagcaaacttgttgtataaaggcccagagagcaaacatattttagactttgcagtccgcactgatttttgtcacatactcttttttattttttaaaaagtcctttgaaaatgtaaaaactgcatttttgtttttgtattgccaaagagcaatacaaaaacaaaaacaggttgagagttagattgggtttgtggatcttcatttgctgatccttggaatagaacatcagggtgggtctttggaaaccgaggactggtgtaatatatacaatatactatatatatatacacaatatatatgtgtgtatgtactttgtattatgcacacacatacacatatatgcatgtatgtgtgtgtgtatgtgtgtgtgtgtgtgtgtgtgtgtgtatatatatatatatatatatatatatatatatatatatagtgagctcagtggtaaataaggagaaatatgaccccagggcttctttttttctttcctttcttttttaaaaaacagctttattgagatataattcttatagtgtacaattcatccatttaaagagtatagttgcatttttaaaaacaaatttataaggtcatgcaactaccaccactatctaattttggaacattttcatctcccctaaaagaaactcccctacccagtagttgcggttcccttcttaccttccagcctgtcagcccctgaaaactgctcatctactttctgtttctatggatttgctgattttggacatttcatgtatatggaatcataacagtatttatccttttgtgattggcttctttcactctgcgtaatgttttaactgttcatctgtgttgttgcatgtgtcattaattcctttctttttattgccaaataaaagttcattgtatggatataccacattttattgtccatttatcagtttatggacatctaggttgcttccaatgtttggctattatgaataatgctgctataaagactaaaatacaagtctttttatgggtatatgtctgtatttctcctggatagacccctagtagtggagttattgggtgatatgataactatgtttagcattttaaagaactgtcaaactggtttccagagcagctgcatcatcttacattcttgctgtcaatatgagggttccattttcctcacatctttgccaatacttaactctttttttgaggatagtcatctttctggatttgaaatggtatcttgtggttttgacttgcatttcgctaatgactaatgaggttaggtatcttttcatgtgcttattggacatttgcatatcttctttggagaaatgtctattcaaattcattgtcaacttttaaattggtttgtctttttattattgagtgagttgttaagtgttctttattttaggtacaagtttcttgcaaatattttctctcttcctgtaggttttcttttcagtttcctgatggtttattttgcaacacaaaagttttaatatgttgatgaagtacaattatctgttttttttcttttgttgcttgtgcaacaaatgcagattcattaagatttattcctgtgttttcttctaaaagttttgtaattttagctctcttaatttgtctacattttattttaagtaaagatttttgtatatggtgtgaggaagggattcaactttatttttatgcatgtggatattcaattgtcccagcaacatttgtgaaaagtaatcaaattttcttgacagccttgttgaaatcaattgaccataaatgtgagggtttatttatggggtcttaatgttattttattgatctgtatgttcatttttatgccagtaccacattatcttggatactgtagctttgaaataagtttttaaattggaaattgtgagttattcaactttgttcttattttttaagattgttttggctatctcagtacttgagtttccacatacattttagggcctgcttatcaatttctgtgaaaaagaaaaaaataaacagagagacagcgccagctggggttgtggtaggaatggtgtttagtctatagatcaatttgggaagtaatgtcatcttaacaatatcaattcatttgatacatgagcatggtatggctttccatttattaaggtcttaatttttttcaacattgttgcatagttttaagagtatacattttacataaattttgttaaattgatttttaagtattttattttaaatgttgttgtaaatggaattgtttgcttaatttgatttttgaattgttcattgctagtatatgaaaacacaattgcttttttttatattggtcttgtgctctgcaaccttgctaaacaaatttatttgttttaatagctttttggtagatttttaaaggattttctctatgcatgatcatgtcatctgtgaatagacagttttatttatttctttctaatctagatgtgtttttctacctccctcccttttttacttccttgcctaattgtcctcgctaggtcctgtaatacaatgttaaacagaagtagcacaggtggacatccttgtcttgttctggatcttagaagtaaaagcacccagtctttcaccattaagtataatgctagctgtaggttttccacaaatacactttatcaggttgaggaagttctctttctcttcctactttgttgagtgtttctatcatgaaatggtattggattttttgaaatgctttttctgtatccattaagatgattatttgatttttattctttattatattaatattacatattaactaatttttgatactaaaccaaccttgcattcttgggataaattctacttgattatgttgtacaatccttttcatatgttgctggacttagtttgttgagaatttttgtctatattcataagagatattggtctgtaattttcttgtgatatttttgtctggtttgagtgtcaggataaaagtgactttctccttctatttttcattcttaacactgctgttcaggcacttttgggacatgtaagatgaagggaagagaaggaagtctagggctgatagtgagttccagtcagcagtatggaagaggggaggaaaaccctaaatagattctatagtgggccaaagattcttggctgccacatggacaccaggcggggacctgttattgggtatatcctatgtaaagaatgtgtcctgttctgttctttttatacacatattcattcagaatatttattgatcaccagctgctatctaataagaagtaaacttattaccaaaaagtttaaatagacctgactcctgtcctatgagaacatataggttaaaggggtaggaagacacaatagaataattacaaactaaatgtaaaattacagctatgatttgtatgatgaagggaagattcctggtgctgtgagagcatataatataggggtttggtctggtgttctggcggtgggaataacataccccaaggccctgctttaggaagaagtgaaggaaggccagtgctgggggaacacagagagcaggaggaagggaaataatgggaaggagaaagtaaaaagaaccaggctacctgcggcctggaagtctggtgataggcccatgtcattatcctcagagcagtgtgttttcacttttaaaatgtctgtttctgaagaactgggggccattgcctaaatgaaataacccagaaacagaaagtcaaatactacacttataagtgggagcgaaacaatggccacatacagggtggaatagtagacactggaggctccaaaaggtgagaaaatgggagggtgtgagggttgaaaaattacctgttagatacaatgttcactatttgggagatgtgtccactgaaagtccggactttaccactacacaatatatccttgtaagaaaactgcatttgtacctcctaaatctctaaaataaaaatttttttaaaggcaaaaattaaaatgtccttgtctggattcaccagttttattttggtttcaggttttccttcaagaaggaaatgtcattcacgatttctgctctttccattccagttctttacatttttgagactcaaagtggaggcaagagagaaatggaattgaatgaaggatttgaaaattgctttcaaaaggctggtcacagagggaaggaagggagaaaagcagggtgtattagtccattttcatgctgctgataaagacatacctgagactggataatttataaagaaaaataagtttaatggacttacagttcaatgtggctggggaggcctcacaatcatggcagaagacaaaaggtacctcttacatggcagcagacaagagagaatgagagccaagtgaaaggggcttcccctataaaatcagatctcatgggacttacttattcactaccacgagaacagtatgggggaaaccacctccgtgattccattatctcctaccaggtccctcccacaacatgtgggaattatgggagctgcaattcaagatgagatttgggtgtgctcatagccaaaccctattacagggttaagtttattgaacagcagcagaaggagggtacacacatctgtctggtccaatcccctaattttacaggtggatgccctgaggctcagaagcactgggtgacatcctggctcacagagcttgaggtggcagagccagagagggagcctcagcttcctggcttccttttgagtgctctttcctctgaccctcactcttccccaagctgagctctgaaggacaggaagagagagggcaagatgccaagtagaggaggcccaatatgtacaggccttgaggcagtccttgcggaaggccactgtggttggaacaaggtgagtgaacagaagatggtgagaaatgcagtggaaaagttaggcagggccttaactcctcaaagaggagtgcagatttattctaaggatggtatgaggcgttttaaagggggactaatgcaaaaaacatatatggatgaagaagatgactcttcctagttcatggagaatggattaatggggccagacagaggtggagagttgaggtaggagtctgtggaaggtgaagtggtgagaagtggacagactagagctttgttttggagttcagattgccaggacttccacatcacctttaaggcatttgtaagaattccaagaggaaggtggctatgcctaggctggagaaaaagggcagtgtggatcctcctctaggcagttgggttattctagaagcagatgtgttggctctttctgaagctctggaaaagtataaagttttctgttgcggtgttcatggcttaccctccagatgttttgactggccgttgccccaccagcctgcggccacttgacactttggatatctcctctcaggtattcggctatagcagtagtggaggaaaattctccaagaaataaaaactttcaggtgggtgcggtggctcacactggtaatcccagcactttgggaggccgaggtgggcggatcacttgagtctaggtgtttaagaccagcctgggcaagatagcaagacctcgtctttataaaatagttttttaaaaattagccaggcacggtggttacacacctgtggtcccaggtactcaggaggctaaggtgggaggattccttgagcccaggaggatgaggctgcagtgtgcagagagcatgccactgcacttcagcatgagtgacaaagcaataccctgtctccaaaaaagaaaaaaaaaaaataaagaaatagaaacttcctttcatccgaatgcccctccttctttcctaatggaaaaatggttacctattcttcaaagccttcctcagatattaagctttactatgaaactatgaagacttgtgtttatacacaattatatggcattaattatgctcatctaaccctttttactatgcctgtatggtccttattacacctaaactgttatcattttttctgtttaactcggagatacaaagcctagagagatgaagtaactcacccaaggtcacaggcagttggggcccacagtctgaaagcttagccattgtgccatgttgtcactagctgggagctctctgggcagcattactgattttctcttgctttcaacacaactctgttatgtcgcactttccctattatgtgaagagttaattatctgattttcttctctggttgagagtgagcaaattgaaggtaggaactgtgtgttacttactttcatattccagtgttggatggataacggatgcaaagtgagtgaatgaatgactaaagaacatgaatgaatgaagggatgactcagagaataactgagaaaatagagtggcaggtgtgggacggggccttctgttaccttatgcagactgcactttttctaggccgaggagtccctgagctgcattacaattcaggccagtgtaatttctggctttaccatcacatagtttaaaattttccattaatcctttggtgtgttctaatcaaataatgctgttctcagttaaacagttgaagaagctcccattctggcaggtattatactctttaacacagttgctctgttgtcaccaaggacacttctgcatctgatattgatttaaatcttcagttatgaaggtcttgaagatgactttgtagataatgaagattgtattggctcaagaaactgtaacaatggaaagaatatagtgcatacttgttcatccaatctgagaaacagagtagccttattgataagcaatttacaaagcattttgttctatgctgatacaaagttgaaacatagtgggtgttctatttggtgtcaagtgttgaaagtatttttggaaaattcattatattttggagacagttcaagttgtgttgaacttttactcaaataaagatttatatagctgtgccttgattttgaaaaatttgttttatcaaaatctgaattgcagaatagatacatcagaaacaaatgccattacaaaataatctccaggtagctcatcaaatacctatggaatgggtacaatgagtatagggaaccgggtcaccatctatccttcttattctctagggtctgatcaataaagcaaaccaatgaagcaagattgctagccagatagaaaatgaaaagagtgattttgctttgtagagtcctctgtgcacatccttgtaaaatctatattaaaatatttgctttaggcttcatcaaaagtgagactattgactcttactctttatctagatgtgagcaccacaagctcagatgtgcatacagaaggagtgaggcaccagatcttctgggccatccccaataccgtgtgcttgaatatggatgaggctggcaggttggttccagaaagaagacattataggtggaatgatgttcccttaaccccagaagatgtccacattctaattcctaaaagctgtggctattttacctccgaaagcaaaagagactttgcagatgggattctattaagaatcttgagatggggttgatcaatgcctttgattatctaggtgagccaatataatcacaagggtccttacaagagggaggcaagagggtcacagaagatgtgatgatgtaagcagaggtcaaagtgatccacaggccaaggaatttgagcagcctccaggagacagaacaggcaagaaactagagtctcttggcagacagcgtggttttggtccattgagatttctgacctatagaactctaatgtagtaaatttgtgttcttttgagctagtaagtgtgtgatttcttacagcagcaataggaaattactgtagaaggtttggggacctgcacagatgtgcttattacaagggaacaagatacaaaggagaaccttctgggtgtcatcacagaaagtgaaggacaaagtaaccctgttcaccaggaaagcatggtccagttcatgtcaagcttcaacagatgaaatcaaccaccttcctctcctggggaagacgagtgagagaaacagaagctaattaaggtgtcttagtggagagaagtttaactccaggaattagaggctcacacaacccttgaaggatgggaaacgaagcctgatatgatcactttcaggaaatctaaaatgtgggaatcgcagagaaacatgctccctaagtgagtcacaggaggatgccaaagtctatagtccagactccacttctgttgcctgtctgcagacattgtcagagaatgaccttcaccttccaaatctcatgtgagacattctcaatggtggactcttctagtgaccccacaggcaaggaagaaatgtagtttctaggcttcacccctctaaaagtcaagggccaaactgtacagggtatcaaaatacctggcacagaggtgaagagaaaattatggtagaagtttgcttctctgcagtttgagggtggaaggtagaaagaggaacataagcatctctccttacatccctagccctatgctcccctcacctgcattcccctcaccaataacttagagtttgccaagactgggagatggtcttagaaatggagaaataactcagtatgatagtcagcagcaagccaagatgttcattgacttggctaccattataagccaagtcaatgaacatcttggcaaactctgagttattgcagagcagtgcagtcaactcagtacagaaaagataggagacagatgggaaattgaatattcgtggatacgttttaggtgattgtgctgtaatttaactataacttaccaggtatctattttgaacctgctttatttcaagggcacttttttttaagcttttgacaaataatttaagccaaattaatattcattgcaaatgtcaggagcagttgagttttcttttcatagagcctttgaacctgtttatgggaaagatcaagtgttatcatgccattagttctactttttaatacaggataaagttgtacatgtcactgttatctaattactaatagctataaataccagttaattaaataatgcaggaatagaataaatttactatgccgtgtttcttattgctctcaatcaagtatttttagaagattttcatattacctcttttcagttttaattgcctcttaagaagacagaattgcttctggtatacctgaagcagccaagggggtggagttgttaacatgtaatgcggcttgcaggcatttggttcagtgtggagtctcagagggtgaaagtgtagaatgccagatcaaggtttcaagccatgaactaagagtatggaaaagagctggggaggagtatgttgtagatgaattgaggtattagaaaataggagtgcaggttgcagattactaggaagccactgaatagaactgtttgaagctatcgtacctgctcagtagccaggatgactttttcaggcccattcagagtaggttttggtttggtaacactgtttttgcttgactttttgctgctaactatcatactgagttatttctccatttctaagaccgtaaggccaatatcaagagctattgctttcagctcctagttactaatcatttcagttttatcatcagagattttgtttttttacttccaatggattagttcagtttctacctaggcagactatcatggaccaaaatgttcttctctaaaaatgcatgttagaaaatattatcatggtccttttggtgtttaacagcttctttggaataataatttaaattgtgttgaccactctacacatcatattttcagttaatatagaagttatgctctaaaatagtcagtttctaaggtttggtttaatttctttgtgtcttaggagcctatgttgatttgaatggtgatattaatatcattattagctatccttacataagaccacccaataaaactttttggtatctgtaataaagtttgactttaatttttgccaaaatatgtgatgtaattctggagttgaagacatcctaaaaaagagtcaacttagattactgtatgccccagcaaaataatgcctcatgatcacctatttccacctctagacaatttcatttataaccttgacttcaaacctaattcacatctgcttagctcagaactttcttctgaattcaaacttgcttatacacttttcattttaggtaccccatccagctgtttcataggcacctcacctttaatatgtgcaaatctgaaattattagtcttttttcattccaccagaacttctctgccttctatatttcctggcaaagggattgatgccagctagtcgtccaagttcaggatctgaacatatcctagacttctaccttttctccatatccaatcagttgctaagaccaaccttctaaatacatatttccccttccccgctatcctgtttgttattatattgctgaagcgttcatgatgtttcagctggaactattgcaataacttgcttactaaccattgtcttagggcagcttccacagaaatcaaaccctaagaggaatttttgtgcacaagtaatttatgaagaaattgctcccaggatagactcctggaaagtgagggaaagtagaacaggggaggaagagaagccaagcaaggatgagaacttgggcaaatttctgcagagggtagcttccatcatatcctgcagccagggcgacactaagactttggtagagtccttcctcaatcaatcaattgcaacttggactttcctgaatacgctatgctgcctcaagattcctgccttttcacctgctggtccactggcctgaaatattcttcttctttggttccctcctcacttgacctctggactaaagatgactacaaagtttttttcctgctctccctttgtgactgttccaagaagtcttgaggtcgtttttctattctgttttgtgaaaaggccatatttgcgaagggaaccccaaatacaaaaggagctgagaaaccaaagggtagggcaaacaaatccagtttgtcaatagagggtggtttattggggaactcatgggcagaagcatggtcttgggcagtcataagacaggtagatctcctcaccattaccccaagacccagagcttatataccatagaaaaagggtatatgtgctttagctctagagggaatgtgcaggacaattaaagttgacccttcatggaaagacaagaacgctatgtgcatcatagcctataatttgccaaagggcaggatatatggtaagtatgtgtttatgatgataacatcgagattgtactggtttacaaaaggaacagtaaataaggcagaaatattagaggcactcctgggattggggttaatctgaagtcaaaatggcggattagcattcaagatggagttactttagcctcctcttactccatggtgagcttctcctgggctgccatagctctgtgtattgacttggttattttatttcattgcaactgttatttgcatgattacctttccctagtgggggatggaagagacaaaatcttttcatttttatccctttggtgtttagcccaacacttgttaagccaatgaaggaagtaaagaagtgaaaaaaattgatgaaaggactgtgattccagttatgcgtattagatcataaatagtttctgaggagcttgagattccattagaatatgtgatgtaagtaaaacttattttggcttattacctttttactattgagtatgatgagacctcatggtaaaagttgtatcaattttagagtctctttgatgtagctataagattttacatttcttttatgactcaccatgtaaagtttcaaatatgtactagagagatttaaaatgagcatgaagtgatgactaacatgtaaatttgagaatttcagtgttaaaatgatagatttgttttctcatctacaaatattatatttttaaatattaggtagaactgattctaaaggaagtaatcacattacccatattttaaaaattaaacttgcccgtgaaagaaaagcaaagcttacatgacactttaacttttacaacattttatttaaaagataaatgtcattactcagttcactaaaatgacctttaaaagccatgatctttaaaaaagaaatagttttcttttaaagggaaacacattgcaccaatttgcaagttaatggtcgaatttttgccttaacagtgatgagaaagcagaaattgaggcacaaatgatacaaatagcatgtttcagtcttgaaaggcaatattattccttttattccttaaataagcttttacggaagcgttctgactaacgctgcatgcaagagatttacgtacatacttccatgagatgaggatgtgtcattaaaatatatgaacataatagatgttgtgcacacaatatgaaacaaaactatgcttagggcatctggaaagtttctctttatgaaataaatgaacaatagctttatttaaatctatctaaaaccaagctctgatttacatatagggcttaatttggatcattgaatttcctttgcattggtttcttatgcatacattttgtagtaattttaaatatgtaaactcatcagcatagtttgtgtgtgtatctgtattctaggggatcctttaggctaaataaatgcaatatgtgaaagttttaaatcaccaattattaattaagacataaatttcctatatacagtcatacctacctgcatttacagtgtgaacctgctttgtctttccttgaataaaattaaagtgattggatctttccaagtatcatatttacaaccaacttctccctctggaggctccctcccttccccacctccagcctggactgaacacacagaagactgggtgtgattttatgatataaatcaatggaaaagctggtccaccttactaggagcagctttttagatcagcctctattgtgcatattcaaatatatttatatgcatgtaacaacaaaaaaacattcttgtggctttgtttattaaagatttctttctggacaaatagattttgaattattgctttataaagtagaccccaatttactacatcacgttttttctttgtcatcatctattgttcttttggatcctaattattcatttttctcatgttttaaacttcttatatacaaggcttatttatacttgtcactctcccatgcctgtcatagtctatatttatatttcacttattttaagaaaatgcacagaaatccatgttaaacaactaaccacacaaaaactacattctccttcaagattaaacccctgccttactttgccccttctcttcccagcctgtctttttgaaagagttacctgctttactatctttacgtcttcacctttttgtcatctctaggtttccgtgaacttaaaatgcttcctggtattaagaactacttggttgtcccctgtgcttatgtatttttaaatgaaataggttgaattccgcttttagattttttttttgctctgaattaagctcatagcgggacttattaaaatgcaattgctaataagagctaataattactgagcacgtactatagtccaggcagcatgctaaactctacctggattgtctaatttatgcatcactatcacactatgaggtaggagttttgccactggagaactcacaaggcgagttttggccatactctccagaataatataggtcaccctaaagtcaccccaacatggaatatacatacattgctgaaaatacatcccctaaggttggagttctaaaatcaaaagtccagtagcaggtggggtggttcaggagattgatttctgaatgttcttattattcctaatagaatttaagtctagacaataaagatatattcaatgacagtagaaatagggataagaaaaacaataaacctaagatgaaattagtatgcaaaatgtatgctagaaatcctctacccttggcaacatgagcctcagacttgaactctgagccaaaacgaagatgaaaaaactatcagtgacatcattaactttttctaaaatcagaaaacaaaccacttgttcaggaaaagttcagttcatctaacaatgagactcaggtcctcatagcaatgatcataaaacattatacacacatccctttaaaatagatgtatctttccaaaatacatttttatagcaattacataattttcttgaatcatattttagtgtaaaaatgagcagccttttctattggttcgtctaagtcctccttgcttccattttagcttacttagcttatgattcagtaggtgtggaatctattaagttggtgcaaaagttattgcggtttttgccagttccaaaaccaatggccaaaactgcagttacctttgcaccaacctaatatgtgaatttcctctctttttaccttgcatgtcatcaatagaaagtggggccacagtagttaaaataagtgactgcttctgaaatggtccttcatctattaaatatctcagtacttacaagaacacttgtatttctccttgtttctttttggaaatatttaaatgtagtttatagaatagcagaaatattccaaagagccatttgtttattaagcaaattttgtgtcagagggaaatattgtataatgaaagatgtgtcccaagtttgtttttttccatgtttaaatctttttgtttgctttgttattcctcacaagcttaaaacagttttaaaattgcataatgttttagttgctgataaatcctttatcggggagaagaggatgtgggtggataaaattaagactattgtgatacggaataaatttgcagagctggaaagcaaggaaaaactaaaaaaaaaaaacttttacagagatctgtttagtgaaaaaacataagtgataggatttctctttgttaaaaaggaccatattctttacaatattttcttatagcaatctcaaggtttatttagatgaaatacctaatacaaggttttggaacatctacagaagtgtatttggggccatacaacttggagagagggattgagggagggagggagggggagagagagagagaagagagagagagagagaggagaaagtgaaaaatgcaaacataattaaagacaaagacttcttttcaagaaatatcattcagttagataaaatgtgcacaataaacctgtgtttgtgtttgacaattcctcagaaagcatccttaaacatggtattaccatatgaccctgcaattccccttctaagcatataccacaagtaattgaaaacagatattcagacaaataacatgtatacactacatgttcatagcagctctattgacaatgaccaaaaagtggaaacagtccaaatgtccatcagtggatgaatggataaacaaatgtggtatatgcaaacaatggagtattgttcagccatagaaatgaagcactgatacatgctacagtatgatgaagccccaaaacgtcttaattgaaagaagtctaggcctagtccgggtgccgtggctcatgcctgtaatcccaacactttgagaggccaaggagagcagatcacttgaggccaggcattcaagaccagcctgggcaacatagcgacacgctatctctacaaaaaatacaaaaattagctaggtgtggtggcacacacctatagtcccagctactcaggaggctgagatgggaggattgtttgagtccaggaggtcatggctgcagtgagccaggatcatgccactgcactccagcctgggtgacaaagcgagacccccttctcaaaaataaataaataaataaataaataaaaaggaagaaaaagctggacataaaaggctatatctatatatatcacacctgtaatcccagcactttgggaggccaaggcaggcggatcacaatgttaagagatcgagaccgtcctggccaacatggtgaaaccccatctccactaaaaatacaaaaaattagctgggagtagtggtgcatgcctgtagtcccagctactcaggaggctgaggaggatctcttgaacctgggaggtggaggttgcagtgagccgagatcgcgccactgcactccagcctggcaagagagtgagactccgcctcaaacaaacaaaaaggctatatagtgtatgattacatttatatgaaatgttcagaatagtttaatactagagaccaaatgaagattggtggttgccagggcctggggagaaggggggagggtggtggaataattgcttaataggtaggggatttgaatttagtatgatggaaatattttgcaactagatagagatggtggttacacaaagttgtgaatgtactaaatgccactgaattgtataattaagaatgggtaattttatgttacgtggtttccacctcaataaattattttagaaataagtgtttgcctccaggactgaagaatggggagttggagagaggggtggggcattgtcatagtattttggttttaaactttacaataatgtctaaattgtaaaactatgtgtgtcacttgataaaataaaattcatttaaaatttttactaaatgttgagtaaataacaaggaaatgtctaagtcctagaaaaatgttgactaataaaactgattataggtagtattgaggatttttaaaagaaatctctttgtggacattaattttgagctgcacttttgaggctgagctgaatagactgatagaatgaacgagggtttgggagtgggtggcataagaggcgggatatgaaggggactgggaggtacagccttataaaaaggacttccccaaagatgaaagtagaggtcatgggaatccaacaattggttacttcctctccatcttgtttgcaccaaacactttacctctctctgctttcaatttataattagttaaatgaaaaagatattggaatccccatatcatggaactactgtaagaatagtctgtcctggtattggaaaaaaattctaaattttatcgataaaaattcaatgtaggtatattaactactttaagcccagaattattccactgatgttcacaagtcacccatagggaagtggctcttgttccctaagggatgaaaaatatgagtcttggttttgcttagaaaattaaaacgaaaaggtatgaattccactgacacctttgtaacttaacaaaaaccttaaggatctttttggattcatggcattcataatagcttctacctacccaattctgtagaggctttagtagtcttcaagtcctgtttcttaaagcctattaaaaaatacatttttagaatacgacatgtgagaacttcataaaacatttgggaaattagccagtttccctgagcgtgtgcccttgaaaaatcagatgtaacttccaaagtgactctaggaatttcaaattgccactcacagtgagaatccactccttcatcccatcttgacacttctgcccaagaagagcaactgctgggcatattttggaaagtgatttagggcttcttgctcccagtattattttaatttagtgtattggagctgtcagctttcacctgactgactctgatggaccccacgcattgcacagtgtatgggtaaaataataggtaagacattataatttattgaagtcagggttactgttataaatactcatagcatctttttcctttttttaaaaaatcataaactcctacaattgctttcactgctggtggtattccttttcaatgcttatcaaagtgtaagtaaacaaataacccatgttctcggtgacataaaccaacctaaactaacaaagagaattaaagatagtctctgagtatggttaccttgaagataaataaattgttaaaaaaattccagaaagtttttctaagaaaatttccctcatttaggaatcatattttttgtcttctaagacaatgaaataaattaacataagcacactggttctaagtttaaaagaaatcaacccaaatgcctgaagctcagaaagtgagtactcctaataaaatatttgaaatttcacttttccaggtacaagtttcctgtattttatcattttcttgtgcctactagatttcctatctttcttgcttttacaaatatttccttgttgcaatccaagtgtcccattgatggatgcatggataaacgaaatgtgatgtagtcatacaatggaatattattcagccctaaaaaggaaggaaattctgacacatactacaacatgaatgaacctcgaaaaacttatgcaaagtaaaataagccaggcacagaaagacaaatactgtatgaatccaatgatatgagttacttagagtagtcaaagtcaagaagaaagtagaatggtggttccctgaggctgggggaaggggaaatgtggagctattgtttaatgagattaatgtgtataatgagtctcagttttgcagttcagttttgcaagatgaaaagagttctgtgagtgggtgggggtgataggactatgacaataagaatgtacttgaagcaattgaactgtacagttaaaaatggttaagatggtgagttttatgtgtatttaccataatttttaaaattaaaaacttaaaaatagatatgaaaagaatggttttagtagttttccattaagtctatcatcagctctttaattaggataaacacttagtgtcttgttagagaaaaaatccttgcctttattttatttgtaaattcaaatgatgttggatacaaatattttccatatatatttagcttcttaaatatagtctgttttcactcttggtttttaagatgtgccatcctttgaagtaacaaaaatgcgatataatatgctttatgtctgtaatttcattttaataccacaattattggtgaggaaactcttaccaatgaggaaactgatgctcaaagaagtaccttgttccaggtcatatagtgctaagtcaggatttgggcttagtctgtgcagtaagaagctttggactgcatgtaacagaaatcccacttcagactggcttcagcaaggagataccatagttctcacattccagttcctaaggagtaggcttcaggtctcgaaccctgggtccagctgttcctctgttcctccctttattctgccatatcctgagtgttggcctcactctcagattggtggcaaaatgtagccaaagccattcccgagtgtcatcagacagcccttcaataggtttcatcacgcacctcattggccaggcttggtcacatccattctttgaccagtcactggccagcagaaagtaatgaactaaaattagaatttggggccacatggatattgagaagctcatggccgtgaccactttagcctgcttgactctcctatagcatgccccttccttatgggtattgatgcttttcatctctttctgcactgactggccccacactcctgtgcttttgggatgattgtatctggcttgttacagcttctctagctctctttgtcactgtgagctgctccttctggtttctattagtgtacttattcccattccttctctggttgcttaattgtctgttgcttagctgctgtgccctgggaaaatgaaaaaaaaatcaccttattagagatttttataaaaatttaaaaatagactaataataatggcatagtggtctcttctaagaaaaaaacaagtaagtcttagtgcatgcatcttggatcaccactttttgctgttcagattcattgttgcacatttactgcttcagctctagtttcctaatagttaagactggttcgtgagtcatttccaattgcaagtatttcatgttacataaaagagtatataattcttttatgtttttcaaagctattatgaaattagctgaatgagaatttttatcatttttaaagagatccttgctaagaaagccttgtagttgtacatactaggtttgctgtttgctgattttttttaaaaaatgttaaaattcatatgtgacaataaatacatgtgtattaggccgttctcagattgctataaaaatatctgcgactggtaatttataaagaaaagaggtttaattggctcatggctctgcaggctgcacagaaagtatagtggtttctgcttttggggaagccccaggaagcttcgaatcatagcggaagataaaaggggagcaggcatcttacatgacaggagcagagacaagagaaagcaagcggggagatgctacacactaaaattacctaagaactcactcactcctaagaactcactcactttcatgagaacggcaccaaggggatggtgctgaaccattcatgggaaatctacctgcatgatccaatcacttctcaccaggccccacctccaacactgagggttacaattagatgtgagatttgggcagggacacagatccaaactatatcaccttggtaaccctaaactttgcttcttatgtattttttttaacaagatttgataattcctatgtgctttctctttccaaaatggtaaaaagttctatcacctaaatgtttaactttgaatgttatttctgtatatatttttcattgtgttattaattttaatttttccttctgtgaattttaaattctatttaattaacaattttctatatttcttatgcttaacttttaaatcatgcattgccttttatctttttcaaaagatattatccaaggtatttttacaatggtgttagatttttcagtagtgggagataatgttaaaagatggtcaagattttgattggcagactggataacttagcagagtctctcaaattttacccctaaatatccctaaaggcaaaagagaatgaaggattaattctataatttgggtggctagccctaaatggtcccagaaagtccactacaatctctttaagccgttctgtttcaacttaaaacttcatgtacattttttatttccctccataataggtgtgtaattattttaatgtgagttatgctttaattaattgtcattgagttaactgatataccaggaagacatgccatgtgtaactcttgactttgccttcatattatcccatttgcaggaggacttgtatatctggtccatgactctggctttgtcttaagccctcccagtccaagcctgccagctgcttgaagtcattggttctaccttagttctacacagagggagcctccctacacccaaaactttatgacaacctttcatacaaggtgcctcccctctggcctgcctatgtcatgggttctctttcctttcatgtcttcaactacaccacttctgtgtttttagcagttttcttcccttctaaaccacatatggactcttgtcatcctgccttcagcaccctggtatagttggctcagcctatgctgtggagcaggacctaaaaactgaagattttaataaaacagtgtgactgattcagagtcttaatggaagtttgctccaagagtggtctgtgagaaaagtttaagtgggaactacagagacaaggccaccagttagaatgcacatagaaggcagtttcagcagaaagactggcatgatttgatgttattgtttaaggaatacacagaaaccatgacctatgtcttgaattatacttcccccatcctttacaggctgtgatgtgggtgaatgctgattcatgtgaaatttcagttattttcctgagggtaacattatgattgcattcatgtatcagatctatgagaatatgacataattaaatattacacagaaaatgagctacttgcccccttccttccaagtagaataaaatatggaatgctgtagttaatggaataattaatgtccactactgatgacagtgaattctttggctcagaacaacacatgtcattttgcttacatgcatggcttgtttattccttgaacttttgacttacagagactagcattttactgtaataaacacttggttacatctgttataaattgagcacaattggtttttccaagaatagtagcgttccaattctagaccaaaattataagcagctgtctgctaatagatatgtataccaacttccacctttgtgccctcttgtttaaaaaggttgtctataccttagaaatcaagttaaacttgatgtaatttcttaatttgaaaactatgctttatgattttgtgttctttccccctttcctcactcaaaaagggaccattctgtatggaaagaaaatagtgttttatggtgtttgcaacttttttcttcctacgattttaaggaagtatttctcttaattttttctaccatttgaactaaatttaactttcagtctttctaagttctcatggggttttaaattcatctttttacagttttcttagtggttacttttctgtagtattaacctctataaagtttctaggatttgggggagagtaaaactaatttgtttgtaaaaagtaagcctagtatttgagcatgagtttggtttttttttttttagacaaatcatattttttatttgaaacttcagattacatgtttattttatttattttattttttattatactttaagttttagggtacgatggattaaagacttaaatgttagacctaaaaccatagaaaccctagaagaaaacttaggcaataccattcaggacataggcatgggcaaggacttcaagtctaaaacaccaaacacaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaatttacaagaaaaaaacaaacaaccccatcaacaagtgggcaaaggatatgaacagacacttctcaaaagaagacatttatgcagccaaaagacacttgagcatgagttttgcattttcttactaactctcttaaattacaaaggaaatgtaattcacatatgaaaatcttggcatatatagaaaagtaaagaatttcttgtgagcttaccagaatctcaatactgctatgataattttaggatatttaattccatgccatttccatgccatttgtataggcctcttttttttttttttttttttttttttgagacagagtcttgctctgtcacccaggctggagtgcagtggcatgatcttggctcactgcaagctctgcctcccaggttcacgccattctcctgcctcagcctcctgagtagctgggactgcagttgcctgccaccaagcctggctgctttttttgtattttttttagtagagacagggtttcaccatgttagtcaggaaggtctcgatctcctaaccttgcgatccacccctctcggcctcccaggcatctttctaaaaataaaattgttaaaccaggcatggtggctcacatctgtaatcccagcactttgggaggccaaggtgggtggatcacctaaggccagagtttgagagcagcctggccaacatggtgaaactctgtctctactaaaaatacaaaaattagctgggtgtggtggtgcacacctataatcccagctacttgggaggctgagacaagagaatcacttgaacctgggaggtggaggttgcagtgagccgagatcaccccactgcactccagtctgggcgacagaatgagactctgtctcaaaaaaatttaaaaaaaagttgttatgatgcacatacatagttatatttttttcatttaatatttttaacgttgcttttcaaaaaatagacattttaaaattacactttaagttctggggatacatgtgcagaacgtgcagttttgttacataagtatacatgtgccatggtggtttgctgcactcatcaacctatcatctacattaggtatttctcctgatgctatccctcctctagaccccccacctcccgatgggcccttgtgtgtgatgttcccctctctgtgtccatgtgttctcattgttgaactctcacttatgagtgagaacatgcagcatttggttttctgatcctatgttagtttgctgagaatgatggtttccagcttcatccatgtccctgcaaaggacatgaactcatccttttttatggctgcatagtactccatgttgtatatgtgccccattttctttatccagtctatcattgatgggcatttgggttggttccaagtctctgctattgtgaataatgctgcaataaacatacatgtgcgtgtatctttatagtagaatgtctttatagaagaatgatattataatcctttgggtatatacccagtaatgggattggtggctcaaatggtatttttcgttctagatccttgaggaatcaccacactgtcttccaaaatggttgaactaatttacactcccaccaatagcgtgaaagtgttcctatttctccacatcctctccagcatctgttgtttcctgactttttaatgatcgctattctaactggcatgagatggtatctcattgtggttttgatttgtatttctctaatgaccagtgatgatgagcttttttccatatgtttgttggctgcacaaatgtctttttttgagaaatgtctgttcatatcctttgcccactttttgatggtttttttttttgttgtaaatttgtttaagcttcttgtagattctggatattagccctttgtcagatggatagattgcaaaagttttctcccattctgtaggtttcctgttcactccgatgatagtttcttttgctgtgcagaagctttttagtttaattagatcccatttctcaatacattcaggacataggcatgggcaaagacttcatgactaaaacgccaaaagcaatggcaaaagtagactttttttagagcagttttaagcttacagcaaaactgagtggaattatatacaaagatttcccatatcctccctgccctaagacaagcacagcctctgcagtcatcaatatcccacacaaatgtatgatgacatgtatccaccatttgtggtaccacacagaacagcttcgctgccctagaatatcctccgtgctgcatctattcaccccttcccccactcccaacccgactgacctttttactgtctccatagttttgcctttttttcagaatgtcatacagtttgaatccaacagtacatagcctcttcagattgtcttcttttatctgctcacatgcagttaaggtttctccatgtcttttcatggcttcatagctcatttctttttagtggtgaataatattgcattgtctggatgtaccatagtttacttactcatccacctactgaaggacatctggttgtttccaaggcttggcaattatgaataaagctgctataaacatctgggtagaggtttttgtgtgaacataagttttcatttccatttggtaaatactaaggggcatgattgctggatcatatagttagaatatgttttgttttataagaaagtgccaaactgtcttccaaaatgactacaccattttgcattcccaccaacaatgaatgagagttcccgttactccacatccttgctagcatttggtggtgtcagagttctatattttgactattttaataggtatgtactagtatctcatttttgttttaatttgcatttatctgaggacatatcatatagaaattcttttcatatatctatattacttctttagtagggtgtctgttaaggtctttggtccattttttaattggcttatttgctttcttattgtggagttttaagagtttttatatattttggataagctgccttatcagatatgtcttttgcaaatattttatttcagtcagtggcttgtcttctaaatttcttgacagtgtctttcaaagaagagaaagttttaattttaatgaaatccagtttattctttctttcatggatcattcctttggcattgtatccaaaaagtaattgtcaaacccaaagcccaaagtcatctacattttcttctgttattttctatgaaattttttttttttttgacatagtctcactctgtcacccaggctggagtgcagtggcacgatctctgttcactgcaagctccgcctcccaggttcacaccattgtcctgcctcagtctcccaagtaggtgggacaacaggcgcccaccaccatgcctggctaactttttgtatttttagtagagacggggtttcactgtgttagccaggttggtctcaatctcctgacctcgtgatctgcccgcctcggcctcccaaagtgctgggattacaggcgtgagccaccatgcccggcttctatgaattttaaagttctgctttttacatctgtgtctagattctttttttttcttgcatgtggatgttcagttgtttcagcaccatttgttgaaaatagtcttttctttattatatttccttttcttatttgtcaaatatcaggtgatgctagtctgttttattaatctatttgtctactgtttggcgaataccgtactgccttgattactgtaacattccagtaagcattgaagttgagtagtgtcagttcttcaacgttattttctttctgagtattttgcctttccatataaacttcagaatcagtttgttcatatctacaaaataatttgctaggatttttattttgatggcatttaatttatagatctagttgggaagaaccaatgtcttgacaatattgagtcttcctatccatgaacatggaatatttttccattttgtagtgtctttattttattcatcataattttgtagtttttcttacatagatcttgtatatattttgttcaatttatacctaagtattttatttttgaggagatgctaatataaatgataatgtgttttaatctcaaattctttcttgtttattgctggtatataggaaagcaatggacttttgtatattaatcttgtattctgaaaccttgctataattgcttgttagtttcagaaggctttttgttcagttctttcagattttcttcatagactaacatatcatctgcaaacaaagacagttttattttttctttccaatctgtctaccttttaattcattttcttgtctgattgcatcagctagcacttccagttcaatgttgaaaaggggtgataagagggaacatgtcttttatttcactttattttatgctttaatttgggaaggagagcttttttttcagaagggtttgcagtctgcaggatggccatcctgacaggccaggaatcatagcctctggccagaagccagaaatagatactttgagggaggggaaggtggaacagaaatttacgctgaatgaggtggctaaatatacatactcaataagccataggaaagttcatgaatgtttataaaagaaatatgcacatgcacagttgagctttatgcccattcctgggtcccctgtacaaaaaacagtggtgttagcataatctgaaggtggacttttgagtcctctgatgtcaaaaggtgaaccagaggacacaaatacctgtactacccattctctgtggactgaccaggagcgcttcatggtcagtggtctcttatccggtgaaaaaggaagtacagtgtcagttgcttggtccatatcagtggtggagtcttttgaaagggctggtttctgttaagcccttagggaagaaagcctaagcccggttagggagggagggggtacaaccaggtaggtatgaacccccatcccatcatttttgagaactcagttttcgtccttgccttgtttttgatcttggtaggaaagcttcgagtttctcaccattaagtataaggttagctgtaggggattttttttttcttaaatattctttatcaagtcaagggagtacccctctaagatttttgttttttaaatcatgagtgagtgttagattttgtcaaatgctttttctgcaactattgatattatgatgtgatttttcttttttagcttattgatgtgatggattatgttaattgatttttaaatattgaaccagccttgcatacctgggataaatctcacttggttgtggtgtataactcttgttatacattgttggatttgattttgttgaagagttttacatatatgtttattcatagtattaatctatagttttcttgtaatatatttttctggttttggtattaggataatattggtctcatagaatgagttagaaagtattccttctgcttgtattttctgaaagagattgtaaagagctcgtgtaatttcttctttaaatgtttgatagcattcaccagtgatccatttaggcctgatgcttttggttttgggagattaataaatattgattcaatctctttaaactttaaaagatatatagttggcccttcatatctacaggtttcacatctatggattcaccaaccattgatcaaaaatgttcaaaaaaacccaaaacaacaaaaacaaaaattaatacaacaataaaaaatagaaatttaaaaatcaatggttttaaattgtataacaactctttacatagcatttgcattgtattaggtattttaagtaatctggtgatgatttatagtatacaggaggatgtgtgctattagtaatttgtgttctctctcttttttcttagtctgcctacaggcttaccaattttattgatctttacaaagaatccgcttttggtttcattgattttctctattgatctcctgtttccaatttcattgatgtctctcctaatttttatttttttcctctacttacttttgatttaatttgctctttttctagtttcctaaggtagatagctaactggttttttaatctttcttttttcctaatatgtgtattcagtgctataaagttttctctaagcattacttttgttgtacctcacaaatgagatgcaagttttttacatgccagactggaaacaagaactttaacattgctctttttttcttatataatcttcaaaatgatcagctttaatgcctttacatcatactttggagagatacatgatgatttacttaatgtattttatattaaacatttatatcacttctcactattccaaataaacacatagtgtatgtttttgttttttttttgaaccctagtctcactctgttgcccaggctggagtgcagtggcgcgatctcagttcacagcaccattcacctcccaggttcaagtaattctcatgcctcagcttcccaagtagctgggactacagatgcccgccaccacacccggctaattttgtatttttagtagagatggagtttcaccatattggccaggctggtctcgaactgctgacctcaagtgatcctccctccttgaccttccaaagtgctgggattataggtgtgagccaaaatgtgtggccaaaatgtaagaatatgtttaaaatttaaaatttaatactttaaaaattctttgataaatcgcttttcagtagtacaatcatttttggtatcatcagggaattgtttccagggctgtgaagataccaaaatttgtagatgctggagtcttttctataaaatggcatagtatttgcatataaactttgcatatcctcctgtttattttaaatcatctttagattacttataatacctaatacaaggtaaatgctatgtaaatagttgttatgctgtgtttgttttaaaattcatattatttttgttgttatgtttttttttctgaatattttctatctggggttggttgaatctgcatatgcagaaaccgtgggtatagtacccgccagatagagagggcctcctgaattgtagtatatggcacctataggattttaagtgcctgcacttaactgtataatagctgacactagattattaaaaatgtgttaatttgcagtaacttactgcttcaattatcatttttggttgttagaaagactgaatctttgtccttgtatattttccagttgcattttgtcttttataaattgttctttgttacttggcagtttactgcattttaaatatttttcagtatatctatatattcctgattgttccttatcatgataaggaaaaacacattttttctttcatatgtttttatcatgtaacatttaatatgaaacattgatgtagacatgtgaattataaaaataattctttattattataatgccaacttcactggaacctcccaacttagtaggaacccaacttaatgagaacatcagcacctaacttaatggagtcttacttggaccaatctctgcacttatgttttcttccctgccctccccttatcttcccttcattggaaagcactattcttactttagaagttatcattgcctttgaatttagatttaaacctttttttttttttttaaataagacagagtctcactctgtggcccaggctggagtgcagtggcatgatctcagctcactgcaacctctgcctcccaggttcaagcaattctcctgcctcagcctcctaagtagctggtattacaggtgcatgccacaacgcctggctaatttttttgtatttttactggagacaggatttcaccaggttggcaaggctgatctcaaacccctgacctcaggtgatccacctgccttggcctccgagaatgctgggattacaggcataagccactgcacctggccaagttttaaactttttatcatacacttaatttctaaacaatagtttgtttgattttattattttttggatttttttaaaaaatattcttacactatgtgatttctgcaactggcaactcctgcaacattgtttctgtgagtcatccatgttgctgcatttagatatggcttattcatatttatcatgataaattttctgttgagagatcatggcacatttatttacctttattttaagttcaggggcatatatcaggctcgttatataggtgaacttgtgtcatgggtgtttgttgtacagattatttcatcacccaggtattaagtctatacctggtagttattttcctgattctctccctcctcccacccgccaccctttccttccataagccccagtatgtgtttttcccctctaaagaaaatatcacaatttatttgtttcttgttgataaacatttgagtttaaaaaaaatcgttattattttaaataatgctgttatgaatattgctataggtgtctgtgtctacaaaagtacacatctaaggatttctctaaaacatgttcctgggaatagaattactagggtaattatagagtattcagagcttcaatttaaaagtataaagctgtattattttatttatttatttatttattttgagatggagtctagctctctctccggggctggagtacagtggtgcgatctcagctcactgcaacctccacctcccgagttcaagccattctctgcctcagcctcctgagtagctgggattacagagtggcataccactttaattttctccagcagtgtataagaatttctttggatctgcatccttgcctatactttatatagttagactcaaatttttataaatctatggaagtaaaatagtatagtattttaattttaaaattatatttttttctaattattaataagagtgtggcatcttcttgtatgtttatttgccatttttgggtcccttatctgtgaaatgcctttttgtgtcttttgctcattttttaattaggttatttgctttattctcattgggctcaatgagatctttatatattatgattaccatttctttgatggttatatgtgttacagatacctttcagtttttggcttatcttttcactttctttgtgatatcttatttaaacacctttattgagttataattgacatacaataaatgacacatatttaaaatgtataattaatcatattttgacatatagacatatgaaacaatcaaccatcaacataatcaagatcatgaacttaccccacattcccagaagttttctcatgaacacatatttcattctctcttgattaaatacctaggagtggaatggctgtgtatatgataggcatacatttacattttatcataagaaattgcccaactattttccaaagtggttgaactacttcacatgccagctggcagtgtatgagagtttcatcatgatacatttttatgaacacacattcttaattttaaggtagtcaaatgtatcaatcatttatttctttacttctttgcacatgttatttaggaaattcttccctgtctgagactgtaatgacattctcctgtatgtttaaattttttaggttttgaccttttgctcaaatctttgatcctttgttgtgatatgtgcagtatggtgagtgtggtatgacacacagatttaattttatttttcctatatggacaaccagctgtctcagcaccacctattgagttgtccctcccttttcatgtgatctccagtgccgcctttgccaaacatcaagttttcctgtatgagagactcagtgtttacatctgtattgtttcagttgtctatcctaagccagtgtgacactatggtaattaatcactacacctttgtgataagttgttgttttttagagattttagagatggggtctcgctttgtcacccaggctggggtgcagtgatgtgaacatagctcactgcagcctcaaactcctgggcacaaatgattctcccacctcagcttcccatgtagttgggaccacagggacataccaccatgcctggctaatttaaaaaaaaattttcgtagagatggagtcttgctgtgttgcccaggctggtcttgaactcctggcctcaagcaatccttctgcctcagcctcccaaagtgctgagattacaggcatgggccaccgcacccggcctataataagttttgagagctgttggtgcaactgcccttaacttatttttcttcagcagtttctgggctattcttggcctttgttcttccatatatatttcggaatcagcttgccaagatccataaaaaaacacttctgagattttgagtgaattctatttaattcaaagatcaatttgaaaaaaaattaaaatctttacaaaattgggtgttctgacccgtgaacatggtttctttccctttatttgaatctttaatgtccttcaaaagactcttataattttattaggtatgtcttgcacatcatttgatatatttattaccagattttatgtatggaaggcaaatagtgtgttttaaattctaccagacttacattaacatatttttttttgagacggagtctcgctctgtcatcaggctggagcacagtgcatgatctcagctcactgccacctctgcctcccaggttcaagcgattcttctgcctcagcctcctgagtagctgggactacaggtgcgcaccaccatgcctagctaatttttttttagtagagacggggtttcaccatattggccaggatggtctgtatctcttgacctagtgatctgcccacctcagcctcccaaagtgctgggattacaggtgtgagtcacccgcacccggccacattaacgttttaatagaagtttagtcctttgcttttctaaattttctcccattgcccctctcctcattgcccccaaagattaccacttttctatcagtttaatatggaattttacacaaaaaattattttcattctaaaacagaataaaaaatagtacacatattaaaaaagatgaaattttgctttctgtttttcattctgttactgtatcataataaaattatttacatttgtgagaatacattatttttctcatagtgattaatgaattaatttaagtacttttaggtagagaactgatttcagtgcccattgacagttattttctactaaaatgtctctattttttggattcacagttttattaatctcttggtggtctggatgatattgttagctaatttttgtagaaaacttactgtgtggcaaatttataagactttttcatcttgtagctgatttttttataatattcatttgcagggatgatcattaaacataagtcattctaacatataaatagcacgtagatatatatataaaatccttgaatcataaacttctccctccacgcataatactctgccttgtttttagcatttgttattgtagaggagatatggaaaagaaaagtatagttgatttttcccccactttggttaattttaggacttgttgaaaaaattctttaagtttaaaatttttatgaggctatattttaatatttatttctgctcattaagtttctctggaagatgttacactatcaatttctaatgtcaagtttgctttttaaggtctggaatgttttattctctcatatctctgattattgcctctcactgattcatttgttcttgcattgggcagttttctttcgaaggtttggcatttaaatatgtcattgccttatgtgtatttttcacattgtcatttatttggcctctactctgaaaatgcttctcaagtttattctctacaattataaattgattttctgcgtgcctgctgattttatttgttgttacatatttcattttcttgtatctttttcagccagttcttgtttaacacattattttttcatattgggttcaaaaagtagatatctttagaaatgtttttttttctatttcttcaaatccaagaaggaaaatggtgagcagtgaggaggcagatgattttcctttaagccattattctttgcttttcttgggcagacagaatttatggatagatattgattaattaattcagcacatatttatcgagcacctactatgtgccaggtactatttcaggccctgaggatatagtagtgaacaaaacaggcaaaaaaagtccctactttcatggcggttatattatactgaggggaatagggaatacacatacaaataaataaaacatttgtacatcagatagagggatgtgccctagagaaaagtaaagtagggaaaggagagaagaatttttggatcaggtgcatgggttgcttttaaactgagaaggtaaagaatgattggataaagaaaatatgatatatatgcacaatgaaatactattcacctataaaaaggaattaagtcatgtcttttgcagcaacatggatggaactggaggtcaccattttaagtgaaacaattcagaaacataaagtcaaatgccacatattctcacttataagtgggaactaaacaatgtgtacacatggacacagagtatggaatgacagacattggagactcgaaaggggcaggtgatgagaaatgacttaataggtacaatgcatgttattttgggtgatcgatacactaaaagccaagatttgaccactatgcaatatgagcatgtaacaaaattgcacttgcactcttaaatttacacaattttgttttttaaaaaagtagataaagatataggaaacagagcattccaggtggaagaaactatgttgcaaaaacctctagtgggtgcatgtcagttgtgtatgtttcataacaagagtgtcagcgtggcttgagcagaacaagcgagggagggtgagaagtgatgtcagagagggacaagggatgaggtccagtgaaaaggtccggcagggctttctggcttttgcttttttgtacatgagatgggaatgtgtggaggaggtatgagcaaaggcatggcataatcttacatttgttgttacaagatcactctggctgctgggttaggaattgactgtagaggccagagtagaggcagggagacccgggacgaggctcctgagagatcctgtggatctcaccttgtgattccagtgagacatgctggcaattacagcaggtgggagcagcagcggagaagtgctgggagttcagctctagatatattctgaagcagagccaacatgattggctgaaaacattagatgccaggtgaaagagagaagagttacggataagtccaaggatatttgcctgggaaccaaaattgagttgccaccttctgagcaggagaagactgaggggagatgagatttggtgaagatgggggggttccattttatacatcttaaatttgagatgcctatgtaagtggagctgacatgtaggaaattggatacaccaatctgaagctcaggggagaggtcaggctggagaaatgatatgagattcatcagtggctaaatggcatttaaaatcataactctagatgacagcaaaggagggagtgctgatagagaaatagatatgttggcattttcatttgtataattcacttttgactttgatttgttcatttctacttattttacacagtagtcttctgagattggttttagggctcctgtggtgtaggttatgtcatgtaagcacgtattagattgttttagtttttgaaacagggcactgtgttgcccaggctcgagtgcagtgatgcaatcatggctcactgcagcctcaagctcccgggcttaagcaatcctctagcctcagccttacaactagctgggactacagatgcgcaccaccacacccagtgaattttttaaaatttttgtaaagatggggtcctgctatattgcccagggcggtcttgaactcctaggctcaaacagtcctcccatcttggcctcccaaggtgctgtgattacaggcatgagccattatacctggccttgttttgatttttgaatgtaaaagttccacccaggtctgtctcagaggaccccatctcatccttgtagccatcctaaagttttcttctagacctaaaggttgtatgtaggttgagattaaaaaaaaaaaaatgggcgcatgcctgtaatcccagctacttgggaggctgaagcaggagaattgcttgaaccagggagtcagaggttgcaatgagccaagatcgtgccattgcactccagcctgggggacagagcaagactctgtctcaaaaacaacaacaacaaaaaacaggaacaataaaaatcttattttatgcttgggataaagcagacatccatcaaatgttagtttgctcttttagatatggatgtcctaccctttctgtagtttagctgtccagtaattggtccagtagtacacatagccgcaatctgtgtcttcctgggatgaatttaaggctgctagcagaaagaagcctctttctactgaattaactaattaatgtaattctggattggcaaaagttattcccttgctgcacagaggaagcataggaagagagaacacagtcttcataaaaaggaaaaagtgaggtgaggggtcagagagaatacacactctgacaacattctttaaagatcctggatccagccatgcctcaagtcaccgtaggatggcttcttcccccttccttgcctctcttcctccctttcttctctcttttccttattttttttctgcttatgccttttgaaattggctatttgcaattggaatgattctgactaatttcatgcctgttcaatccttcaggtcaaggcaagggaaataaagagactacaagtagttcattgaacaaagaaagcacattcaggtccttatttcactaaccccccttttcagcatctcagagatgacatcagtaggttgcttcaggagacactggtctgtaagcacataggctgtacatgcagagccagctctgggtggcctgagctgccagccactcccaggatgggggtcagtggtatacgagttggtgaaagttcatgcctccctctgcttaaatttagtgggagagccaaacatcaaacaaatccacatgtaatctaggtgataaagcagaataggggctagggatataggcacaggggatagagctctgttgtggataggtagagcaacactaagaggtggccttgaaatggtgtaagaatgaaacaagtgatgggatgaggccatctggggatatggagtccaggcacaggaagtcaggagtctttgggtgatttatgagcaggtgagtgatgtagtttgatttattctttaaaaccatcactcaatgctctagagaactgaccttaggggcaggcaggccaattaagggctaatgtaatggtggcgcaggtaggaagcaatgggacttggactgagtgatagtgccaggaagtcatcgtagagctggagatcaagctgatgggagttgttggtggagtcgctctggggtttgagtacatgataaatatcaaaaaatgcatgcaagatttttgcctgagtcaataagtccttgtgccatctattgatagggagaagtgtgaggggtagatgtctggaggggcctgccactgagcaggacgctagaagagtgtgacatcttggaaatcataggcatgattgttttcaggagaagggggttgtgttaggctgttcttgcattgctataaagaattacctgggactgggtaatttataaagaaaagaggtttaattggctcactgttcttcaggctgtgtagaaaagtatggtgcttgcatccgctcagcttctggggagggcttggggagcttccaatcatggcagaaggcaaagcagaagcaggcacatcacatggcgaaagcagaagtgagagaaagagtggagggggaggtgccacacacttttaaagcagtcacatcctgtgtgaactcagagcaagagctcacttatcaccaaggggatggcccaagccattcatgaggaatccaccctcatgacaaaaacacctcccaccaagccccacctccaacattaggaattacaattcagcatgagatttgggtgaggacaaatatccaaactgtatcaggggttgactctatcaaacactgatgaacagccaaggtacaatgaagactgagaaattcccattgggtgggccatgatcatcatataacaagaaggtttgggagtgtaggggttcaggggagatctgattcttgaccatgtgttcaagggacagtccctttgctgtgccaactgctagaggagagcagaatgtgcaggctgcccaaacctgttctgcctctgcagaagggttgaaagtgatgggttggattgcctgggatcaaagccaaaactagcaccactgaagcagtgtggggcaggggagaaaaacacagattgctgggaatttctgcaagatgattttggcatcatctttatggtacgtttgaatgtggcctgcataggaaaccagaaagttgaacttaatacaaaattggaacttgcctcctgatgggccccaggtgacagatgaactttgaaaaaaaaaaaaatcagtgtttacggtagttcttaccacagtatgatcggtaattccacccaacacctatttccatgattagcctggttttcttatttcttttgcaattcacctctaagccaggcatgtgatatgtactaaaatcaacctgagggacaaaaaaattctctggcatttaaatggatttcacatgtgccacttctaaaaattcccagcaagaggggacatttctattaagacattccactggaatgaattgatggctgcctgaattgtacaattatatttgctctaagggatgaaggatctaaagaatagaggaaatgagggtagttagaatacaacaattataattatggagctcacacgctgctatgttgagagaaatgatcagcagccacttctctgacactgcaagattttatgttttggagttcttaaatttgagggttattaccctgagttacccagtgttataaacttttatttgcaaattgcatttataaagagtggctatagaaggcaggataaaatatagccagtaaaatttgcactgtctcatagttttactagttttccaaaacaactttcattgggctgatgtttgaatgtttggttaataggaccatgtttttgcgtgttgttttaattttcagaaaaaaaaaaataaatgtctctgagaacccaggagagggagtagttaatgtttcctgacagggatcaggaaagacttcagaaaaatgctaacatttggcagggctggaaggagagatagttttctagtagaaaagtggaagaacacatcccacgtagaagggaagcatccacaaagacgagaccacttagaacagctagatgggcctggatcagggccaaatccaacaggaagttggcaaccttggaattatgggctttaaagataggggatggccttagtggtgtctgtagcccccagctagcaaggatgtgagctactaggtagcctgttgtcccagggacagaactgaatgccatttcttcttgggtactttcccgctgcttttaacatttgggtgaccccagaagaggatccaaattggcgtttttcaggtctaaaggtcaatttttgcttctagaaagatgtgtaggttacctctagagccagctgaactgcctaattcctcagaggacacactaggggaagggaaattgaggaggtgtcagtggaaggtgacaaagttggagcttccaaaggtcacacttttattgaccactgttaagccagacagggtcgcatcccgagtgtatcataaagggtgttttgggagaagtaggcataacaagtctctccaaaggcagccctgggaagtacgtggaaaaggcatgatggaaatgattacggaaggttatgctgggactgggtaattttccatcagtcttagttattaaaagcatttaccccgtgttagggttttgcagagaaacagaaccaataggatgtacttgtatgtcaaaagatttattttaaataattggctcacatgattatggaggctggaaggtacatattcctgtgattttgaacctgtgagttggagataaagggaagaaccaatgttgtagtttaggttgaaggccagctgcttgctggcagaattcttgcttgagggaggtcagacttgggtctgttaaggcctttaaccgactggatgaggcccagctccattatggagagcaatctgctgtattcaaagttcactgatttaaatattaggatcacccaaaaaaaatccttcacagaaacttccagaataatgtttgactatatatctggggaccatgggccagtcatattgacatataaaaagttaaccatcacagcctccaaagactgacgcaggaggggatgcccctttagagctcaatgtctcttgattgtcttttgttgccaacaaaacatgaattttaaaactacttttttccatgtcgatgtatccccagtgcctataatataacttagcacatagtaggtgcttaataaatattttataaataaacaaatgataggataaatgtttgagttcaattatttgaaagcacattatatgacactctagttatttccattctggacagaatgtttgtgctaatgtatgtaataacatcacgtcgagttgctcggtttgtctggcttgtgttcctatacttcctaggcataaattgggcatctttggaaattggtcgtaactttttcatattactgattatcatggagaaattggcaatagacttcaatacatgatgtttccgtgtgtcctgctgagaagctctcacccaagtgagaaagctaatgaaccgtctgaggagttttagctgtatatatattacagcacattgaaagggaaagagaaatgatgtattttctttaccagcaaagcttgtgaaggctatttgtaactgtacttggcccaccgataatttgtagccttggaaaatgtgaccgacaggtgtggaagtactcctggagcccatggtagagtgaatgataaatcatagccttgtagatggatgggagacaggactggcaagaagttcatcagcagtgggtgcaaatacaatgagcaatgaataaaataatatgcatctgattttgtctgcaaacaaataaagagaaggctaacccatacttaccttcctttcatggttcagactttcctgatattttatgccctttacaaacaccactttttgaaggactacactgaatgtcattcaccatgttccctgccctccagtaacttattgctgccatttgtttgttccctacaaatctcatgttgaaatttgatctccagtgttggaggtggagcctaagaggagatgttcgggtcatgggggcagatccctcatgaatggcttggtgccatccaagcagtaatgagtaagttcttctattagttccagtgagaactgcctgtttaaaagaatctggcacctccatcccctctgtcttgcctcctctttcaccatgtgatctttgcacacactggctctgcttagctttcagccatgagtggaagcagctgaagcttccccagaagcagatgctggtgccttgcttcttgaacagcctgaggaaccgtgagccaaattaaccccttttctttatagattacccagcctcagatattctttattttttattttattttattttttcgagacagagtcttgctctgtcacccaggctggagtgcagtggtgcgatcttggctcactgctagctccgcctcccgggttcaggccattctcctgcctcagcctcccgagtagttgggactacaggcgcccgccaccacgcccagctaattttttgtatttttagtagagacagggttttaccgtgttagccaggatggtcccgatctcctgaccttgtgatccgcccacctcagcctcccaaagtgctgggattacaggtgtgagtcacagtgcctggcagatattcttttatagcaacgtgaatggactaagagacattctagatagaagtttggggcagaggtgtgtatgcacctttcctagttggtgggacaaaatgatttgcttcagctacaattttagtagctgaaaacttaacagaaaacaggggtcaaggtaaagggttaatgggaatcattctctgccagcagctgtagggaaggagagatagagatggcaaaggaaggattaagcaaagtgtgccaagggagtatctgattatagtgaaggaagtaaaaaactataggaggtaaagaagaaactagaaaaactggcagaaaggcttgaaaccatcaggaaggaagcgaagactacgcagggcctaggggactatctcatttgataaagcactttctagtatgcatggcactcatctcagaggaacgtaatctgatttggcaaagaaaaatacctctttgaatctctggagaggaaactagctagaaacaagaaggctgctggggcgatgacagtagccagaggagtcttgaggaataaaaaataaatgaaggtaatgaagatgtccagggaagtattggcatttatttattccagactttggatgaagatggagatgcatcttttgtttcctgggcttcggatcctggggcactggggtctctcagaggttttatgaagatgataatggggtgggtttcaggagagagataaagactgtatctttggtgtaagtccaggcaacagagaacagttcaaggaaatatgctcccacatgaccacacatgagcctcttgagtagggccaggacatgtcaagaagggaatgactatctgcaccaagatagttgagacaattaaggaaggacatttccttattaggaagggattgagaatagatcccagagggagcattcataaatagtggaggaaatgatgaaaatgaagatttaaagaagatacaaaggtcagaaagatacagagaactaaagtcagaagtgagttccttcagaagcccaatctagaactggctggcctctttgcaaaaggcccagcttcttgctgagctccggggattgtttctgtgactgatacgtgatgaatccatctccatgtttcctgctgctgccctacacttagatttccccaagaatacaagctagctagacctgggctgttttgcaatgagagccagtttctctcctcccttatccccaggagtgactgttgtgcgctacacctggattccctggggaagctcagtgaattcaaacctgcaggtgtggaatcaattccattggaaaccccaaggccagttgaccagttcctccagactgcacacctctgacattctcaggtgcttctcaaaatggaagcccctccaaggtaggttatctgttctctgcagcccaacctgctctgtgtgtcctccccttggcccagcctccctcactccctctctccaaaacctatgcacgacatcttttggagtgcttgtttcctagtgaacaaaagtcctttccttcatcctcctctttagtagagggtctttatccctgggtcttaactgacaccttcctccagctcaagaattttaattttctagcagccttccgattgtagattctatgagagcaggaaccccatgtgatttgtttacccagaattttcttagcatctagcacagccccagcactagcaggcacccaagaaatgcttctggaaggaaggaaggaaggaagcaaggaaggaaggaaggaaggaaggaaggaaagaagggaaaggagaggagaggagaggaaaggaaggagaggggaggggaggagaggagaggggagaggagggggagggggacggaaggaaggggggagggaagatggaagggagggaggatgggaaggaagatgggaggatggatttgcttatttgcctgcaacctgtgttttcagagtcagtagttggggttgagacccctctattttccctgtgccttttacaggtaacgtttcttcttcctcttatccacggtcctgtgaggttcatgctgtctggttataaaacccactaccccatcactgtcagcactaccttcctacttctgttcttcatgtagtaaaggctttgctgtctggctcctgtatctcctttaccccaagtctagggtaatgtcagtgtcttaaaaaatgatccactcaacactccagttttttggtctcttgacttcctcaatactagtgaacttcatcatcacttctctgccaccatccacccctggcttcgtcctagagctcgtcatcacctgctgttataccacatctaacatttttgtttttattggtgtatatttccagaagtggacaattagtgttcataaaaatgttctctacaccactgacttcaattcctcaccacgtagacacatcctgattcaatccaatcaagcatttatactaccaagatccccaactcatttgccatctgcctcctttttgttaaatccactgtggttttctacctttatttcaattgacaacttggcagcatgtaccaattttaaccactgctgccttcttgaaatgtttttctttggcttccttcacacttactctgattctcctatgtctctttctccaactccctttgttctctgccatctttacccatttctaaatgttggtgtcccttaatgtttagtcttttgcttttttttttgagacagagtttctatcaccaggttggagtgcagtggcgccatcttggctcactgcaacctccgcctcctaggttcaagtgattctcctgcctcagcctcccaagtagctgggactacaggcatgcactaccatgcccagctgatttttgtatttttagtagagatggcattcaccatgttggccaggatggtcttgatctcttgaccttgtgatctgcccacctttgcctcccgaagtgctgggattataggcgtgagccacctcgcccggcattttgatcttttttctttgaattctacactttctacctgtgatttctgtctttccttgggcttaagtaataatttgcatacagatgttttccaaatttagagatgcctcagcctagcttgtgaggtccagacagttatctcaaagctatgtgctgattgtacaaaagggactaatattgacttcaaactcaacctgttagaaactaaatgcaatataccaaccatctccacaaattttctttgtctcctgtgttttgtttctttccgtttcctttctcttcttctcttctcctttccattcctttcttttcttttctttttttgaccttcctcacgtatcttgattctgttttcttctctccaactccattcccacagcttctggccatcatcatctactacctaggccattgcagtcctttcttaaactgctttccagatatctattcttaattccatccaatttaatatccaaactgtcagctttctaaaatgaaaatctgatcatgtcattcttctgcttaatgcccttccatttctctgcattgcccttaataaaagtctaaatgttttgtcatggaatatgcaacccttcaaaatgtaacccaagtttacctcttctgcttcaactcttgctgtccttctctctactgaatcctaatagtccagcagtcctaagaattcaagaatctgccattctttctaatgtgtctgtttcaactgcctagaaacagcctttttcttacctctctttaacctcctcttcacagtttggcttttgtgatgtcctctacggtgggcttggtggctctcctttgtgttctcacatgcacagtcctttctttcactgcattattattgcatgttgtatttgcccctttacgcctctgtctccatcactagacagaatgaatgcctttgacggaaggcactcaaatcacattctctgttaactccccagtgcccaggaccctggcttgatatacacttgttcaattaatgaatgactaattgaagagcttgaatgaggggctgtgactgcgtaatggtggcacaaatgcaggaggcttctaatagcagcatcttggcagaatgaagtgttggtcctattttacatgatcattaatatggtcaagtactttctagctaggaaaaatatagattttagtggttcatcaccaggcatgcactttgaattttctactcatgatgtgctgaccttaagataattcctttcccttcccttcccttcccctcccctcccttccctttcttccctttccttcccttcccttccctttgttttttttttgtttgtttgttttggtttttgtttttttggatacagagccttgttctgtcacccaggatggaaggcagtggcatgatcttagctcactgcaacctccacctcccaggttcaaggaattcttgtgcctcagcctcccgagtagctgagattacaggtgcatgccaccttgccgggctgaattttttatttttagtaaagctggggtttctccatgttgcccaggttggtctcaaactcctgagctcaagctctctgcctgcctcggccttccaaagtgctgggattacaggtgtgagccaccgtgcctggcgagaattttctacaataccatgtgaggtgtcccatgcaccaggacaaatgtgttgtctagaaagtttattcaatcacgtattttaataatttaaatcagtgaggatcatatgtactgaagcatttttgaaagtatgcagaaaatgagtcttctagtttttacttccctatgttatgtgtcatgaggtccttacaggagctaaaatgtcttttttttaagatgccatttctccaactcttccctagtccccttgaacttactttcagtattaaaaaaaaaagaaatttcttcttattttactgtgattgaccaaactaatttgtgactgtggctagtggtcttgaaaattaaaataatttcattcatttagcaaatctggttgaagaaaaatgtgaataaaaagttttttcttcctggttttctttactgtattttaagccatctgcaggggcttcttgtgagattatctgtcttgaagatatttgtgactaattacaagcagtgtaacctgggagagaagctgttcaggctgaggattttaaaacgatgagatgagagaaaattagcagacatcttttattatgtctactgtctttaaaagtcaactctctggaaaactatttttataggcaaaaagtaggtgggtatgtggtatgattatttgttttacttttgagggcagatgctgtacctcacatcatgagcaatccaccctcatgttagagggaagatggagtcgtttctgggtgtttgtgaactcttggtagagccaactgaatgtcagtttctattattctgtggtgaataataactcaagtaattttcataaagaaacagattgaatttcactgtgaacattttcatcaattcctagaatcttggaatttcgctaattagcgagttggaagtattgtattatgtgggagggggatttaatgaattaaaatactattaattttgtctctttttgttttggttcctgagacatttacattttattgactccttagatatgggcttaagcaagtctctttttaagacaggaagtcattgaacaaattatttgtgagctccaagagtaggctgattttattgcttcaaattatgtgtggggggaaatgtactttgatccaaatgttaattggatactgaagaattgtttctgaaaatttgactatttttaaacagcttgatataggctccaattaaaataaccacatataacgttcatttttattttcattaactcagaattaagaactgtgttataatttttgaattcatgcaatattgcactttctcaatttccctcaggtatcatttttgactatgtttacttggaaattatgctttttactcttgtatcaaaggcattagttatgacatgttactaatgaatgtaagcataaaggaatgatatttttattaaatcctaggcattatgttttattcagtgtctttagattgctggtttaaaaaaattccatcagaaaccaaagtgaatgggtattacccaacaacttccacagggcagccctgtgctaagctacacatactacaatttatcacatttaagctctgcaagagccttgtgaagaattatcacccccattttacacagaaggagttgaggcacaaagaagttaagtgcctaccccaaattcatacaaataacagttggtggatttgagatcatgggttttttgaaatcagtgatagatgctctgcgttttggttcttcagtttcatgcttcttattttttatgggggctcaaatcattgtatagaaagcattctgtgcctacttgcaaaaagatttcagatttgacaaatagtggtgccaaaaatggagctggcaaacacaaatagagggaaaactggctaagaccagtggcattggttataagcagaatattcaccagcattgcttaaagctttatagaaagaaaagatgacatcctcagtatgaggattaggagaccatttgtagctcaagaagcatgaccattaagcttctagctgttaatggaaataatctgagagctttgcactgtacgaagctgtgtctgtttgattgcttcatctgtacatttgcttgtgaacatagtcaatcaaaaatcaaagagctacctacctgtttcttagttgaagctgtaactgtaatagttttataagatttaggatgcaagctaggaattgaatttggagctcttacagactgtgttcaattgggttgactcaacttgctataatatattttcaaaacatttgggagtaggaatctcactgattgaagcaagagttatccagacttctagtttctattgaatgctggagtacaaattgggggtctatttgataataagcaaattaatctgttttaatgattaaaaataacattatgtctaaaatccaaactaatctcaacagtttatcaatgaaaagtaattaagaacttttgaagaaccatcacgtctcctgtgatttttaaacatctatttttagaacttagagaaaatcatagatcttaaaactttgattctcgctttcaactttgccttaagatctggattattctaaccctcctagtcctcctgagaaattcctactttcttgctagacccagctcaaaaataccctcatttatggattctcccttaactatatgcccaatgtcccctcctccctgttctcactggagttaaccctttcttgattccccctgtacgctatttaatgactgacctttctgggtatctgccaggctgagctgtgagcacctgggtagcagccagttcttttgtctcagaatatagtacagtgcctgacatttaagagacactcaatatttgttaaacattcatacattgttaaacaaatgtatgaataacacggggaaggcaatgcatgggtgcatcagagacaatcatgtcaaaaaagagaggaaaggaaagggacatttcccagaactttaaagactgaaggatctcattaatgactcatctctgtcctaaaagcaatcaggatgactgttcagtgcccctcctggcaccatgtgacccacataaggagtgtcttcagactgaagctttgctagaactcagagttttacaggctctgcccaggagcctctctggcattttctcacacagtctaacaggcagaaaatctcttctttctttttgtgatctttgacgaatattgttggatcttctgattctgacagcctttagcagtgctccattcaggtgcagggcagtggatgcctaggctgctgccttcatagcttctcccgctctctctatcctttttatctttaatgtcctgcatctcgaggataaagtgtccgcctcctgcttctgctgtccaccttctctttgggacccttgaatcctgacactcagctgcttagatttctaaatgctccttttctgccctacaccttgcttccttaatctctgggcatcgcctgagagaaggagctgatagggccgttgtaccatttcctgcaacttttttttttttcctaaatgagacttgctaatttttttccatttgtgagcttcaagaagtggtatttaattgctgcattaagaggaagaataaaatcaaaggaaaaggaattaaaaaaaaaacaattggcaaatgattaaaaaccaccaaattatcaaaataataattaaatacaaaccgaatttcatcttcattatataaatacacagacaaatcacagactgtgtaattgtcaggactgacactcacaatccagggatctacagctgtggcacccacggcggacgcttccaagcccagctgcccccagctgtggcccagattctttcctgagctggagagcaaatggaacaaaaaagtttggaagagaagataacttagatctttggagcttattgagagaaattgaaatcctagaggaatcctaggaacatgaatctgtagggagaggaaaaacatttctaatatatacgacagttcttcaccatagatctttggccatatccagggaattaagagatctggtttagtctcaactcagtctccacgcaggcataataatcttgtccaagtctgttaacctctgtcatcttcagtgatcataaaagtccctaatattgctaaaattcaatacttctgttatacagtcctattggtaagagtatatagaatgtgcaatgtagagatgaatgtaaatggtcttttctccctggtggcctcgagtgaggagcaaaatacttataattctgtgaatgcaaagcaaaaacaaacgaggaatgaaaagagaagagaaacagaacacaagcctagggggagaagacttaataggttattgtggaaggaaaaaatagaaatgtcaatagtcaaaataagaagtttgactgtgctgtgtatcactgagagcctgctgaacaggttgcgagctaataattacaagaatccagttaacctcaagtaagcatctatgcctcatgttcaggattgtgaaccagtactttatttcactgatactttattttactttctaatcttccacatatatttatgtgcgatatcacataataaccaatacctttggttattatgtgattctgagccctattttatttttttgatttttaaaattttatggagacaggggtttcactctgtcatccaggctggaataatgcagcagtgtgatcatagctcactgcagcctcaaactcccaggatcaagggatcttcccacttcagcctcccaagtatctggggccacagacatgcaccaccacacccggctaattttcttttttttttttttagtagagctgaggtctcactatgttgcccaagctgttctcaaactccttagctccagtgatcctcccacttcagccttccaaaatgctgggattacaggcatgagccaccacacccagcctgagtcctattttaaagaagtataaggtttataaaaacaaaaggaaaacctgtaaataaataggaactgatgtaattaatattttaaaaaacaacattggggctactaaagatgagtttcatgcccacatgaaacagtcttttcaaaaaaataaccacgacattcatttttatttttattaactcagaattaagaaccatgttataattttccaattcatgtaatattgcactttctccatttctccaaacacaggtgcaatgtttgactatgtttgttttgaaatgatgctctttattcttgcatcaaaaacttatggcatgttactaatgaatgtaagcataaagggacgatagttttattaaatcttaggttgtttgagccattaggatgtaataattttaaaatatataacagtcctttcaaaaatagctatttaaaaattattagtatttaattttttcacctaatttttccaattatttattgtggtaaaacatgtataacataacataatttagtacattaaccatttttaagtgtacaattcagtggcattaagtgcattcatattgtttggtgaccatcaccacagtttatcccacatacatttttcatcttgcaaagtcgaaatgctatacccattaaacaatactgtctgtatgatttctattatgctaagtgccttatataagtggaatcatgcagtatttgtttttctgtggctgacttgttttgcttagcataatgtttccaagtttcatccatgtcatagcacatgtcagaattttctacttttttaaggttgaataatgttccattgtatgtgtagatcacattttgtttatttattcatctgctgatgaatgcgtgggttcttccacattttagttattgcgattaatgcttctatgaacatgtctgtggaaatatatcttcgagatcccactttaaactcttttgggtatatactcagtaggaaaattgctggatcacacagtaattctatttttaatttcttgaggaaccaccatagtgttttccacagtgactgtaccattttcactcccatcagcattgcacaagggttctaatttctctacaaccccactaacaccggtcattttttatattttgttcttaattaaaaaaaattatagcagccatccttatgggtgtgagggggtgtctcattgtggttttgacttacatttctctaatgattaacaatgttaagcatcttttcttttcttattattttatttatttttttgagatggagtctcactctgtcgcccaggctggagtgcagtggcgtgatctcagttcactgcaacctctgcctcccgggttcccatgattctcttgcctcagcctcctgagtagcagggattacaggtgcatgccaccacacctggctaatttttctatttttagtagagatgggttttcaccatgttggccaggctggtcttgaactcctgacctcaggtaatgcaccttcctcggcttcccaaagtgctgggattacaggcatgagccaccacacccagcctaagcatcttttcatatacttattagccatttcttatttggaaaaatgtctattcaagtcctttgcccatttttgaattagattgttgactttttgttattgcgtttcagaagtcttctatatagcttggatattaatcccttaaatagacgtatgatttgcaaatattttctttcattctgtgggttgtctttttactcctttaatagtgccttttgatgcacaaaatttttaaattttgatggaatccaatttgtctatttctttttgtggcctgtccctttggtgttatcatatataagaaattactgccaagtaaatattgggaagcttttgcctcatgttttcttcgaagagttttacagttatagctattacatttaggtctttgattcattttaagttaatttttgtacatagtgttagataagggtccaatttcattcttttgcatgtgaatatcaaaatttcccagcaccatttgttttaaaaaaattatcttttccccagtgaatagtcttggcactcttattggaaatcatttgaccatatatgcaagggtttatttctggactctgttgtattccattggtctgtatgtcgatgccagcaccacactgtttcaatttactgtagcttcatagccagttttgaaatcagcaagtgtgagtcttccagctttgttattttttagaattgtttcagctaattgggactgcttgcaattctacatgaattttggggtgggtttttctttttccttttcttgattttctctcttttcttttctctttctttctttcttactttctctctctctctctctctccccctccctccctccctccccctttttctttctttctttctttttttttttttttttgtttcagaattttgctcttatcacccaggctggagtgtaatggcgtgatcttggctcattgcaacctctgcctcctgggttcaagtgattctcctaccttagcctcccaagtagctgggattacacgtgtgtgctaccacacctggctaatttttgtattattgttagagatggggtttcaccatattggccaggctggtcttgaacttctgacatcaggtgatccacctggggtgggtttttctatttatattaaaaaaagtcattgggagtttaatagggattcattaaatctgtagattgctttgggtagtattgacgtcttaataggtttttcaacccatgaacatgggaaatctttccacttatttatttcttctttagtttgtttcagaactgttttatagtttctattgtttgttttttacctccttggttatgttaattcctaagtattttattctttttgatgctattgtaatggagttgttttcttatttcctttacagattgttaatttttagtatataaaaatgcaagtgttttttgtgactttgtatgctgctacttggttgaattcatttcttagttctaacattttttggtgaaataattagggttttttacatataagaacatgccatatgtgaacagagataattttgcttcttcctttccaatttggatacctttgatttctttttcttgcctatcggctctggctaggacttccagtactgtgttgaatagaagtggaaaagtgggcatccttgccttgttcctgatcttagaggaaaagcttgcagcctttcaccattgagtatgatgattactgcaggtttttcatatatggctcttttacgatgaggtacattagtatttaattttgagtgttacagtttctctgaatgtctgatttcagggtaagtagctttattctgtagaaggcaaaaataagaacaacagtaacactcttaataattagataatggtgtagtgagataagaacgatgtctgacagactttgggctgattcataacacttctgttttctgactatcagactttgaacaaagtgcttaacttctgtgagcctccagtccccatgtgtggaattgccctccaaaagttgtacctatgcatgcttttgaagtttcagtttgtttctatatccacacctacatcatgagtatgaagagtgcattattttcccctgttacttatagtaaagggaggaagaataatttcctttgacttgacaccatatccccaattagttcattttttctatttacctaatgtcgtatatataccataggtagaggattagctaattttattttatttttggattttcctcccttcttgggtttagggaagttttaactcagtgcctagaccctcacacatagttggcacatgcaggttggtgggcatacacaaatcaaatcaaaagtgtgaagagctgaaagtgcattgcacttgctagcatgtacttgctaagagctctgtttgctcctcatggatcgggctccctttcacactaggcatatgaagggtgtgaggatgagagtgctggctgggatgactgctacagtgcatgcatgcagcagatagaagttcctattttcacctcaatgcttattgaatcaggcttttccctcaggctttcacactatcttaacgggactaatagttgagttagttaagtttgtgacagcctaaggctgcatcagtgtgcattgagatagaaagtttcaggaataagcaaagcaggagggactggagtggacaatgtgcagaagttgaattctagcagtcgcagtagcacatctgtttcagtgttcaaagtgttattttgccaatgctaagaagaataggaataggataaaaaaatggataacaatataggggaatgattttaaaaatgaatcaaaaggttaatagtaagaacaagtcaggtgtggtggctcatgcctgtaatctcagcactttgggaggcccaggtgggaagattgcttgagctcaggagtttgagaccagcctgagcaacatagcaagaccctgtctctgcaaaaaattttaaaagataagaaaagaacaagtatcagcatacgtttatgttgagatggtttaccagtcagtgaaaaaaagaaaagttcagacagtttaacaagtatccactttccaggaagatctagtcccaaattcagtcattaactcttaaatggtgatgttttagaaatgtaaatgtaattggacaatagctgggcatggcagtgcaggcctgtagttccagctacagggaggatgaggtgggaggatcacttgaggccaggagtttgagattaggctgggcaacatcgtgagatctcatctctacaaaaaaaaattaaaatgaaaactaaaaaaattagctgggcattatagggcacacctgtagtcccagttactcaggaggctgaggtgggaagatcatttgagcccaggagttcaagtccaacctaggcaacctagtgtggctgaccttcatctcttaaaaaacaaacaaacaaaaaacaaccctgatctgttatttcttgtcttctgctagcttttggattagtttgccattgcctctctagctcttttaagtgtgatgttagggtgttgatttgagatctttctagctttctgatgtgagcatttagtgctataaatttccctcttaacagtgctttagctgtgtcccagagattctggtacattgtctcttttttctccttggtttcaaagaacttcttgatttctgccttaatttcattattacgggagtcattcaggagcaagttgttcaatttccatgtaattgtatggttttgagtgagtttcttaatcctgagttctaatttgattgcactgtgatcttagagaggctgtttgttatgatttcacttcttttgcatttgctgaggagtgttttacttcccactatatggtcgattttagaataattgccacgtggcactgaaaagaatgtatattcttttgatttggggtacagagttctgcagacatctactaggtccacttggtccagagctgagttcaagtcctgaatatccttgttaattagctggtgtttttttttgttaaattaacaaaatagatacattcctagctagactaataaagaagagaagaatcaaatagacacaacaaaaaatgataaagaggatatcagcactgaccccacagaaatacaaactaccatcagatgatactattaacacctctatacaaataaactagaacatctagaagaaatggataaattcctggacacatacacactcccaagactaaaccaggaagaagtcaaattcctgagtagaccaataacaagttctgaaattgaggtagtaattaatagcctaccaacaacaacaacaataacaacaaaaagcccaggaccagatggattcatagctgaattctaccagaaatacaaaggggagctgataccattccttctgaaatgattccaaacaattgaaaagaagggactcctccctaattcattttatgaagccaacatcatcctgataccaaaacctggaagagacacaacaaaaaaaaaaaagaaaacaggccaatatcccggatgaacatcaatgtgaaatcctcattaacgggcaaaccaaatccagtagcacatcaagaaacttatctaccatgatcaagtctgcttcatccctgggttgcaaagctggttcaacatacccaaatcaataaatgtaatccatcacacaaacagaaccaaagacaaaaaccacatgattatctcaatagatgcagaaaaaggcctttgataaaattcaacatctcttcatgttaaaaactctcaacaaaataggtatagatggaatatatctcaaaataataagaactatttatgacaaacccacagccaatatcatattgaatgggcaaaggctggaagcattccccttgaaaactggcacaagacaagaatactctctctcaccactcctattcaacatactattggaatttctggccagggcaatcaggcaagagaaagaaataagggcattcaaataggaagagaggaagtcaaattatctctgtttgcagatgacatgattttatctttagaaaaccccatcatctcagcccaaaaactccttaaactgataaggaacttcaacaatgtctcaggatataaaatcaatgtgcaaacatcacaagcattcctatacaccaatagagaagcagagagcaaaatcatgaatgaactcccattcacaattgctacaaaggaataaaatacctaggaatacagctaacaaggctgtgaaggacctattcaaggagaactacaaaccactgctcaaggaaataagagaggacagaaacaaatggaaaaacactccatcctcatggataggaagaatcaatatcatgaaaatggccatactgcccaaagtaatttatagattcaatgctgtttccatcaaactaccattggcattcttcacagaattagaaaaaactattttaaatttcatatggaatcaaagaagatactgtatagacaagacaatcctaagcaaaaagaacaaagctagaggcatcacactacctgacttcaaactatactacaaggctacagtaaccaaaacagcatggtactggtaccaagacaggcatatagaccaatggatcagaacagagaccccagaaataacaccacacatttacaaccatctgatcttcgataaaccccacaaaaacaagcatgggggaaggtaaatggtgctgagaaaactagctagccatatgcagaaaactgaaactggtccccttccttacaccttatagaaaaattaactgaagatggattaaagacttaaatgtaaaacccagaaccataaaaaccctagaagaaaatctggacaataccattcaggacataagcatgggcgaagacttcatgacaagccaaaaggttcataacaaacctgcacagtctgcacatacacaaagtcatataatatcaacattctgctctgtattagtctgtttcatgttgctgtaaaggaatacctgagactggggaattgataaataaaagagatttatttggcttccaaaaaaacccactaaaataagtaaagtttaaaaaatgtagttgggaaagtcatttaaaaaagccaaaagcaattgcaacaaaagccaaaatagacaaatgggatctaattaaactaaagagcttctgcacagcaaaagaaactatcatcaaagtgaacaggcaacctacagaatgagagaaaatttttagaatctacccatctgacaaaggcctaatatccagaatttaaaaggaatttaaacatatttacaagaaaaaaaacaaccccatcaaaaagtgggcaaaggatatgaacagacacttctcaaaagaagacgtttcacagccaactaacatatgaaaaaaagctgaacatcactgctcaccaaagaaatgaaaataaaaaccacaatgagttaccatctcatgccagtcggaatggtgattattaaaaagtcaggaaacaatagatgttggcgaggctctggagaaataggaacacttttacactgttgatgggagtgtaaattagttcaaccattgtggaaaacagtgtggcaattcctcaaggatttagaaccatttgacccagcaatcccattactggatatgtactcaaaggactataaatcattctactataaagacacatgctgcatatgtttactacagcactatttacaatagcaaaaacatggaaccaacccaaatgcccagcaatgatagactggataaagaaaatatggtacgtatacactatggaatactatgcagccataaaaaagaatgagatcatgtcctttgcagggacatggatgaagctggaagccatcatcctcagcaaactaaaacaggaatagaaaaccaaacaccacatgtactcactcataagtgggagttgaacagtgagaacacatgggcacagggaggggaacatcacacaccagggcctgttgaggggtggggcctgaggggtgggaacttggaggatgggtcaataggtgcagcaaaccaccatggcacacatatacctatgtaacaaacctgcacgttgtgcacacacacaagtcacataatatcaacattctcgtctgtattagtctgttgtttcatgttgctataaaggaatacctgagactgggtaattgataaataaaagagttttatttggcttctcccccaaaaaaacccactaaaataagtaaagttttaaaaaggtagttgggaaagtcatttaagttacactttcctgttaataaactataatattataatagttatgataaacaccataggactcttgtctgttggttagaaaattttttcttttgttttcccttttttgttctctttttttttttttttttttttttttgagacggagtcttgctctgtcgcccaggctggagtgcagtggcgcgatctccgctcactgcaagctcccgggttcacgccattctcctgcctcagcctcccgagtagctgggactacagcccggctaactttttgtacttttagtagagacggggtttcaccgtgttagccaggatggtctcaatctcctgacctcgtgatccacccgcctcggcctcccaaagtgctgggattacaggtgtgagccaccacgcccggtcttttgttctcttctttatcacccctttgccatcccaaaagtatgcattgacatggtttggctctgtgtccccacccaaatctcatcttgaattgtaatccctatatgtggagggagggatatgctgggaagtgatcgaatcatgggggtggtttctgccatgctgttctcatgaccgtgagtgagttctcacaagatctgatggcttaaaagtgtttggcagatcccccgatcagcgctctcctgctgtcatgtaatacatgccttgcttcccttttgccttctgccatgattgtaggtttcctgaggcttccccagccatgtagaactgtgagtctgttcgatctcttttctttacaaattacccagtctcagagagttctttatagcagtgtgaaagtggactaatacatccattaaacatcagaataaaaagcattaacttgctatactgcctaatgtttgctactttcaaatttccaagtcttaccagcgttactcagtaattttaaattttttgaattatcacagtaaggcagaacttgaaggtgatttgcaggcaaaactgtggctaatactaataacaaggtagagagttgctgaatcttttaattagcaatgattttaatattcttcttctctaggaggtttgcctcagatgacaagttgaaactcatgtgttctaaaagaaacctcagtagttcccccaggagatttttatggcttctaagtcaagtgtgattttgtgccctgcagctgtcactagtggcatggtagagtggatacagcaaaaattgatttttgtttttgtaatatttaaagaatagcttttatttatggcaatggtctcaatgtcaaaacatacagttaatagtgtcctcaagtttgtcgttatatgatttcactgtgggcaccacttaacagcaaagaacaataatttatttttcagtcctaatgttaactgaatgttcatttaacaaatatttaggtttacaaatgtcatttgactctggagctgttggtatcactatgtgctcaagttagttgattctctgggaacaagaacacatcattctttcttttttctttttcttttcttttttttttctttctttcttttttcttttttttttttgagacagcgtctcactctgtgactcaggctggagtgcaatggcacaatcttggctcactgcaatctctgcctcccggtttcaagcgattattgtgcctcagcctcccgagtagctgggattacaggtgtgtgccatcatacccagctaatttttgtatttttagcggagacggggtttcaccatgttggccagacgggtcatctcgaactcgtgccctcaaatgatctgcctgccttggcctcccaaactgccaggattacaggcgtgagccatcatgcccagctggaacatgacattcttattcttacctctgttgaatcattcgtttagcaaacattccatctaccacctgtcctgtgctaaataaaagggattcagagacaggcacagagtcctacctccaaaggaccttttggattagctgggttatgcaggagcatccagagttctatggggacacagagaaacagtgaattactagaaagagtggtgggagagagtggtcagaaatgatattgaaaaagagatggacaaagaaggctgtgaatgcaatggccaacagctatgaatacgtataaagtgcatcctgagaattacagctgatggtgggaggaggtgagacccatgaggactaagctgggctttgctctgaaagctctggggtaacagaaggatttctcaaaggagaatgatgtgatcagctatgcatgtagatatcaatgtggagaaagaattggaggtggctgatctggaggaatggtgctgaggctcttggttgcaatattccagatgagaaattctggagtcccaactaagaagaaagaaataagaaggacatatttagtaggtcaggcacagtggctcatgcctgtaatcccagcactatgggaggctgaggtgggaggattgcttgagcctaggagtttgagaccagactgggaaacatagtgagagcccatctcattttttttaaaagaaaaagtaaaaggacatatttaaattctattaggaaagaatttgaggggcgaggtaattgtggatatgggaggaggaagaggccgtgaaccctcaggttgggctgtggggaggtgccattcactggtgatgcatttgcatgggggcagggttttagtgcctttctcccctccatgatttcctaatacagaagtgtatgcagaaggaaaaactcaagtaagacataaagccctactttaggaataatcaagtaagcatcctatacccccatgcaaacccagagcgtagggtgtaagctgagaatccaagtagggctttctcctttccccctcaatttgaaatggctgaatttgggcagtacacgctgggtcttctacttcaagagaccagaaggagggggctggctggttgcccttagggccaggccatgcccaagcatatctggaagagcaagacctgggagaagttacctcccagttagaaagtgggtagagtcccattctgtctccagtgaatccaatgaacagtaatcccacccattcttaaaatgtagcccaatgaatgctgcaagagctggccaatacgattttcaacttttcccttggggaagtaacagtgaagaggtggaacagtggggcaggagcatggtctcttttatggtcagaggagggataggaatgatgacagttgcatattcacccccaatgctggacacagtgactttggaaactctcaaacaactgggaggaaacatgagcagggattcttgctgtggagagaaaaaactatttgagaaccatcagaatgttggttggaatgagaggggggatcctgtctggctttgctcattattgtgcccctggccccttggcacattgccaggtacatattaaatgctcaattaatatttgttaaatccatcagtgaaatttcctgtgctactcttgtctactaaaagatacctaactcttaattttaccattcaggaacaaaggtatattcgtgaacttttcaatgaggaaagtataagttgccattttaaagacataggggagaaaatgggtttgatgttttaatggagcaattgggcttcactgagctcggtatcacaagagatgaggggttgagaaaatacctggatttgtctctttaccatttagcacagcccagagatgggttcaaggattattgactttcccgcaggcactcgggctgaacttgcctcatgggaatgcttggagctatggatgatgtaggtttgtctgggtcttctggagctgcccagatccacaaggaacaacctcccagaaccaggccagagagtgtaataagcattgatttctatgctctgctgtccatgctgctaaggactgggagtcctgcactgaacaatggtgtaactgcctaacaagttcaccttgcctgctgcctagacagagacaatttattaagacaggggaattgcaatagagaaagagtaatccatgcagagctggatgtgtgagagaccagagttttattgttactcaaatcaatctctgtgagcattctgggattagcattttaaggacagtttgatgggtagggggctgccagtgagtcacgagtgctggttggttgggtggaagatgaaatcatagagaattgaaactgtcttgaaatgaggcagttcttgggtggggtccataggatcagatgagccagtttatccatctgagtggtgccagctgatccattatgtgcagggtatgcaaaatatctcaggcactgatcttaggctttacagtagtgatgttatccccaggagcaattgaggggaggggggacagtcagaatcttgtagcctccggcttcatgactcctaaaccataatttctaaccttttggctaatttgttagtcctataaaggcagtctggaccccaggcaagaagcgggtttgttttgggaaagggctgttatcatctttgttctaaattataaactataaattaagttcctccccaaagttagttcagccgatgtccaggaatgaacaaagacagcttaaagatgagaaacaagatggagctagttaggtcagatctctttcactgtctcagttataattttgcagtggcagtttaaatggaactgtacactctcaacctcacagaatttcaagtctagtgaggacttagggtaatggagaccaaataggtgagacagaaaatgtgttttatcaaaggagtaggattgattgctactacatcattctttcattccaactttctcacagattttgccttaatgatctgagaggtcaagaggctctattcagaaccctagaccacgtttggctttgacataggcaatcagccttggggactcagttcccttttaactcataattaattataggcatttacaaattcagggaccaaagtgggtaatcagacctaattaactggtaatcaaccaatgtttcactttctatccttctccatgtacaatgggacaagttcataaagatagttttgattctaggaagactagaagccctttggaggctgggagaaccattctaacatcatgtatgaggaaattgatgtgtggcttctagttttttaatcatgtttggggaacacatggccatctttttcactgctccaaactttcccctacttggtggttaccatgtcttctacaccagacactgtcctaaaatgtgcaagccccattcctcaggtggttgcacattggatgaaacttcatgcttgctatctctgttgtttaggctttagtgtactttcatttagttccattacatgttgtctatgattgcttaaaatattccttcaggctaagctcaatttctaccagctactcactgataggtaaagttcaatgagttcatttgtggtggtggaaggggaaaagacaagagctggtgacacacaacttcaaaaccaattatcacaacgttgctacattggcccctgaggatggagaagaccctggaagagtgattatattgtagcatcagtctaaaaagttagtgtccagtggtttttctgagagagtgatcatcattttcctcttattcaccactgagtcaatgtaggttttctagcatctctatgatgcacggatcttcctaatttcccccaaagcaatgtaacacagaagtaacttctgtgcatggattgacctttgatctccagtggctctccaggcttcacctgtttttccaatgttatggaactcaatgaaatgggggagtctgatgaaattaaggattatatttatggcttgcagtattggtgctgtacatccaaggtactgctgtccaagtttgaggtactcccttaatgtgacaacataaattagcgtgttatcaacccaacaacactctttctttctgtgatcagcccttttctcctttcatcaccttgatacaagtcatcaagatcttggaagctgtaaagaagtgtactttgtaagagctgaaatattattgcaatgatgccaccaagaatgattatgacatggttcatgtgccactgttagatcgacttcagggatggtttccaaagacatggctttgcctcctacatagttcagattgaataaagctctcttctaatacaaattacccaatctgtagagtctctgcagtgaatattagaacctacttgtttttcttccttacatagggagcttttaaaccatttcctcttatgaccatgcctttgagctaaaagccataggtttggatttaggaaaagcccacaaaattttaatattagcacaagtaagatagacttgggaaaatgtatgtttttgctgctcaaaacattattttgctctctcaaaacattatttcaatccaagccattcatttatgtatcaagcatactggtaagtcttgatgctattttgtgatgtttatattagatatagtatccctggccactgtacaacagataaacttttaaatgttaaggcacaatagaattttattggtcaggtacataatgtgttctgattagtgggcggtgcccctccaagcaatgatttggagatccagctttctttcatcttgtggcttttttgatacaacacttccaccattacctcagaaggggaaagaacatgagggattgcatgtgtttaagggtcagtcttggaagtggcacatatcacttttgactcagctagaaatcaatcatatgcaaagaagccaagaccaaagcccagtggtgtgcccagggggacaaggatactgctgtggtcaacagctagcccacctctgctgcaattatcttctgtattcctctatatcctcttcctttctttgcaatttgtctttttaaattctataatgtaaagcttggcagtgaacctcaagtgttgaacatttaagaaagaatctaaaaatacatgagcccatcatattttatgcattttaaattatgtgaattttaaaagtgtgatttaaatgttagtaaatattagcagaatctcatttgatgtgtgaaatttaagaaaagtaaaatataccaaacttaaaaataatctaaattgtgtaatctcaaagctggctggcaaagcaaatagtaaggtgtttatgctcttgacacttggagcctttgcctcagcggacagcagaaatacccaacgtccttggttagtacaacatgaattataaaaatttttatgcattagactctctggttgtaggttttaatgacctgttgtgctatcctcttaaccttcatggttattctactttaaatcatgaagtagtagccaatgttaaaaatgtacctgaaaatcaatgccattgaaatggaaaggtaataataataataaagaaatgcaggaggatgaaaagaaagaaagaacaacaacaaaaaaagatcagctaatacttaggagcaccaggcattgttctaagcatttggatggtactgacttctgagtttggtaggaaggtactgtaatcactcactcccagtttataaattcagaaatgtgatactctgggtggaaggccacacatctctgtattatacgatgtcatgctgttcatttaggaatgaacactccgcgaactattagagatattgctgagacaattaaaaggaaaatgccagcaattttttcactctgccccattctagaattaatcctattggataattaagaagcatgtgttctgacaacataattgttcaggcacacatccctggcatacaagcagctgcctcaaactttatacacaaacaaggatcgcttctcggccttttggctgagatcaagtgtagtacacacaaacagggagacacacccttgtcatttcctcatattttgaatcaaggccctaattttgtttctggtttctcttcctttcatgctgtcctgtaaacagcctgttgcattctcgcttatggagtggggttttattttattttttctttttggaacccctgatggatttagaaattcaataataagaatggacattgaggaagagaaaaacagggatgggctggagagagggatatgattgactgattcattaatgattatcttcattcatcatcaaactgttatcaagaatattgtgtaccaagcattattgtacactcagggaatcatttccccatttcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattactttgggcagtatggccattttcacgatattgattcttcctacccatgagcacagaatgttcttccatttgtttgtatcctcttttatttccttgagcagtggtttgtagttctccttgaagaggtccttcacatcccttgtaagctagattcctaggtatttcattctctttgaagcaattgtgaatgggagttcactcatgatttggctctctgtctgttcttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccatttatttccttctcctgcctaattgccctggccagaacttccaacactatgttgaataggagtggtgagggagggcatccctgtcttgtgccagttttgaaagggaatgcttccagtttttgcccattcagtaagatattggctgtgggtttgtcatagatagctcttattattttgagatatgtcccatcaatacctaatttatcaaagtccattagggaaggaagatgagtatttaaaaaaggaaatgaacaaagtagacaataaagatgtgtctcactttccctgtgaaaacacttcatatacagtttatccagacaagaagaggtgaaaggactggcgaaagaggtgaaaggaccatcaggtgttctgtgttgctggtgtgtgggctatgctggagacagtcctgcccttagccttgagagacaggtacccccatcctaggtcctgtacttcagagggtgtcactgtggcaagaggcctgtggagccaaagagacctgataacttagagtcccttatgacccaggggcttggcgccctagaatgccctgcaggatgacctggggcccactgcctaggtctgtgcagacctcctctactggcagttctcttgaggatggaaatgcatggtagatgtgagcatctccaggctcgaattgggccaaggggtggctgttcacagggaggtgcagttcagctctaacatcagccaggggtgtccccaggctgtccacaagactgttcatggagggaaaccagaggtggaagaaaaaggtgcagtctggggcccagggcctgctcttgtttggctgctatttcccatgtgggactctgaggggtccaagaagtctaaagtcatccctgatctctaagttctttaagaagttatatttgttaagatagaaagctttaacattttttaacaatgtataagcttgctttataagttttgatcatcatacatggctatttgggcctccatttctattcttgcctataccccatgaatggaaagggtgagcttcatggagaagatgaagctgatgaggttggttgggtcaaatgatgaagatcttggtgcatgatgccaagtagctatggggagttaacagacatgtttaaggataaggtgtgtgtgatcagatgcatttttataaagacagcctcaggcagtgagtccattaaaagctgctgcccttagctcacagatgaccaggaagtggcacctaaccctgtggaagagacagtgagagtggaagggagatgaggagattcagatttgagagacatttatgagtagtatcaatggggtttcttgattgattaataggttggctaacatgcagaatgatggaatgagaaatgggaagtcagaacagcaggacccataggaggaacggagatgggcatattttgttgtctgggaaactaaggatggcaatactattgattgacattagaagggaggtttttggggagagacaatgcattcagtttcaggtaccctaagttggaggtgtctcttaagacacccaggtgccagtgtgcacccggcactgagaaatgaggtcagggctgtgcctggacctttgtcactcctccgtccccaagtcacacacgtctgttgtagcatgtgagagtggattaaaatctcatacaaaattaatggccaacgttaattatccctttgtctaaattgactaaatagttgagttaattcaagatatgaaacttcacttatgatggactataccttttaggtcatactagtatttcacataacatgaggcttctgggtaattaaattcattgtccggagtattgcattaaaatgggacaaatctggattttcttcctttgatgtaactgatttgtactgcaagacatttccatcacagactttttttcccactggtcagtgccttttttctattttatacattcttaatttaagccattttatgtgtagctgtgttaacttctataacttctataaccataaaacataattatcccataaacgtatcagataatgttatgaaagttacattgaattaaaatgactttcacagagtcacataaagaactctaataatttcttttaaaattatagggcaggtcatgttcagaaaaataatcaaacattaagtagaggaattacattggatcagtgcccagattcttaagagataccattgaagatgatcacctggtttcctctgaacttgaatgtttccttgttatagtggcccctgacagtaaaccaaaggatgagtctgatccctcaagattcttccccaaaggacactggtaacagtgtagtttataacttaattccttttaaagtaatttagtcaatgttaaataaatgaactttggagagctattggaaatatatatatatatatatatttacaatttttcatctatgatgaagataatgatatccctatgcctaattcattattgctttattcacccatttatctcatatatttattcataatattctcctatgtcaagctgtgctttcaggtgacagttgtatataccataaggagcatatttggctatagatattatctaaggctataatctcaataaaataatataaatattaatgaaatctaaaattaataaattctattatttttaaatgtatagataaaattactagaaaaaatacattggaattactactatgtgtactgagtgttattgactgtgggtactttttttttttttttttttgcgacagagtcttgctctgtcacccaggctggaatgcagtggtgtgatctcggctcactgcaacctctgcctcctgggttcaaacaattcttgtgcctcagcctcctgagtagctgagattacaggagtgcaccaccacacccggctaatttttgtatattttaatagtgatggggttttgtcatgttggccaggctggtcttgaacagtcctggcctcaagtgctccacctgtctcagcctcccaaagtgctgggattacaggcatgagccacagggcccggctgactgtgggtactttttctttctttaagcatagcctgtgttttccaaaatttctctcatgagcatatcattcttattgtcaggtcagcctgaaataatcaaaaggattagaatgtagttttaagagattatttcagtgaaaagctgggaatagccatctgggaaacatgaactccagagaaatgaggtcagtgctctgaagttaaagttaaaatcttgcttatataggatagaaaacaaagaaacttagtaggattacagcgttttctatacaagcctggtttatgtgttacaacaatttaattagttaccattggttttcttttctatacagcttttcttttcctttccagtttaaaagagtatatttaacattccatcttagacaatgcaaaagtcatgaagtgtttgtgtgttagagttaagagggaagttaatctgtaatgaagatcagcagttaagagggaaggggtcttgcctggaacccgttagtcattcacaacattttacaagacagtgtaagaaagggaaaaggctaatccataatcaaagaaacaaaggttagagctgcttaggttacaggtctctgcttatgtgacttaggacccataatcacattcccttacagctgaattattttaaaggtccaacagcttagagtttgaattacttattttcatattacatttagaaaaagccaatctgtcattaaaaaaaaataaagatgcatgaaggttgaggaagagtggtggtaaggtcacaaggagtcatatgtaggctcatgtgttcacactcacatattcactataaggaaagaataaagccaagaaagaaaaagaaaaactcaatttcttgtcatccttgtaggggtggaaaggaagtcaagtcacggaaaatgctttctgtttacctctttaagaagtcactgactaccagtcttaactacggaaattttttctttttttctttttcttttttgagatagagtctcactctgtcacccaggctggagtgcagtggtgtgatctcggctcactgtaaccaccgcctccgggttcaagtgattctcctgactcagccacctgagtagctgggattatgggtgtgcaccaccatgtttggctaatttttgtatttttagtagagacaagtttcaccatgttggtcaggctggtcttgaactcctgacctcgtgattccccccccttcggcctcccaaagtgttgggattacaggtgtgagccaccatgctcggcaaactgcagatatttttgtggcaggtagacgcaccagttgctggataaaaaccgtttttatttcataatttgaacagttaccattaccatttctttttagtatcattaaagatttaagcacatagaaaaacatagagaaaaatgtaatagacatatgcccatgatccagctttgtcaaaattttgcatttttgctaaatttgcttcagatattgcattgttgtcaagttaaacattacagctttatggtggataaggggaaagacatcaggtagcccctgattggaggccattgttgtggggaatctggaggcagggtaactagaagtgggacatcttatgtgcttggttaggggtacatatttggctttctctggtgataagttgtaagcagggacaaaaattaaagaagctgttagtaatcaagtcctggctatttggggccaattgctatagaggtcattgtttagctttgtggattgtcactagagatagcaatgtgtcttcctgcaagtctgacataaagtaggctggcttctggattgttcattggcaataaagggattggtttcctgggcaggttgctgcaggtcatgagtcaatgtaacatttttatatatggtctggccacagtctgtagattcagtctcccctatatgtgaggctcaaattcattcatttagctgttgaatggtatttcattatatgactatacaactatttatttattcattctccagttgataagcttggatctcagctttttaacattctgaacaatgctgccattaatattcatgtctacttgtagaagacattttcattcaatgtttttataagataactttcctgctatgtggctgctttctggttttggaccagaaagatatgatgagtatctataactcttgtcttttcccttggtcagagctgatgtactgtaactataatagtggatcgctagaattagtaaacagtacccaggactcctagagcttacagaggcaggtcagaaaatcacatttgcctggtttttaaattcttatgacaaaatgtcattatttctcttccttttacaaaaatccaagctcctccttttctttcttcatcgtctccctttgtctggagttagtcaggatggcaacttcaccactccagcagaatagaaacctctttaagctagctattataaatagcctccagagttgcttattcagacattatcacataaagctcactcagtgtgaatgttttcggtcaaggccaggtgactaatagatacttaactggaagttaaattgaccacaaattctacgatgaacccttggtattgagtaattgtcagcactgttattttacgtttaccctgtcctttaaatgctctactgtgtattgaatattaatattgtaatacatccttttatacatgcatgctttctaggattttcaatagctttttctttcactccagatattcacttaatgtacattgatgtgaatagtaactatttatttcaaagaaatggtaaaacacacacacaataacatttcagtcaacaatgaactgggtatatgacagtgttcccatgagattataacgctgtatttttaccgtatcttttctatgtttagatacacaaatattcaccattgtgttacaattgcctacaatatttagtacggtaataggcagtacaggtttgtagtctaggagcaataggccatgcaatatagcctaggtgtgtagtaggctacaccatctagaattgtgtaaatgcaccctatgatgttcataggacaaagtcacttaatgatgcatttctcacactgtagccccggcattaaggaacacataataggaaaaatatgaagttgtgatcctcacttacgtaaccaagtttttgttttgtttttattgtacatatttaaggtagacaacatgatgttttgatatacttgtacatagtgaaatggtgagtacagttgcacaagttaacacatccattgtctctcatagttatacttttttgtgtgtgttaaggcacctaaaatctactctcttagcaaatttccagtatgcatgacaatattattaactacaggcttcatactgtacatgacagatctttagacttatttatcctatataactgaaactttgtactctttgacccacatatcccatttcctgtttagtcaccttttgtttgttttgttttgctttgcttttagattttgtatataagtgagatcacttctccctgtgtctgacttatttcatttaggctgataacctccacttgtacgttgttgcaaatggcatgttgcaacatacatgttgctgttgcaaaaggcaagatcttctttcttaaagttgcaaatagcaagatcttctttcttaaggttaaataattttccatcctatagatataccagattttcttttttgggagggtggggggaatggagtttcactcttgttgcccaggctggagtgcagtggtgccatctcagctcaccgcaacctccgcctcccaggttcaagtgattctcatgcctcagcctcccgagtagctgggattacaggtgcccaccaccatgcctggctaatttttgtatttttagtagagactgggtttcgccatgttaggtaggctggtctcgaactcctgacctcaggtgagccaccaacctcagcctcccaaagggctgggattacaggcgtgagccaccacacctggacaccggattttcttaaccacttatttatagacagccacttaggttgtttccatatcttggccgttgttgagtaatgttgcaatgaacatgggagtgcagatatctttatgaggtgctgatttcatttcctttgggtatatactccagaaaagggattattgggtcatgtagtagttctgtttttaactttttgaggaacctctaaactgttttccataatagctacactaatttattcttactcctaccaacaatgtacaaggtttcccttttctccacacccttgccaacatttgttatctcttgtttttttgataatagccatactaataagtgtggggtgatatctcattgtggttttgatttgcatttctctgataattagtgatgttgagcactttttcacatctctgttggccatttttatgtcttctttgggaaaatatctatccaggtcctttgcatgttttaagattgtgagttccttatgtattttggacattaaccccttatatagatatatggttctaaaatattttctatccatctgtaggcaacgttttgaatttgttgattgtcccctttgctgtgcagaagttttttagtttgaagtagtcaacttgtttgcttttgcttttgttgccatatccaaaacaataattactgaggccaacgttaaggagcttttcccctgtgttttcttctgagagttctgtggcttcagattgtacaatagttctttgattcattttgagttgctttttgtgtagagtgtaagatgagatccaatgtcattctttcgtatatagatatttagttttcccagcaccatttattgaagagaactgtctcttccccttttgtcttcttgatgctcttgtcaaaaatttgttgactatatatgcacgggtttatttctaggctctgtattctgttccattggtctatgtgtctgtttttatgccagtaccacattgtttcaatcgctatagctttatgataattttaaatcaagaagtgcaataccccaaactttgttttcgtttttcaagatcgctgtttggggtttttgtagttctatatgaattaaaaaaaaaatttttttttctattttcatgaagaatgccattggcattttgacagtgattgcattgtgtctgtatattgctaagggtagtatatacattgtaataatattctttcaacaattcatgaatatgaaatatctttccatttatgtgtatcttcattttctttcattagtcatttaatagttttcagtgtatagatcttttatctcctcagttaaatttattcctaagtattttattgattttgatgctattacaaatgggatagttttctgtatttctttttcaggtgggttgttactggtgtaaaaaaatacaactaatttttgtatgttgattttgcatggtgcaactttattaagttaattttatttatttagagacagagtctagttctgtcacccaggctggaggtgcagtggtgcgatctcagctcactgcaacctctgcctcccagtctctagtaattctcctgcctcagtctcccaagtagctgggactacatgcatgagcgaacacacctggctgatttttgtatttttagtagagacggggtttcaccatgttggccaggctggtctggaactctttacctcatgtgagctgcctgcatggtcctcccaaagtatattatgtttattagacctaacaattatttttttgtatggagtctttagggttttccacatataggattatgtcatatgcaaataaaaatagttttactttttccttcccaatttggatgcctttaattactcgttattatctgattgctcttgccagtacttctactattatgttgaatacaagtattaagaatgggtatccatgccttgtactggattttagaggaaaagattacagttttcccccattaattattatgttagctggaggcctttcataaatggactttgttatgttgaagttcttttctatacctaaattgttttgagtttttaatcaagaaagaatgtggaattttgtcaaatgctttttctccatctgtttagatcagggttttccaatcttttggcttccctgggccacactggaagaaggagaattgccttgggccacacataaaatacattaagactaaggatagctgatgagctttaaaaaaattgcaaaaaaatctcatactgttttaagaaagtttacaactttgcgttgggccacatttaaagctatcctggcctgcatgtggcccatgggacacaggttggacaaccttgatttagatgattatgctttttatttctcatcctgttaatgtcatatattacattgatttatttgtctatttaaaccaaccttgcatcctagggatgaatgctgctgactcatggtgtataatattttcaatgtgtagttgatttcaatttgctggtatctaattgaggatttttgcatcaatatttataagagatattgacttatagttttctttttgttttaggtgtttttatctagttttgttatcagacaatgctggcctcataaaataagtgtggaagtattccatcttttgttttttgaagtgatttagatggattggtattaatttttctttgagtgtttggtagaattcatccatgaagctctctggtcatggttttgtggctgtttttgttgggaggtttttaattactttaatcctttctgtgctattgatttgttcgggctttttgtttcttcctgattcaatcctagtaggttgtgtgttcctaagaatttatctatttcctctaagttatccattttcttgacaggtgattgtttataatagttccttaggattcttcttatttttaaagcatccattgtaatgtctctccccttcatttgtgattttatttatttgaatctttcttttttcttaggctaaggttttgtcgattttatttatttattaaaaaaaaacttttgttggtttttttctgcattttttatactctaatgaagtattgaagtctcctgctattattgtattgctgtctatttctcccttcagttctgataatatttaggtgctctggggttggattcatgtatgtttacaattgttaaatactttcttaatgaattgacccctttatcatttaatagtgaacttctttgtttcttgtgacaatttttgacttaaaatatattttgtctattataaatatagccaccagtattctctttgcatggaatattttttgttaggaattttttttaataccttcactttcaacttgtgtgtccttaaagctaaagtgtgtctcttatagtcagcatatagttggatcatgtttatatatctactcagtcactctgtgtcttttgactggagaatctaatccatttctactcaaggtaattgctgataagtaaagacttagtgctgctattttgttaattgttttctgtggggttttttttgtttgtttgtttttagatcctttgttctttatttcctttcttgctgtcttcctttgtgactggatgattttctatagtagaatgctttgatttctttgtttttatcttttgtgcatttagtatatgttttgctttgtagttaccatgaggttacatagctagtcttatagttataactgtctatttcaagttgataatgtcttaattttgataacatataaaaactctacacttttattctaccctcacattttaattttacaatgtcacaattttcatttttaaatcttgtatattcctttataaatgaatgtagctgtagttactttttgtctgtgaccacttttaaaacccagtttcttaactcacagaccttttcccctatgtgaatcccactgcctccatcatttcttgcctgaactattgttttgaaaaaaaaccaacgcttttgaacaattttgctatctctgggcttacttcctttcaagctactcttccaactgctaccagaatgatatttctaacatgaaaatctaattactttccttcttaaaatccactggggcttcttatcatctttaaaatagagtaacaactggctagtgtgatgtgaaaggccctttgtgacttgaatgccacctctccaagttcctcttctgtcactctccagcataatcatgtgccaagcagccctatcctccagctacacccagaagttcccagatgcgccatagggccccagaccctttgcttggagtattccttcttcctttatttatctgactaactcatcctttaggagtcaactgctctgtgaagctgttccagagcctgttccctcacctgcagaatcaggtacccccttacccctgtgcctcagcatccacacatttctgttatgggacttgacatagagttttataattaggaacatgcttgagtcccccattagactttgggcactttatggagaaggactgtcttgaagtgttcatctattttatttttcatcactttgaatttcaattaaaaccttgtaaatatgcacatgtatacatgcacacatacatacctacaaatacctcacttttaactcccctctgccacttgttttctgaacatggacatgttatttaaccataagaccttagcttcctcatgaaaaggttgggctttggtagattttaggagcttagaggagtcattaaaaattgtaaccaaggattcatcaagagtaaggtcattttttctatccttagcactcagaaatatatgtagtaatttgttgaataaattaaaggaagtaaggaaggaaaaggggctggagtaaaagagttgaggagaaaagagtaaaggagaaagaaaaaaaggaacatgaagccatatggggtgagtgggatacataaacaacatcagaattctgttggaaataaagaaaaaggaggagaccaatgctgggcagacaagtaaagtattcacactaaaaataaatcagacataaaagttgccctcaaaaaacttcctctctggtaaaagagattaaaacaagtatctacataaaattacaaggcaagtagtgagaattgtctggggcaattggtcttctgtaaaagtccatggaattaacaaataattgagcaacagaggtacagggggaagttcttatgggacttcagaggagaagaaaattccatctagctgaaagagtctaggaagggataaataaaacttgacttaggcggtaaggacagggaggatttggttaatatggataagggggagagtttggggtgatgggaggaggggaggagaacattccaggcagcatgaggaaaggagagtgaatgggacttgagattaaaccagtttggccaaatcattctgttttggtggctcacagtcatgcctctatgacaacaaattctgacagtttagacatgcattattttattgtcttgacttttccggctattgtggtaaccacaaataccatttctacctctcccaaaattttaaagtctattcagaagtagccaaaaaaaaaaaaaaattagttacaatagtgacatgtaactatcctaactccgactttggtacatgctgcaaagatggagacttaggaagtgagctcctgtaatcattaagcataggccatggcagagttttcatagccttgcttcctaatgaaggattgaaaattatttagccagagtaaagcaaaggctaaaagaggagctaaactcagcaggctcagggaacccagagagcacacaggaatgataccacacctgaccacagagaattacactttctgcttgtgctactcagaagtctgaactcctctagtgaaagtgttttccaatcatcaaagcttaacctttaccgatcatgacagctatctttgtgtcctgctcacaggtcttctgtagaggaggctgaatatgacaatgagaaatggaaatcatgttttctgttttatggacattttaaaaaatgttaaagttttaataacatatttttcttctgagcaacattttaaaatttaaaatctatctttgagtcttttttgcattataaggaattccacaagatagtaaaaatgcgagtttaatacattttgtaaatattgtggaataaaacaatttcctcctctttatgaattagctcatatttccaaatgttcaccaatcacattgatcctctggggtgatttaaatatggagtgtgataaatacaaaaatcctcttgttagaaaatagcattagaatatatgagattctaagagatttatgtcatttgactttcaataattactggttacctgctatggctggtatgaggctaggtattgggtatataacggtacagaagcattcctgacaatatcatcagtgatccaggagcaggaaccaggtccttataattctacaggtacagatattggtaaacacagggttcttcaggagcttgccaaatccaggctctagggtcaagaagggatcctagaaaatagaccattaaggtagagtgctaaattggaaggaggggttggaggtgatgttctggataaaagttacagtctactcagaggctatgggatgaaaggaagcatgccactggaggagtattgctgggaattgtgaggagacaaacaaaacaaaaatccgccacaatgctcaaatttctaattcaatgtgttacatgcatattttatgagaaacagcctttcttgtctgatatttcttttctaaaccaattggtgaaacaaataatcgtaaaaatgttaacccactgcaattccttttggagcatattttttttttaggacagaaatttgtgaaaatgttgttaccttgtgtttagtgtttccttcattggtaagtcctctgtcaaacataattaattatggggctgggcatggtggctcacacctataatcccaggattttgagatgttcaagtgggaggatcagttgaggccaggagttcaggccagcttgggcaacaaagcgacaccctatctctacaaaacaaaaatgaaaaaattagccaggcacagtggcacacacctgtagtcccagctacttggaaggctgagttgggagaactgcttgagcctgggagtttgaggctgcagtgaactatgactacaccactgtattccagcctgagcaacagggcaagaccctgtttctggaaaggaaagaaaaataacaaaaaccaaaccataacttgttatttgagaaaagttaagattctcttcatttcaatttgttgatagcccagtgggagaaacatggaatttctgagttggaaaagcctaatggaattcatagacctttatttgccaaggagttctcaatgggaggaagtaagttgcccaaggttactcagcctcttggggctaatgctagagctagagctcaaggtttttaattcctatccagtaccattctccagatgcccagaatttagacataaggtttccaaaaaaggcttggtagggatcccctagttctgctgtgaagtgcccactgtgacattatcctttgtttccacttccctctgcccccatatggggttttaattaattaatggaaggtcagatggcaaatgatttgctttctgatgggattttgatatgcattgttgagagcaattacatatgcacattttggagacagcagcttcctgactgtactcatttacatggctaatcaccatgagcagcacttgtcaggcagctctatctgtaggggtaggacaggcacggggagaagccaacaaggacataacacaaaacactcacgttatactctttcaaactgaaacgctcaatggcacattttagatgaagccaagtgacttgttattactattaccaatgtccttttaattgaggcttcagatgaccatagaactcggtgaccttaaagagatgagctcacgtcaaaagggacaatttttgatatatttctttacagtgtgaaagggtcaatgaactggcatttgccaataaaaggcaaagctctttttgcatctctataattcttaataaaatttgagaccaaatgagaaaactttgtcttttctatttccgtttctctgattgtgaaataaattagtaagtgaaaagagaaataacttctattttattaaggtttttttgtagttttattgcaatagacatagctaaggcatcagtattagaggcttgtgttggtgacttttatttttaatctttggtgattcaacgtttgcatttagatttctgaaaaagactactgtgtgagtaatctggtattgtacagtacactgattatctgaaaacaaaaacctgccatttgtaagcatttcctttttctctagacatatcgtgcagaatctgccatgaacgcaggctctagaatcaaatattgttaggctcttaccttagtgcagccttataccacctgaaagatgctgggtaaattgacgtaaacttcttgagactcagaattttcttctgcacaatgggatgataatggaatccaagtcacagggtattaatgaggattaagtgaggtgaagtgagtgaagccttggcaagatacatagcccattctagcaactcagtaaatgctatgaaatataatatgactggtaatgtagagctttattcagcttttcagactgtacctgatatttcaaaccctcataattgcgctgactctgagttcatcactgagaaatggccaactttggttataagtatggaagttcttataagtactatttctctaacacttactaagctgtcagtgcatggtcataggtgatatttgtagtaaatgccatgtagaaatttcatttggtgaaaatagttcccttcatatatatatatcatatatatgatatatacatatacatatgcatatacatgtatatatacacatatacatatacatgtatatatacacatatacatatacatatatacacatatacatatacacatatgcacatacacatatacacatatgcatatacacatatacatatgcatatacacatatacacatatgcatatacacatatacacatatgcatatacacatatacacatatgcatatacacatatacacatatgcatatacacatatacacatatgcatatacacatatacacatatgcatatacacatatacacatatgcatatacacatatacacatatgcatatgcacatatgcatatgcacatatgcatatgcacatatgcatatgcacatatgcatatgcacatatgcatatgcacatatgcatatatacatatgcacatatgcatatatgcatatatacatatgcatatatgcatatatacatatacatatgtatatatacatatgtatatatacatatatacatatacatatatacatatatacatatacatatatacatatatacatgtgcatatatacatatatacatgtgcatatatacatatatacatgtgcatatatacatatgtatatatacatatatacatatacatgtgcatatatacatatgtacatatgtatatatacatatgtatatgtacatatatacatgtacatatatacatatgtatatatacatatatatgtacatgtatacatatgtgtatatatatacatatatatcatatatataatatgtatgtatatatacacacacatatatatatgtatgtatgtatgtatgtatgtatgtatgtaaaatctgagacagggtctccctctgtcacccaggctggagtccagtggcatgatcttgatgcattgcaacatcgacctcctgggctcaagccattgtcctgcctcagcaccccccaatagctgggactacagggatgtgccaccaggcccagttaatttatatatttttttgtagagtcagggttttgccacgttgccagggtggtctcaaactcctggcctcaagtgagcctcctgccttggccctccaaagtgctgggattacaggcatgaataaccataccaggccaaataggtcacttttaaagaatacgtggttttccccattgtattaccaattaaaatgaggggaaaaaagactcttttgacatctataaatagctgtctttcaaaaattctgttaatttggtttattgctatagacattcttaataatcatatgatttctggtcataataattgctgaatctttgaattctgttttaaaaaactttgtataatgaaaaatgtcaaacctatacagaagttgagagaagaatatgataagcccatatgtatacctcacccaacctcaacaattaacaatatatggccagtcttatttcatctaacttcccactcacttccctcttgtctcatcacagtgagttattttgaaaaaaagaaagccagacattacattattttattcctaaatacttagaaatatatcacgagaggataaggaccctttggtgttaataaaaccacagtaccaatatcacaccttaaaaattaaattccttaacatcatcaaatatccagtcagttctctaatttctgcaattatttcatgagcatagcattgctttatagtttaagtaccgcttttgtgtaaaagaaaatgaaagaaaaattaaaaagtaattttattgtgcatttgtgttcatgtggtgtataccatagtaatttctgtcatttgtctcctaggaagtaacatattgaaaaatatctttttagtagttgcattttacaaggcaactgctagatgcatcttgatcccaaagatgagaattttactgggagttagaaataccacagcctacatcagcattactgttttatatttccaccaaataagaagtgattttttttctctgttatctagacactgtcgatgaagactaatccagaataatttatacttccaattttatatttaggaaacccattgcaagagtttcctttgatttgcaatttgagctacatgcatactgtgttctgtcttggaaaaatactgatatctatggaaagtttcatgactttcttctgtaaaagctataagtggcctagaaatcaattaaatagaaagtctctcattagggtgatcattttatgatatgttttatctttgcaagccaggacactggaggacaaaacaaacatttaaccctgtcagtggggtcaggaaaaggccaagctttttcactttctgccatagctattccagaatgttcacgtgtaaatcatgctttcagagccaagctatgctttagatgtctacagaagcctgctatttaaggaaaactacagtgaatccttttgcaaagtgaggaatacattgttttgaaccatgaacaaatatgattaatttagttctcttatagtaaactttccgcatattagtctttttgaatggacctaacttgaatgtcattactgttaaaatattaacctctttttactctttttatttttatttatttattattattattattttttgagatggagtctcgctctgtcatcccaggctggagtgcagtgatgcgatcttggctcactgcaagctccgcctcccgggttcatgccgttctcctgcctcagcctccccagtaactgggactacaggcgcctgccaccacgcccggctaattttttgtatttttttttttttttaatagagacagggtttcaccatgttagccaggatggtctcgatctcctgaccttgtgatccacctgtctcggcctcccaaagtactgggattacaggtgtgagccactgcgcccggtctctttttattttaaagtaagattgaacgtgggtaaaaactctaagcttctgtggccttataactactccattctatagaactgcatttctctgagatttgcttgcttttcttctctgagccagtgttatgtttaaatggagccagtgagtcttcattcgccatttttcacagtgccttacagtttgtcacaccagtgggttgaatgattttccaggaaacatcatcacctctcatgtgggagaagggatgacaagggatgtgggagaaggcaaggtcatttctgctccagaccgtgtcacagaagaaatgagtgacgatttgtgcatggttctcttctattgattaggaatgtgcgcgcttcagtcccgttcctgtgtatgttcttgtcaggatgagatttctaactgctcagttgtctcactgtggtcacaaggagaacttcacaagtgagtggagaggacccagaaaacccctttctactcatggcacagcagcccacaagatgagatccctatgccactcccagatagcacgtccccggtgcgttctgtgcttttgccttgggcatgattattccatgtcactgatggcttcctggctgaaggttaaatgtctgtgtgagccaagaaggcacattcctgttcatgcctgtctttacttttccctccttgtcttccagttctggtcctgtttgcttcctggacattttgcactacttccaggaaaagtcctgtcattcaatgaaaatgtagtacaattaaacgtacttctactgagcacatttttggcaagaaaaataatgtcttggctgtaagtccgctgcctgaaacacactgatagttgctaaccatgcacattttttcatataaaatgtccacacagaagttcgcctgctgtctggacctgggttcttcctcccttgctgctgtaactgctgctacagccgccttgtgacctaccacacaggccagccacaggcaagcacaaagcacacccctagctgtggactcaaaactgacagagataagttgggcttctgtcagtaagagctcttaaaagcaaaggagataatttcattttgaccttttctccctacggttcaaatgaggtgaaattaattttaatagtcattaatcaaaggcattttgaccattaatgtaaaatcattgcttttaaaagcacccggatgcttgttaagaggaaactattgcccttccaaatagtcttcatttttaaaaatatcctttaacatcgtaagatcatagaattttgagacctgcttaaactttgctttccaacttgcctttaagcgattcctttctagaccaaagtgcagtaagaaatgtgtcatgtcttcccacctgttgatgggttgctttgttaagtggatgctactccatgtcccattctgagatgcttaccttttgctgatttcactgatatcactaatcataaagtctttacatgttttggggaatatcctaacacttatgaaatggacatcagggcagggggtaaaaatctttcatataataacttggcttgtgagataagttgattcgtaaggaaaccgacccatcctgttctactctctatctatttccaattgtaggggactaagcaaagctcaagttttcactaaagaatgacacgtttttccctcaggcttttggcttttgcttacaaaagcagagaaagctgttgttaatattttcatttagctgacaaaattgcagttatctcttttagcgaggttttgatatttgttaacaactgtgaatcatttcatagataattcaagccttggctttcatcctgtcagatttcagaacaaaattttagatttcctgaaataaatgtggaatgcatgctttgctcaaggtagaataaacctaacctctatgaagtcaattaaataaatgtgtaatggatcaccttaacctgggaggctgggatctctaaaagtgtctgatgattttaacgtgtatacgtgtgtttcttttggtggtaaatatataaagatacatcttttatctgattgtcaaaaggcatttggctatcacttgattttaccacttgcaacagagatgtcaggtgagctacttactctttgaatagctgattacatttcgcctgactcagtttccagcttgtgatgccccaaagtcctttgtaggagagctgggaagccccagggctttcttcctcacgggaccctcagcctcagtgctcctgggtgtgtgtgacagtttcagcctgcctcagcctggccacagaataccacctctttctcaaccagtgcctgtaagaacagccccattaataacattttctgactttagtaatctttattgacaatttaggggctatggagagagatcactcaagaaaggacctcctttgatgtctccttatctccacttcattttctcttggtctccctgcctcccttactaaagaaacaaattccctcccttatgcctcactagttctcccagaggtctcagcttccacccttggtgcttatcttgttgccaaattgaacttgggtccacttgccccgtgcacagaaaaagccacatggacaccaggatttgcagcaagagaaaatgagacatgatttcagggcacaaagcaaagaaaatgggctgctaatgcttaagacctgaacttctcaatggcttataagcaagggcttttaaaggcagggtacatttcaggaaaccagaagttataggcaaaatcataaatcattatatggtggttataaagtggttcggtccaaaaggctggatatcttgaagtaaggacttataggtcataggtagattcagagattctttgctaaaaacttggggtcagcagaaggaagttctcaggtttggcctacaggcatgactctcttcgggcccatcaggaagaaatgcaaaacaaagagtggtagtcagagttcagtccatagttcccccttttctgaggtctatatgatagcaattggcatttttcatcttctgggggtccagattgctataaaacaactcaagaagatatgttaagatgttatcttttagtttccatagggacccaaaacaccttgtgactctgacttgcttgggagactattattactatcttgtttgctttatcaaattgttcgtttacttttcaaggctaagtgcctggaatttcccttgaaagaactcaaaatttttcctttatttccatgcttccagggccctggcaggctcctaagtcaagtccctgctccatgtcaatctttgtagtttcctaaagaaacctggaatataaagtgatctctgtcttcttacatgccatgcaaagattttagctttggttcccaaaggacataggggtgtgttaggaaagatgcctagaaagccaggatgtctgggttctgagagtcttgaccctgaccctctaaatgaccttgtcttagtcacttcacctctgtaaacgtcagtttccccatttgtaaagtggagatgataacataagccttgccttcccgagagactgcttatttatttatttatttatttatttatttattttttaattgagacgaagtctcactctgtcacccagactggagtgcaatggcatgacctcggctcactgcaacctctgcctcccgggttcaagcaattcttctgcctcagcattcctagtagctgggattacaggtgtgcactaccacactggttaatttttgtatttttagtagagttggggtttcaccatgttggccaggatggtcttaaactcctgacttcaggtgatccacccatctcagcctcccaaagtgctgggattataggcatgaatcactgcgcccggctgctttgtttgtctcttatgttctttgatatcctggagggtagagcagctccagggtctggaccttcaaattctcatgggagaacaaagcagctctacccactaggaccttacacaggaacccatcactgaaggaacagaatactttaggtacatgactttagtgctttttaagatatatgtatgtatacatacatacataaatatttggagacaaggtctcactttgccacccaggctggagtgcagtggtataatcatagctcactgcagcctcaatctcctgggctcaagtgatcttttcacctcagccaacccaagtagctgtgactcaaggcagtgctaccacatctggctaattgtttcttaattttttgtaaagacaggatcttactatgttgctcaggctagtctcaaactcatggcctcaagcgatccccctgctttggcctctcagagctgtaaaatgtatattttaatacaaatattgtccatagtgttatgtgggtctggaatattccagctgtatcacctttcctgatgaagggtctgagtggacaggagagtgttttcaggcctgaatggtgatagggatgtgcttattgaacactcatgactcgtgacactggggtcagcagtagtttactactcacaactaccctgaagataagacatttttaatctctatttcagaaaggaggagactgaatttgtgagagaataaacaacttgctcaaggccacacagtcattatgtccaatttcaaagtacaattgactccaaaactcgtgtttctgtatattagcctgttctcacactgctataaagaactaccgagactgggtaatttatgaagcaaagaagtttaattgactcacagttccacaggctgtacaggaagcgtggctggggaggcctcaggaaacttacaatcatggcggaaggtgaagaggaagcaagcacgttttcacagggcaacaggagagagctagcaaaaggggaagtgccacacccatttaaaccaccaactgtcatgagaactcactcactatcatgaaaacaagggggaaatctgcccctatgatcccatcacctcccaccaggtccctcccccaacactgggaattaaaattcaatatgagatttggatggggacacagagccaaaccatattattccattataccaagttatagtacagggtgtcattcatgcagaagaacatctgaactttctacagccaccagttctcatgaatcctagaaggagatttaaacttggaggaacaatagattgtaagatctttagggactctgccacctatagcattccaagaggtcattaattctttttttagtcacaagttcaatggggtgctcaaaaaagaaattattccttgttttgcctcttccattcaaacaatggtctctggagtgtgatgtgcaagagagtcaatcaggttgtagagggaaaatattaggcaggaagaggaagttgccagtccctcaaggcctggcctatgaaccagcattttgcattctatgggtgagattgtcatagcatccatccaagctcaagaggaagacacagagcttaccctcgatggaagcaatatcacggaatttctgtccattttaaatcttcttcaagctgcattatttttgtaaaaatgatcccagcaaacctgtcctcatggaagcagaaaggaccatgtataggtgtcacattctgtgtcctcctccatcaccacttctacccatcatcttcagcattggcttgggcttggacaattgaccctctgagttctttatgccacttcacgttaatttttaaagaagatatatcccaaattgttggagataaagatgtagactacctcttgagtatagtagtttttttgtttgtttgttttgttttgctgtgaatcaatcaggaaacttaatggtagagtgagtgcagagctccatggagtttgttgtgtgtctcctaaaactagaaaagaaaggaaagattttgtcccctaaaatattctgaaatgtgcagtgatccctgacaggcaaggtgctgtacttctagtgcttaacatcctaacaacatctagcagattctttgtggacagtctcctgtctatcatgttcagtttggctcaagcgtagagtccattggaaggaaggatgagagatggtgccagagagaaaagagcagattgcgaagagcctttgggctgcatgacaaagtaccacaaacagagtgtctcaaacaacaacaaaaaatatattgtctcacatttctggaggctagaaattcaagattgagatgtcagcagggccggttccctctgaggactgtgagagagaatctgtgccatgcctctttcccagcttctggtggttgctggcaaatttttggtgttccttggcttgtacatgcatcaccctggactctgccttcatcttctcatggtgttctccctgtatgtggcagtctccatgttttctttcttttttacaagggcatcagtcatattgtattgaggcccaaccctaacaacttctgtaaagaccctctctccaaagaaggtcacattctgaggtcctgggggttaggatttcaacatataaattttgaagaggaaactattcgactcctaacagacttgtaaaccagtaaaggattgtagactttgaaatcagagtttttattaggatcatgtaagataatgtttatgaaagcacttcacaaactgtgaagtacaacacagatgtgagttgctgctattgtaattgctatgcatgttacaattattcagcctatttctttccattttcctttgatttttggactttgcagagcagactgtcacgctgcagaaagtgtgaaaatggcaaaatgcttctaccaacatgggatttggatgtgagaaaaaacagctaccctttgcatattcttctaaggaattaggacctactaattaatttctgatgttttgagggaatccaataaactgcctctataatttgtattggacctaccaagactcactcttgtacacaagcccactgggcttatgtatgaaatagaaattctattctgttctattaagagaaacctagcagctgccattctcttctgaaatggaaaaccccaaggaccaccgtctttggaatgtcagatttaaaatataaaaaggagcttatgttcaaaaaggcagcaaacaggggagggttctattggactaagaattgaaaatatgttagcccttcaagaaatgcctttctaggatgtaaacaagattaatttgaaagtgatttcttttgcctcgcctgtataatatttttctgggaacaattttgtttgctttgaaactgtcaccactgggtatcttagaaatctcttgattgctttttcatcttctcacagaccaccgaccttgcacccctgcctctcatattttcacaaaaatggaagatcaaaattcatttaaacaggagtgagaactgccataaaacagcaaatagcataataggaaataagacactaatccatactgtatgaatttgtttctctgtttatgtatatgatgacttttttcctcagtggatttgagggggttcataaaaccatgtaaattacaataagattaaataaacaaccgagggagcaaaagccaaggagcaaacatgggtgacaaaatacggaaactagaggtgggtttaacaccatgaaatgtataccctgtggacctgtgctttcgctggagctggacctgagatggtgcccagcttctcagtggtcacaccattcatctccaaatgcctgggttctgtaagataatcatagtaatgagccctgtgcctgagtagctgctctgtgtccttgcagagaaatttcttccaggggccctcataaaaggacactgtgtgattatgggcagagtcttcagcccctttcgctgtagcagatacagaagtggacaccatgtggttgggttcttgtatcttcccttgatgaaggtcagtggcataatagtgtggcgtaattaaaaaagcaaacatatgaaaaaaaccttattatcactggttattagagaaatgcaaatcaaaactacaatgagataccatcgcacggcagttagaatggtgatcactaaaacgtcaggaaacaacagatgctggggaggatgtggagaaataggaacacttttacactgttggtgggagtgtaaactagttcaaccattgtggaacatagtgtggcaatttctcaaggatctagaaccggaaataccatttgacctagcaatctcattattgggtatatacccaaaggattataaatcatcctactataaagacacatgtacatgtatgtttattgcagcactgttcacaatagcagagacttggaaccaacccaaatgcccatcaatgacagactggataaagaaaatgtggcacatatacaccatggaatactatgcagccataaaaaaggatgagttcatgtcctttgcagggacatggatgaagctggaaaccatcattctcagcaaactaacacaggaacagaaaactatacaccacatgttctcactcctaagtggcagttgaacaatgagaacacatgaacagaggcaggggaacataacacactggggcctgtcgtgggagtggaagactaggggagggatagcgttaggattaatacctaatgtagatgatgggatgatgggtgcagaaaaccaccatggcacgtgtatacctatgtaacaaacctgcacattctgcacatgtatcccagaacttcaagtataatcaaacaaacaaacaaaaagcatggtccaaatcaaaactccctgatcgtctgatagtctgactccatccaagggtttaattgagaatatccacagcagcatttctgaacatttttggagtagggactcctttaagaagaagaataatgacaaatataaactgagaactgaatatacccaggtatctgagattgtctcgtttactctgcacagacaccccaggtgtagatactgttattatccccctattaaagattaggaactcaagacctcccaaagtaagtaacgtgcttaaggtcacataggtgatagtgatagaaccagatataaactcaggcatgggttcagcctggtgttatccatcacacagaacaggtcaggacaaagctttttgacaacgtgattaaaaccattaagctctctctccagaagaatatgcatacggacataaatacaaaaatctagatgtcttctttacagttttcatatattccctaaagtccttcttctaaatagatcaagagcctccaactgtaaagactgaatgatccaatgtcattcaggaccttcttggaaatagttttctatcaggacttgagagactgcagatgggagagttgagggccctagctgatagcagaatatggggtatagatgtgctaggtttcagatgaagggcagatacatgagcttgtacagtcaggtaagatatgggacagactggggccctttcatgaaagttgaggacaattgctaagtgagtggtcactctcacctcacatgctgagaagttggccagggaacatctacggtgtctgttccaacacatgatgaaagagtgattgagggcccaaagtatttttacctacataatcattttagttaggaaatattgttccaatagtacaacatggccacatgaatgttccaataaagcagccatagtttatctacctttacatggagctgtttcctggtaatctatctaatctattgacctctctgcaaattgtacacccaggtgtctgattgacttgacctatggcatagaatcaatgcatatgagggattaaaggttggaggacatctgacacctatcagggttttgattttagaatagttgacctaaagctatcctttctgtgcttctcaatagaaatgccagttatcttttgaagccgtatatactgatcaagtacagagaagaaactttattttttaaatcagtgacataaaagtcaaccaaaggtaatgtgaagtcattgggttatcacttaaaaagaggtaggacatcattagaacctaaagtgttgggacactgggctggctcctgactctgtcccttagagtgttttgtggagtagattctgagtaagcatagtaaccatgaaaccatattgagctcacagagttttccaaaaataataatgctggtaatagctaactgtgtgacaggcactcttcgaagatctttgcatgggtaatataatttattctgcacaccccatgaggtaggtgctattattatcatccctgtgttatagataaaggaactggagcccactctctttccacaaagtgtgcaaactctctatttccgtcagatttctctacaaggtgatcaaggacacttttccatgtggaaaagctggactacagttgactcactgtcctaagaagtcagatagaagactggatttataatttggggtaacaagttgtagctcttctgaaaaaaacaagatggattcataaatctcttgtagtgacactctggtgcccagctcatgccaccttcagtcctgaggaacatatttccccagctgctgggaatgccccttcctgatggctcatgactgagtccatccctgagcatttgcctcccagaaggggttatgccccacaccaggggcagcccccgtcctatgaccgctcaaggcagggtgccagggcccagtccccatgcctcaatctgggacatctctgaaagggcatctcagccccatcgcttcttatgagatcggctgaggtttcttttgaaactaaatcacagtcagtttctccctttgccctatcctgctgtcctcatgccccataggagtcctgctcccaaggcactccccagtgaacatcgtgcagatgcattttgatctcagaatctgtttcttggggggacctgaactatgacatctgtctttgtttatgatgtacttttctcaattttaaatcagtgaaagattactttctcattgtatgtaggatatctattaagtaaactattagtgcctaggtcttttttgttgcatctcattgctgtgtggaagaaacacatctcaaattgcattttgatgaaatgaccatgagaatgctttgattttacctggtgggtttgtgtttgtatgcacacacacatacacacacacacaatgacaaagacattgatgcagactcatatagatatctacgtgtttataaaaaatcaataattttatatagcttcatagatatatgatataaatatggaaaaatatagacctaaaataatattttatatacatcatcatataaatgtaaatacagacaaaatataggcgtatgggcaaaacatagccatagccatagacatggattgttgttgttattgttctcttaggcctccatctagatcatgttttcaaccagcactttttttttcttcattgctggttcttcacctttattaggaggacaggtagagtgaaactattcaaatatgacttaaatcaactgccaggatacctcagggaaggttataattatatgctgctgatgtgctatgaaaagctgccaagccgtgagtacatctgtctttctgagccctttgtcacttagcttgctttgtgtagaggtgagtgtgataggaagctgggtgacagctttagaatgttttgaatttctctgtatgagtacggtctaggagccactcactcaggtgttttgcattaagataacacctaacaaccagagattctgggacatgtgaataaatgttggactttcacttgggtaaactctttcattttttaagacagagaatgcatacatggccagtatgaacataggtcttgtccttggtgcttctgcagtctagacttttgtctgaattactttttcagtgctgtgctggagatatacaggtctagatacacaccgttgccagtgtctgaagtatatatgctttatacagcatatgatagaaatatcatatttatggcatatgtcaatgaaatagccagcgtgaatgaaagtgtatagtccgagacaatagatcagactatattgctcctattagtctgctagtcaactggcccaatcatcatgtatttaatgacaccttaatatgcactcaatactggtccctgggagaggacagtataaggcaaatatttttagttaggatctctgatcttagagaaatgcaaatcaaaaccataatgagataccatctaacacaagtcagagtggctaatattaaaaagtaaaagaataacagatgctgatgaggctgtgaaaataaaggaatgcttataaattgttggtgggagtataaattagttcaagtattgtggaagacagtgtttaaaaatcacttaaaaagaggtgaaatactaaagacagaaataccattcgacctagcaatctcattaatgggtatatatccaaaggaatataaaaattgttctattataaagacacatacatgcgtatgttcattgcagcactcctcacaatagcaaagacacagaattgacctaaatgcccatcaatgatagactgtataaagaaaatttcttacaaatacaccacatgtattatggactactgtgtagccataaaaaagaatacgatcatgtcctctgcagggacatggatggagctggaggccattatccttagcaaactaacatgggaatggaagaccaaatactatatgttctcacttataagtggaagctaactgatgagaaaacatggacacatagaggggaacaacagactagggcctattggagggtggagggtgggaggagggagaggatcaggaaaaataacaaatggatactaggcttaatacctgggtgataacataatttgtacaaatgaacccccatgacacaagtttgcctatgtaacaaaccttaacatgtaccactgaacttaaaagttaaaaatagaatttctcaggacatagaaagcactaactataaaagaaaaatagggccaggtgcggtggctcacgcccgtaatcccagcactttgggaggccgaggcgggtgggtcccctgaggtcaggagtttgagatcagcctggcaaacatagtgaaaccccatctctactaacaaatacaaaaaattagctgggcgtggtggtgcatgcctgtattcccagctactcagggggctgagtgaggagaatcgcttgatactgggaggcggagtttgcagtgactcgagcctgggcaacaagagcaaaactccatctcaaaaaaaaaaaaaaaaaaaaaaaaaaaagaaaagaaagaaaaagagaaaaaggtgtatgaatttgatgtcatcaaatgataaaatttttgtctattcaaaaaaaggatatcatctaatcagatggtactcccatcttggggattccttagatattgagggatgtgtgtgtgtacacatacacttgcacctgtgtgcacgtgagaagggaaagattggttgaggagaatgttccgccgttgctgagtttattccattattgcctgataatattctcataggttaaaaggatgcatatttaagaccaaattaaaagtgacggattaacaaatccaaactgaaaaataagaaacaaatgataaaatgtgaatgacttttttacattaaattggctttgcttttagataatggcataaaactagagattgaggaagtcatttttcatttcttcagattgtgccccaatgactacacgtccctttaccttggtgatggtcttccatttttacattcatctgtcttgctaaggataccattttgcattctcatgaattatgctgtgaaaaaaaattctcaaacatctgggtggtttctttttttgtattcacatttcatattccattactttcctctgtcatctcttctaggaataatgattttttgctagcctagttgaatcttcttaggtttgaaccaacagtcttgactcttttgaatgagtttaatttgcattcctactttttctttttgccgattctttgaagattgcaatcaactcctttttgccttcactgtacattttcgagttattgattcacttgctatgtggtataaaatgaagcttacaaatgcagtttctttggttcctaaggtgcttcccacccctctttcagttctctgttgtcccagcaatcctaactctgcattcacaatatcttggcccattagcagctaggacttgtttgggcagagtgaactatatttccttgctctaacgaagcacacaaactataacagctatctcctcagcaggctgctcctgctaaagagggcagagcaaatgttgccttagagcagggagctaagctctgaggatttaatgaacttcaggatactgtctacacaggactgtggcattggtatgaagctcagcgattcatttcagctgtgttagctgctcctgtctgcacagggcctttctggcctttcgaatggacatttttactctcctgtatggcttttgtttagtggattagtgacctggattatgtagttgactatgctgccatcatttagcactttctgaaatggaaaactcacagatcttagatgaaggtcacagaaatcattataaatagaaataggacctagaagctacccctaaatgaagtttcttgaaacaaagatgtggggttgtgatgttacacagaatgttcaggaatgaggcctgggccattatggctgtagtgtggagtggggggattaagagtgtggctacaggtcaagtttagaagccagaatcctacctggatgtgaagtttataaaacagtcagatggagagatcgactttattcttcaagcaaatgggaacccattgaaggcaatgtgatcctgtttgtgtttagaaggataggatgaatatggctgagtgagctgatgtgaaacaacttcccagcctttcacttcagcacacagccacatcaaaaaagtataaaaatgtaaatacctacttcagattcaaaatcaagaatggaaggcctcagctgtcagaaatgaggagggaactcagaggcagggcagtgagcaggaactggcatttaaatggaccatgagagaaagcaataaaagatgtaggctctaactgctggcaattggagttttaagcccatgggaaagcagttcaggccttactcttagatctgagctacaggcaccaagccaggagttagaaagggctgccttgtcaattaaaaaggaaacagcaactgcacactggctcagaggattgatgacaaacttgccatatctctggtgccatcggaaaaagatcaccaaagcgaagttagaactccaggctattgccactgcagatgtaaggtctggatttatactatctatgtggtggggaacccagtactgagaaattaacatgaaaaatgtcttggaatgggagaaatgagtaggcctctggcagagacatctacagtcatcacattggtactcttcctaagagaacttgaatagaaaataatccccactgaaggtgaagtcacactaaaacaagtacaaggcctgtgagtaatgaagtaacacagagggaattaggcccaacaaatggtagaatgtaggttccaaaaattagaaataatagaataatcagaaacatcaattcaggttatttaggatgttcaagaaccagagaaagaagaaaaaccataggattgttgtataacatgtttttataagcgtatttttcaagtgctcttataaaactgtaaaagagcatttgaaaataacaagaggctttctaaaattagaactgcagtcatttaaagaaaaaagcaaatgggttgagcaatagatcaaacagaaaaaaagggtgaactggaatattaatctgagaaaatgatggagaattcaataacagaaaggtagagatgaaaaatttaagagaagaaaaaatggaggctacattaaaaacacctcaacatatgtctaataaaactgtcagaagagaaaataaaagatgagaaagaagcaattttcaaagtgaaaatggtgagaatattacagaactcaagtggttccatactggttcctgaatatgataagtagataataaaataaaaatataaactcacccaagacctacaactgtgaaaatgtataatattaacagcataaagaaaattttatcagcttccagagaggaaggcaaatccgtaacaaggaagggatgttagataatacacttggcatctgcaacaggacatgatgtaagacagtaaaatatcttcaaggtacagaggaaaataattgtcattgtagaatactatacctaggataaaataaaagaataagcaatgacaaactttgacttaaaaagaatatgagtatttacaactctgaattcacagttcaaacgtgtccttgagaaagaaggaaattaaatacagtaaagaatgatgaataaataacatcataaaagcaaatgcaagtaaaagtaatattggaaacatttaacaatggatatttaagaaaaaagacgcaaaacagtgataacaagggacataggttgggagggggagagaattgagtccttgggttacttggaaaaacattaaagatattaattaaatctagacttactaaaattaagattccatgtgaaactttaagggtattatgagaaaagaagtggaatgtataatttgggagagaaataaaatatagcatagaaaataaaaaggaataaggaaagtgattaattcaataaagtgaggtaagaagaaaaaaaggaaaagcaaggtaaattcaaaacacaaaataaaatgacagtaataaatataaacaggtaagtaatcactgtaactaaatgctttaaacataccttgtaaaagacaaaaacctttcacaaataatctataaattagtaagaatttaacagtgtcactaaaatgaagttcaatatacaaaaactaaccatgtttctgtaatatgtaatggcaacaattaaaaataaattttaaagaaaaaatcacttacaatagtatcaaaaaaatttaataccaaggaataactctaattacaatatgctggatagcaacacatgtatctgcatatgcagatggtctctgacttaacagttctttgacttatgactttttaactttacagtggtgcaaaagcaataaacattcagtagaaaccatacttcaagtacccatacaaccattctgtttttcactttcagtatagtattgaataaattacatgagatattcaacactttattataaaatcagctttatgttagatgattttcccaaccgtaggccaatgtaagtgttctgagcacttttaagttaggctaggctaagctatgatgttccataggttaggtgtgtaaaatgcattgttgacttaagacattttcaacttgtgataggtttatcaatgtaactccattgtaagtcgagcatttatccatccattcatctatctgtctgtctatctacctacctacctaccctctttctgactacctacctgtctatctgtatatatatatatgaaaagctatatagtatatatgtgtagatatctatatatacacacactatatatactatatatagattatatatagtatatattctagtccatatactatatatatatactctctctataatatatatacacacacgctatatgtactatatatagattatcctatgtatactatgtataatctatatatatactatattatactatgtataatctatatatactatagataatctatatatagtatatatagtataatctatatatagtatatatagtataatctatatataatatatatagtgtgtatatataaattatataaatatatagtgtcttatatataataaatatatagtgtgtatatatataattaatctatatatagtatgctatatatagtatactatattaatctataaatataccatatacagtatactatattatatatactatataatatagtattatataactatatatactaattacactaattactaaattataattaccaaatactaattattatatatactatatattatatggtatatatattatatagtatatatactatacagtatagtatacatatcatatagtatatatactctatatagtataataatatagtatatatactatagtatatattatataatatatatagtatatattatatactatagtatatatactatattattatactatatagagtatatatactatatgatatgtatacaatatataatatatattgttaatctctatatataatacatagtacactatattatatatactatatattatatacacactatacatactatatatagattatactatgtatatagtatacatgtatactatacatatatactatactatacatatactatgtatatagtataatctatatatagtatagcgtgtatatatattatatatagtatatataatatagtatctatatatagattatacatagcatatatagtatgtgtatatattatatatagagggagtatgtatatagtatatggactagaattatgcatccaaattttggggggcaagaaagaagggagtgggactggagagggaaaaaaggggaactcagttttggccaaaatgctccatttctaaatagaaactaaaattacagtaaaagttacattatattaagatatgttcattcttagttataggattttctttagtcaagtgtattttagacttttttaaaaatgcaattttaaaaaagggaggaaagctaatccttactgcaatgtgaggatgagaaaggggaaggggaagctggaattagatgtacaacttgggaaatgactgcactcttccaagcaagagatggtgaaggcaagaaccagggcgatggcagtgggagactggaacatgaatgctagagacactcaagaggtggaattataagaccctgctgatggcctggatctggacagggggaagtgagcagactcaggggattctcaggtttctaaacctgctttctaagaggatgctgtgccatatgctttctgagatgtggaaatagaagaggtgtgcatttggtatagcaataacggggaggaatggaggatgaaaatattatttaacacttaagcttgacggggtagtgcatgcctacagtcccagctgtttggggggctgaggtgaggggatcgcttgagcccaggaagttgaggctgcagtgagctgtgtttgtgtcactgcactccagcctgggtgacaaagtaagaccctgtctcaaaacgaaaacaaacaaaaaacccacttaagtttgagatattatgggaaacccagctggatgtttccataagacaattggaaatacagatctgatttagtagacacttatattaagtgatgaagttacatatgattgcttaaaaaagataatgaagtaagaaatgataatacacattccatgcttttgctagtgttatgacagaatatatgtataatctataattagttgtatatacacagtcacattattacttctagcatgagttagagttaattcatgtgaatgccttaaaaacaaaggatttactttatttggtatctttgattgtatttggcacaggccatagtaggagcttggaatagggttaatagatgaaataatgaaactaattattattgtttctttttttttatttaaaaaagctagctctattgaaatagtataaaattcacattacatacaagttactcatttaaagtgcacaattcagtagtttttggtgtattcccagagttgtgcaaccatcaccaccatcaatcttagaacattttcatcaccccaaagagaaaccctgtgcccactggctgtgacacccaacactgcctcccatcaattttctactccagcactagtttaccattcacttattttctttcacagtagatttgtctattctagataattttatagatggaatcacgcagtatgtggttttttgtgtgtgtgtgattggcttattttacttagcataacattttcaaggtttcttcttgggttgtttccatttcttggctattatgagtaatgctgttatgaacattcatgtgcaactttttgtgtggacctatgtttttctctcttgggtgtaaacataggaaaggaattgctgggtctatggtaactatgtttaaccattgaggactgcctgactgttttccaaagaggctacaccatgttacatgttcaccagcagcatagaaggtttcaaagtctctacattctctgtagtacttgttattatctgactttttgatgatagcatcctagtgtgtgttaagtgctatctccttgtggtttgggtttgtttttctctgatggctcatcatgttgaacatcttgagcctattggccatttgtgtgtcttctttggacaactatcagcttctttgcccttaaaactaggttatttgtctttatatcattgtaataattctttatgtattatatataaaattctcttataaggtacctgatttgcaaaataaataattcctttttttgctatttttttgttttgtgtcactatagtcctttttatgcacataaaccttgtcctgtcctattcttttctttctctctgtaattatctatctttaaataagatctttatgtatgtaatggtttgatcctgtttttctcacttaaaattttatagtaaaatttttcccatattattcaaaatatttggaaaatatttataaaatggctataaatcctactatgtaatttatgtaccataatgtatttaattgtttttatattcttgcacacttgtaaagtattttcaatattgtggtattattattaagggctaaaacacatgtgtaaatacatgttgatccaaatacctaagtctatccctagaatgggttctagttaagaagtagagtaactgggtccaagaccataaacatctttctagactgcatgcaaattgttttccagaaagtgcgtcagttcacactcttctagtaagtgcctgtttcattatgtccttatcaacactgtgttatttttaatcaagtagtaactgtgtgaacatttctccttgatgcccagaccctgcatttacttaatgctgagcccgtagctgtcaattcaggatgatgcagttcgctcaggaagtcataagttctgacaaagctttcacagtagtatatccatgactttttggtgacttcaaaattcacttaaagagacataaaacaattaccaggtcattagcagtcactttttaaaaggagcccccaaaaaattatctctgagagagatggcttctgagctggtgttttattttgcagggcagggagggggatgccaagaggaatagttgacaaaaaggaacaatttaaaggcaagcattagagttatgggaggaatgagtggatcattctgctcctatatctgggtaatctcctcgagggcagggactccagcttactcctacaatgtgggacacttaacagcacagactccagatgagcagatcagtgttggaatccaggtgttcctatttcctggctgagtgatcttgggtctgccttaattgcacatgaagcacttagcacagctaagagcatgctagcttctcaatatatgttagctatttcccatgactgttcactcagtatccctaactggacagcaagcattggggatgacccaaacaagcactcaacataagtattaaatgaacaagttatgggaaaactttttaaaaatttgcttggaagaaacgtttcagttttctgtaggatgagccactcacaatccaccattttaaaattaatcctcctcatgtttgaaattgtcctatgctcttatccagttaggtttcctcagtaagattttactttgaaataaaccattatgtgtagcatgacatttttctgttcttgcagggatatgcattgttctttatttctgttattttaaatcatttagtagataaccaaaaaaaaaaatcacttaagagtctgatttaatcaagaagcagaggatgaagtgtgaaagatccagtgtttttctgatcctcagttttgttgaaggctgcaaaaaggtatcaattaagtgacctttccaggtcaggattttatggctctgataaattccccaggcttagcacttgtcagggaagacatgcaagtgaaaatatgaagattctttctctctaactacatctttccaatgagtagatgagatcatggatttgcaagtgcctcaagaaaagttttataaatctaaaacattattattattattatcttgttgtgataacagcacaaaaaatgaagaacttaaaattgaggcaaaggtttttttttaaaatcattttgtaacatcttacagctagacagattgttacagattttgtggtcccaagctctcacttttacagatgaaaaaaaagcataaaattgcttaagatgacatcatttaaaacaaaagtcttgttactctacagaaagacagtggatggtaaaatttaataatttaggctgggcgcggtggctcacgcctgtaatcccagcactttgggaggccgaggtgggcggatcacaaagtcaggagatccagaccatcctggctaacacggtgaaaccccgtctctactaaaaatacaaaaaattagctgggcgtggtggcaggcgcctgtagtcccagctactcaggaggctgaggcaggagaatgacgtgaacctgggaggcagagcttgcagtgagctgagatcaggccactgcactccagcctgggcgacagagcaagactccatctcaaaaaacaaaagcaaaaacaaaaaaatttaataatttaaaatattcttagatgactacattatttatccccacaatgcaaagaaaatacaaacttatattcacatatttcatgtataatgagtttgagtgcattttaaatgttattgtcccaaggtaaattttaaaaatctgaaataagaaatttcgtttacgaagtctttagtggagtcgattcttttggtgtttggaaaatgtttttgctgcataagcagggcaaagtttaaattctccaagcttactgcaatttaccacatagccctttccttcagagaactgcttacaggaaggtactgtcttccctggatgttaagttacattgaaattaataaaagttaatgaagtcttttaggaactccctgtctttcctgtgaggtgccatatttaaagttaagctactccccttaagcaaaacttcaagaatgttatttcctggtaaccagcatttgcgttaccttgagctgtaaaggtcccctctgcaaggcattgagtgacattttgaatacacacaaagcagtactaggttacaattttttcttttttgcaaacattactttgatccttaggggaagtagtttcccatgctcacatttctttttgttgttgttgttgtttgtttgtttgtttgtttgaggcggaatctcctctgttgcccaggctggagtgcagtggtgctatctcggctcactgcaacctccacctcctgggttcaagcaattctcctgcctcagcctcccaagtagctgggattacaggcacctgccaccatacccggctaatttttgtatttttagtacagatgaggtttcaccatattggccagtcttgtctcaaactcctggccgggtgcggtggctcatgctataatcctagcactttgggaggcctaggcaggtggatcacttgaggtcaggagttcactttttgataatactgtatttaaaacacaattctcctttgttcaactctatttggaagaaatgaagagtgaagagtgatggtgtgagaaatctaaatcactttagggagctctagaatacactatattttatcattataattggaagggcaattggacaaatggttagagattgacatttctgcattgtttatcactaactggagaggcatagtcagaaggagaatggtggaaatcggcctttgggcactattctttgtgcaacagagcagggctcatagaaattctgggaaacaagcaaggcaaagagaaggaagtggaaaaaaggatgactctgctgttctcaggctgcagcatatactgctatccctgctgccaagaatttgaaataacaatgagcagtgcagaatatgtattgcagaagtacttgacatcagataatccgcatagttggaaagtaagatgtttcctttccccttgcaaaaaaggcaaagtgctagttcttccaaaagccatactctaagagtattatataatattcattttaaatgatttgaagtaattttaattggtacttacctgggaggctatatcactcttcatttcaccgtctcaaaatggcatagtgaattgcctctcattggcagttgcgacagtaggataagacaggatgatatatacaaatgacttcttcttcagaagaatccatccagaagaattgtcaaattatttttaaatggctatagttcttattgaaacattgcaagagaagtttaaagtcttcacttgcattgtttgacattgttatttggcaattctatcataaaatcctggaacgtttgagctgggatatacttcaggtgctttcttttcaaaactctcaccttttccaaatgagataagagagatccagagaggctaggtaacttgaggaataaactccaggataaaagaagttgtcagaaatccaaaagatcacagtttttataactatgaagaagacagaagggtgtctaagatctcttcaatatcaacagataggaaattggaggtcagagtaatggaaagaagggaacaggtttttgagagaagaaacatttcaatgactttggttacggtgttacagaaatagtactagtctcattttgaggtgtttgacagaagagtttttggatgacagtaatgcagtttttgtatatgaaatatagggccagatgtggtggctcatacttgtaatcccaacattttggcaggttgaggcaggaggattgcttgaggccaggggttcaagaacagtctagacaacatagctagactctgtctctacaaaaaattaaaaaattatagcttggtgtggtggcacatatatatatatatatatatatatatatatatatatatatatatatacacacatatatatacacacatatatatacatatatatacacatatatatacatatatatatacacacacacatatagatatacatacacacacacacacacatatatatatatactcacacacacataaagtttcaaaccatgaagacaaattgccatgtacgatgacatcaataaaggtattaggtaagacatattttttttgcatctataggcaaaactttatatattatacataatatatattttatatgtaatatataatatgttatatatttatatgttatatataaattatatatatataacactatatatatattttatatatatatataaaaaaatatatatatatatatatatagccatgctcccattctgaacaactaactgggaagggctaaaagggactaattagacccaaagtgaaaaatattttgcatttatttaaaccctacattttgagtaactcatattttccagattccctgttggtagtagccccagcaagaggaaggaatataaaggaagagtcagcaatcttcacctctgtgatttggatacagaaaccaggactccaggcattcagcgacagaaaccaaaacccacttccgtctgccccagagcaccttcttgctccttagtgcttgtttgatcacagcacaggcgaccagaatcagcaggggagcatgaagggccttggttgccttggcaataatttgtcctttggcagggcttaaggaagtgggaagggttgggggaaagggtcagccacactcttgaagaaatcacagctctgtaagctctcttgacaaatgtcatgacctggtgactatttccttgccctgtgaggaatttctgatagccctgagattattttgcagctcttagtctcaacaaaacaaagatgtgagctcataatgatcacatcttaataaaatctcccttatgtacataatgtgtttaaaatgattgtcattatgctggttcatattactttattcatagaaattatagtgttccattttaaagtgtggattatttgcatgatattaaagcaatctttaaattgattaagaaagcaattgaggaattgttgagcaggctttctgtggaaaagggtgctgatggcacctcatattcactctctccttctttcttgggagcagaatctctattttagcagggaacatggccaccatgataaaagactgcattgtccaggttccttgcagtcagatagggccacatgactaggttctagctaagacaatgtaagcagaactgttgtttgggtcctccaagaggtcttcttgaaagagaggagtgtgccctttctctacctcttctccttctgaattcaggggagatagctggaattcaggatcaaccttgaacctgaatgtaataagggaaagatatggagcagtgagagatgacgtggactgctgacaccagtgagctccacaccagctttggcccccctgctgctggacttctttaggtgacagaaaaataaatgtaattctcattaacttggagatcaccagatacattcagctgaatgcaaacctaaataatatagatcttaaaatagtatgcaaacacttagctcctgtaggaaaatcatcaagcaaaaagttttgcccatagacacaaaaaatatgtcttacctaatacttttctgatgccattgtacatggcaatttgtcttggtgatttgaaactttttgtgtcgtaacattgaatttttgaaccagatttccctttatatgctatatggagccttgggagaaataccagaccagtagttcaggagcttgaattcagtgccacctgagtcatttttttagcgctatgctcttgaataagccatcctgatctcagtttctctccgtgtaaaataaaacttctggactaaacaattctctaagctctaaagatctataaatgtatgatagtgcctatttctttttaaaaccactaaaactgattctgggccctagtcatacatgtaaatatatgtgcacaaatacagagtatctggtatatgtacagaattattcaactttttattacgtagggtatgtgtgtattggggggaggaccacaaagctcatcgtcaaagagtctacattttaattgtgtagaaaatgaggcaaacatcgaagcataaaattctgagtaaatcctgtttcctgactcctagttcaacactgtctcttctatttcatatcccttatctcacagagcttcacatattaaacggacagaggcctactagctctgtggtttacagaactcttttaaaattccaacaattttgtttaatgccatgaaatacagttctactctatgattacccatgtgagactaatccacttgctatgataacagtcattcaacctctctctaattaacattaactgtgcttcatctcacttttaaagctatatatccatgagggcaaaatattctattgttcactgaatacccacgtattaaaacaattaatggaacaattaaaccagaaaacatttttatggaggaagtgagttttgatccagagttttagggaggtgataaatgtgggttgtcagagaagtgaggaggttgccttaaagggcgtgaatgttatttgcaaagacatcaggctgtggatgatcagcagcacaaggcagatggtacaaggtggggctaaagagagtgggatctcagagctttcctgctgttcctttgctgccttggctttcttattagcatgaaatacttgctttatgcccagtgtttgtttggagttggatggcactcatgtagaagagagatggataagaatatgatgctggtggaagtaattttaaagatgaagagcagagaatggcaaaatcatcgctgtaagaatgtgccccctttgtacaagagatattccatttgcatatttaggtttcatgcttcattgtgtgcttatgttgtgtgggtgagataaagttgcagaaggaacttagcattgcctgacttgtgaaaattaagtcagccgtgtctttccactaataaagtatcttcatgggcttaattttcttgcagctgtgtgtgtgcgtgtgtgtgtgtgtgtgtgtgtgtgtgtgtgtgatactaagtgaagagaaagtaaataggcagtgtatttattgcaagcaatgtgtttacctgcatgtatcatcactgaaattatcagttattagaagtggaaagtcatgtgttttaagtgtcagttccagtcaacttcttttgcagcacaaacctgcccaacagggtcatgatggttcctaagcactgatttggacatggtcacaggaatacagcacaagaataaagccccatgttcaggtggcacaggctgcagcaaactagactggccaactcaaaagaatgcatgcaaaccacaaatcagagtgagcactggtttgtgttttctaagagaggcatggaagcaactcttcttcctgggccatattccaaaggtcaaacacaaatgatggggaaaaccttgagaagcagaaggaagcagggcctttcccacttggcccttcttttaatagccagtttcttggattcctttcctcatgctcctccatctaccgattcacacatacacatatagttggcatgaatttgctccacaacaaatacaaaaacattgcattgctttacatttctatatgtaataaaaatctgtttttgcctgttagttaggttttacctctgacacccaacatcagtcatagtgggaggcctgtttacctgagggtggcttaagagtctcatggtgttctgcagttcaaaaaattaggaaggggcctccagctctttcggccatcaggatcactgctgagatgcgtgttgtccaaacccttggggcctaagccaccaaaggaggtacttctcccactgcatggaatgtggccatcatcttccgtgtctcctgaagcccctgctgcttgtgttcaggctacagctactcagaccatcccatcagatctcctagacaataagtaagagcgggtgcaggcaccacagctccacacattcaccactcatctccttactcagttcccactcattttcatttcctaaactcaaaactatagtctccatccctttcctgtcaggaaagactcaccctaactcatctctttagtttgtaacagactccaaagcctgcatagggcttttttcaggtttctggcagtttctgttttcaactcatgaacctaaaagttctggaagccctaaactcagaactcaaggggctgtgctacctagaaaaaggactgataattttgccttatatatgtttggatctgattgcagtagcagaaacaagacataaactttattttaataaattatcttgaacacacacatatcagagtgggaatttgtgccaatagggagcagacaaacaggaattttttgacttgtggaaaatttgcaaaattgatatttgtctttattattgttgctgatgttgttttgtgttagaaggagcaagacttttcttaaggtcaatttgactgataagtcaataggcagaatcaacaggttgtttctgcatcacagacctacaaacctctcgttccatttgtcagattggggtaattgtacttccattctggtggtgtggtagagaacattatgtcccttgattgcttaaagaaacaaaatgctttgcttaagtctcccacaaggatggagaggtatttagcacagagtttttcccacagagttttgtaagaataagaatgaatcaagtatttacaataatgatatgtatcttgagaatgagcccctctagattactaagtttatcctttgatctgaaaacataacaatgattgaaaaatcaattagcacatataccatatgtctaaatttagcctaaattaaagatgagggaagcacttttttattaggagttattaacctatgtgtccccaaattaagcaggatttaatagaatttatgcttgcattcattttttattgctacagtaacaaattgcctgtgagataataaataaatgtcttaagcatgcttcacctgggtcctctgcttagagtcatgcttcacctggatcctctgcttagagtctcacaaggcccaagccaaggtgttggcagggctgtgttccattctggaggctttgggggagatccacttctaagcacattcaggttgttgggagaattcggttcgttacggttgtaggactgaggtcctgcttccttgcctgctctcaggacagctggggaccacccttggctcccagaggctccctctgatccttgcccatgggctgctccatcatgtgatttcctccatctcagagccagcaaaagtttgagtccttcttacgcttagaatctctgacttcctcttttgctgcatctcttctgcccctagaagagatggcagagaaaggtctccacctttaagggctcatgtaagtggaatgggctcacctaggtaatccaggataactccctcaaaatctgtaactttaatgacatctgcaaagtccctcttgccatgtaataaaacatattcataggttccagggattagggcgtggatatgtttggcagggggtttggcctaccaagatgccttttcgtagaaaaatgaatataaaacattaaacccccctacttttaagttagaaaacaaagaatataaaagtattcaataagagtgactaaaatatcaaaactttgttttagttcggggtaatggcaagttgggatgggcctgatagaatggagggaatatgaaatctagaaggaagatttttgttttaaaaaggggtggaagggaagtagaaagttgcatagatggagaagaaaagagccacagaaagacaaagagggaggaagaagagagggggggaaaggaagggaaggaactgaaaagaaaggcagagggttgatgaaagaggagggacacaccgggcatggtggctcacacctgtaatcccagcactttggaaggccaaggcaggtggacaacttgagcccaggagttcaacaccagcctgggaaatacagtgaaaccccatctctacaaaaaatacaaaaaattagcccagcgtgttggtgcacacctatggtcccagctacttgggaggctgaagtgggaggatcacttgatctgggggtggtagaggttgtactgagctgagatcatgccactgtactgcagactgagtgacaggagttaagaccctgtctcaaaaaatatataaataaataaaaagaggagggacattgtataaaggctaagaaagatacataaagatatgtaggccgggcgcggtggctcacgcctgtaatcccagcgctttgggaggtcgaggtgggcagacgatgaggtcaggagtttgagaccagcctgaccaacatggtgaaaccccgtctctactaaaaatacaaaaattagctcagcatggtgacatgggcctctaatcccagctactcaggaggctgaggcaggagaattgcttgaacccgggaggcagaggttgcagtgagctgagatggcgccattgcactccagcctgggcaacaagagtgaaactctgtctcaagaaaaaaaaaaaaaaaaaaataaaaaaaatatatatatatatatatatatatgtatatatgatatgtaaaggagaaaacaggtaaaagaaggcatgtgaagaagaagaaagtgtagagggctttaaagtgaaggttaactgaaggtcctgtggtgtgtagggcatttatcatctattggggtaacatattctctaattttcctaagacagctccagattacgctaattatcctggcatatttactagtggcatccttttcactctcataaatgtcctgatttggacaaggtattacatagtaatccttccttaatatggctccatttgaaaggtacattatctgcttaccattttttgcagtgtttaagatgttatcgggaacatctgctccacatggtttggtctcaattcagcaaaatgcatgaaatttatcagtgactgactgaggtccttgaatcaagtttccaattcctgcacgcaccttttgtttctatttgtctctgacattcacagtctgcaaaccctattagtggtattagaaaacgtctgcatcttttcttttaagttaattttctttctccacttgtaatatatcattgcataacacatagtttaaagtgtaatcctatgctttttggtgggagaaaaatgaacgctcattatctcttagatgttaactcagaacatactttcttgtattttagtttttttacattaaaatgtcagcttttccttatctttgcatcctctttaaatggtttaaactcttagaagttacattcttgtttgcatgctaattaatctatattgatgaacatatatgtaaataatagtgataaataaaagagcatctgaccaatagaaaagctaactggctttaatgagactgtatttcagattgattttggttattaaaccacatacagtgctcttgccttccagtaattacactaagcagaactggttatttgatgatgagacagtttccattttggtttaagtaaaattgatttccatgaactacagtttagttctgaataatatatgcgttattctggattgctaagcacttaggaaatagtggataagagaaatattcaattcgccacagatgaaaataacagtaaaaaaatagtggtaaaacgtggatttttgagtcatgcagactgagatccaatgctgactttgttccttaggaactggaagacctcgcacaagtcactcattctttctgacactcggtgtttttatgggcaaaatggggttagcagtatcaacctggggtggtggggaggaatgtgatgcagattaaatgagattgctgagaaataaccagcccagtttctggtacacagagataaaaaattgttagttaccatctccttgcctcctggggtggccagtatgctagtatgttaacctcagcctctgcatccaactttaacctgaaccctaactttgtgatgtaagagtgagttgagtctatctagatttaacattcttttatattgcactagttatgtttgaatttttttttcagttacaccctccaggtctactaaaaaaaagtgtaagtagttaatatgattattttctaaagcaataataaaaatgctttttaaaaagattagaaatttgaaattttataacaggtttagaaaacagtagcatcttattatttacattagatttgacatgtcaatagcaaatgatactttattgtagttcaaaggttttaccactaagaacttgataattattcttctcaaaagtaagctgggcatggtagcatgtgcctgcagtcatagctactcgggaggctgagaggatagaatcgcttgagcccagctaggagttcgataaaagaaaacagccttgactggtgatttgaaagcaccgtcaaaactccctgcatttcctttggtgcttggtttatgactcctcctcagagatgctcttgtccatggtgctgacctcctgattcaagctgtggatggagttcaagtagcggacggccagggtgtcccttccatgctgggaacataaggagcgtcctgtggtgtgtagttgctgttcttctgtgttcagtctgttgtaactttaaagctcttcttcgactcctcaaatgctccaagggctatcatattctcggttactattctgtaaactccccacatgcaatgttctgtttcatgctgtgggtcagagcttcgtgaactgtttctctggtccaactcactcatggttgttgagagtcaagtcccctatagtgatatcttcactcattcattccataaaattttactgcccttttatgtagactcttgtcatgggcactatggacaaataaaaggtgaatatgacttagtccctgacttttagatacttagaatctggtgagaggtgaagagggagatcagcacacaaattcaggaaagtgaggcagaattaagtaactttataggacaggtgcagtgtgaacctatagtgattctcaaccctgactacacatcggaatcacctgtagggctttgaaacatcctgccacacatgcttcatcccaaacaaattcagaagctctgggaataaggagtgaaggcatcagtgtttttaaagctgattccagtaattcaatgtgaagacaaagttgagaaccactggcctaaggaagagcctgaaaaactttcactggctctgtggcaggctgatagtaaaatcttaggtacctttgtttccattgatttcttgcacctgtccttatattattattggactttgatgtcccttactttcgtgttgatagggaacatgtgtaattagtatatactcaataaacgtttgtttgtggatagatgaatacccattcttaatgcttccttctttttaacagcaaacatttattgagcatctactatgcctcaggcactgtactgagtagtgggaacagagcagtaaggacgattgtgtctctgcctggatgccttgtgtttctcacattgcatcttcccctccagcagaactatctggggagcttgttaacagagcaggctcttgaattcctcctcagcctattgactaagtctttgagggtgaacttcagtaatctctgctcacaagccgccggtatgattcctgtgtgcacgacagcctgaaattgctgagtaacggcacatgcaaagccatgacaacaagacaaagacaaatgaagagggctgttggtgtcacatcagaaagggtgacttcccctggggggaggtggcctctaggtggtcttaaaggatgactgtttgcccagggaaagaatgggaaggaaagtacttcaggcccaaggaagatgacctgtgaagtcacagagacacagtgaatacagcatgttgtggagaattgagccagattgtgaagagccttttgtaattttaagctaattaacgcttattgattttctgcaatgttttaagtcctgtgcacaaagacggtaataaactgctcaaggaacagggtgttcctgggtctggctctgagcccttgtttagttcggagctatgccaaactctgaaaatctccccaaaacacagaagccttcttgattcctggtgttataaaaccatacctaattgtgccagtgtccctgggagataggcatagagttctagcttgggtagccaggaacacatcctctgatacagcaatagcagatggagtagggactccctgctctccaaacttctagaagctctagaaggaggcagagtctggtttgagagggtgggcatgggagttgtttcagacactctaggaggtcatggctggtgatcctattacattgatagtttggttttataacaccgtgaatgccaggctatcaacattatgagtaaaattggctttggtagcctaacctggagttctaaccacttataactttttgtctaaaagaggaagctgtgttccaaaagctaaatgtttttgattaacaatagttatgtatgggttgcttaaaagcatctgtcctccaatgctctgagctttacatttgcttcttgttactacttatttgtttttctcaccaaccctctaagatatgctgtatgattacatctgtttctacagattgtgtggcttgggagtgacagagttgggatttcaacctaggtgcatgtaattattagaaactgagtgtatagcaactatgccaggccattcttggaatgaggctttttcttaaactggtggattttctctgcctttttgttaaatactttacatatatatctcacagtttctgtaggggttttgttgagtaattaaggtaaggcaaattgaaagtatataaaatgccccagattaaacaggaaaaaagatattaccctcttacttctgtcctatgacatacattgatatatgcaaaatcccttttcctaagcacttttgcttaaggatgccagataaagggataaggaaatataacactattcaatttggcaggaatcacagctaaggttgaatatcacattactttgctgcaaagagcattttcagatacattggctgtaggaagattatgattctgcaaaacaaaatgtggaagaataggatgaaattgattgagttatgaaaacaattattatatctattcacttatcatctaatttcccgttacctggataattactggacacttgaatcacagtctacacactaaccaactgatggcccacagaacctagaggaaggcaaactctcagctctgttattcgtcttctccatgggaaaaatattgacactgctttggtgaaaacttacagttcaaatatacaaaaggagaaaactgcagaaacaaaatcccttcacagtgatctggaatttcagtaagattcagatatgatatatttgctcctttttattagaaagatttgattatttgcacatttataattttttgcatgactcactatttaatccaagtgttttatgtttattcactgggtagtctaaacatgttctctctttccaaactattatcagtcatcacagtcatttgatatgattcagttatatcctattatttaaacaatcctctactgactgccttctgtgtactcagtattacatacgtaatctttttgtacatgtggtaatcttggatagcaaggggttaacaatgccttgcatagttgttaggcatttcaaaatatttatagtgaagatatgaatgcacatgacctcttagtaaatagaaattaattgagctcatgttgtgaaactaaataaattagtgggaagaaaaatggtagggcttactagcggaagtaattagatcaaagaattctctgttgtactaagttgcctctgtttgtttctgaatggctgctaatgtttaaatctctgggctgccaaatttgtgctattttgccaacaacattttctctactccaagtgttactggaaagctaatcagaggcagtaattgatttaatgacagaatgattcaatagttgcaatcttccataaaatatccccttttttgggtaaggtaaattatcaatttatagatcttctcagaaaagcagttctttttgctcccttaaaaagaagaattctttgcagtcaaatttgtttggggatagaatgtttcacctattttgtgctggagcataaacacagtccttcgttgacagtgaagtctctcttgattcggttgtcctgcataataattacatggctgcttaaaatggcatgtaatcaaaatgacacaatcttgataaaagacgaccgtgtccagggctctctgagaagaatttaatagtagaatttttgtgtttggccgttgctgtgataaacagtctagggttttgcttttaagagccttctgtctctctgaactgcctttcttagctcctagcttcagtagttgatgaacaacacacagtttcctcccttgcaggtatgtgtggcatgaaagaaagagagagagaaagggagacagtgatgatagggagacagatgatagacgattgatagaaaatgagaaatcataggtaggtaggtaggtaggtaggtaggtaggtaggtaggtagatagataggtagatagatagctagatagacagatagatgattgctggaatggggaataatagaagatacataaaagaaaatagataggtgatagagatagagatatatgtgtacacacacacacacacacacacacacactcactcacatatacctgcttaatgaccagaaaaagtacaaaacagatgtgaaactgcagatttcatgttaaagctagaagtctctccaaatgcccacaggtattgagtatgacacagcatttgcagtaaaggaaaggattcgggtgagcaggaggcagcatcctgcagagccctgagctgagttgacctccaattctagaacttgtcttctctactgactcctgaataattaccagcttccccaccccagccttgccaagcagcagaaattagacccttatctcgtgctacacacaaaaatcaactcaaaatgaattaaagagttcaaacaggggaaattgacatagacaatgattttgtggatatgaaccccaaagtgtaggcaacacaaaaaaatatagataaatgggactacatgaaactgaaaagcttttacacagaaaaaaaaaaatggaaaaccaaaaaacaaacaaacaaacaaaaagagtaaaaagatggcctatggatggggagaaaatattggcaaatgaaccatacatccaaaaaggagttagtatccaaaatacataaggaattcaaacaactcgatagcccattaaaagaaagggcaaataacttgaatagacattttccaaatgaagacatacacatgggatacaacatacaacagggatttccttggtgtttgcatgccaacagtgttgctcagttgtcccacagcttccaacttgtacgtttaaataattgtattaggaatgtaatatgtgtattaatgataaaatttgagtagtacagagatgataatacataaaataaatatctcctcccctaaccatatcttgatctcccatttctggttttcattcttcttgtggttatatttataataatatccaggtgatatgtataaatgtctaccttttgagctatcaaccttaaatagtatacattgcttccctgatatgaaagatgtggaatttagcatacttgtactatttcttccacttctaaagaaggttttgttctcactaatgattgattttataactctattgagagataggaaaaagcaaagtgttttttctaccctcatgcaccactcaacacagaacacttctgtgaccagatgtgtgcagatttttcccagtggacaattctctagtggacaccaactgggtatcctacaattccattcaactctggtgctatctacctggagatagtgtcagatctctcaggttgagagcccagtcccacaagacttctctccgccacttcagataccaatagcaaatagcagattgtcacttatacttctgactaacaagcaacaaagcaggttcctgtgacacttccttgggtttgattaatttctgggatgtctcacagaactcagggaaacacaattactggtctattataaagattataaaagatgcagatacctcagatgaagaggtgcatagggcaaggtatggaggaagggtgcagagatctcatgccctctctgggcacaccgcactcccggaacttccatgttttcaccaaccaggaagctttctgagccctgtcctttctggattttatggagacttcattgcataaggatgtttgattacatcactggccattggtgatcattcaatactgtcctctctcctgaagcgcaggagtagggctgaaagttccaaccctctaataacatggttggtttccctggcagccacctccccatcctaggggctcccagttatcagttgtcttgttattatgcaaaagaagactcattattccacagattacaagggttttaggagctgtatcccagggaccaggggcagagatcaaatatatatttctcattttatcacaatatcacaactctagtaatatatgtgtattagtccattttcatgctgctgataaagacatacctgagattaggcaatttacaaaagaaagaggtttaatggacttacagttccatgtggctgggaaggcctcacaatcatggcagaaggcgaaaggaagataaaagaagagagcttgtgcaggaaaactccctttttgaaaaacgtccgatctcatgagacttattcactatcatgagaacagcagggaaagaactgcccccatgattcaattacctcccacccggtccctcccacaagacatgggaattcaagatgagatttgggtggggacacagccaaaccatatcaatacttaaatctatttttcttaatatatcaaccttaggctttatatctagactccagtatatctgtaaaatggagatagtaataacacctattttataaggctgttatgataattaaatgagagaatccatttaaaggacctagcaaaagcttggcttacagtgagttctcaattaatttagctgttattcattgaggacagttaactaattgcctcaagcttcatcccctcacaactttcactgaacaaccacagcctcagtcagcagagtgtgactgtgattgcctgtaatcacagctactcaggaggctgaggcaggagaattgcttgaacccaggagatggaggttgcagtgagccaagatcatgccactgcactctaggctggatgacagagtgagactgtctaaaaaaaaaaaaaaaaactaagtaaaccattatctttccttagcattttgatgtttctctactatttcctgattgctgtagttgctgatgaaaaaatacagtctaacatcacacttcacatcttaatagtctctctttcatcttcattttcttgtttacagtttcaatacttctgtctctagttttgtatttatttttatttaacttttttggtacttagggcctatttccattcaatatctttctataattcttggaaattcttacctactactcttcaaatgttgccttggtagtctttccctagatcctggaatttctattagataagtgatataacctctcagtctgtgcccttttatttttaaatatatattttttatttctaatatgtcaaaacagatctttaaaaaatctgcttttcttgttttattgccatcagttttgtttcatagtttattgttgtgggtggtttataaacatagtttatatggatttcatgtcttcatttatctccctttaaagtttgttttgactgtttcataaaataaattaaattccaagtctagagaattcatgttcctactgttgatgtttttggctgtctttgctaggattagtcttatatttgtgttttgaaatttagattcataggctcattttgagtgagaaaatcttgctttttattttgttttatcttttctatctgctcacccctgggctcctagttcagaaccagatcttattatgttttgaactttctgatctgtggtaacttaggaatgttgcccttccactttggctcaattcctagacacaaagcttttcctccatgtatgcatgcatgcttactttcttatcagccaactatttcaaataaaggtgcagcacccaatgtcaggtttattcattacttttataatatttattgagttaccagtatattctaggcattattctaagtcctggaggtttagctgtaaacaaaacatagtctcttccctcatgagctgacattctagtggaagagagagacgataaaaaataaacatgccatatgtaagaagatggttaagtactatggagaaaaaagaaagaaaaatgaggaatttggggtcagtgttaactcataaaaatgatgagagaaatcttcattaaaatggcaagggggcagtgtggctggaatgaagaaaggaacaggtagaagcaatggaggtgatgagaaggagtttgaagataaaactaaatggattgcatgtgggttatgatagaagaatcaaggacaactccaataattgtgttctgcaggattggttgccatttactaagatggtgaggactgtaggaggagatttgtgccatggaggggtggcaggtgggggcacagagcaagaattcagcattcagacgtattcataaaataaatttgaataaacattcaaatcactgttttgtaagtagtcacttgaaatgactatcaaatatccaagtggagatgtggagtaggaagttgaacaaatgctctggcatttgggaaagacgtctaggctgggagttgggatatggggtaattgggccatgggactgaatgaagtcatggagggagagaatgtcataagagaagaaaataaacagttctgagggccaggttctgagttatgcctagatttagaggtgggagatatgaagaggatctaagagagatggagaataagtcagtgaactagagaagaactaggaaggagtgtcattcaggaacccaagtgaagaaagactttcaagaggagaaagaaagaaaccagaccagatgctaatagtagaaaaaagaatatgaaggctgaaatgtaaagtgaaactcattggtaaacttctcaaaaatggagtgatttttttttggcttatctgagaagggggaaccctcctcaatctttgaggcatatttattcccaggagataacccctccaccccctgctagcatctgcattagtacctggcaggtctgtgacctgaggcattgatgtttctgcccttttccttatccaaggtgataattatttctttgaaagtctggctatgttgtttttatttgctctttttctatttggtcacattggtatgtgtttagagcagtgagagtatgaaaaagtatgaatttactgtaccattttgactgaaatttctttctgccacacctttaatgtcttcagtaagtgttccttttatcttctagcctcacctgggtcaccattaagaatatgattttttttttctatcccatttcacatatagccaagttggcggtgaaattgatgtctcatcacaccacactgccatgagaagtcatttctccttcctttatgagtatttcatttgctatatctccctctgttcctcctagtttttgttgttttttaagctcctcctgggaactcctgttatgggatggattgtgtccccccaaaattcatgttgaagtaaccctcagtaccataagaatgtgactgagttggatatagggtctttaaagaagttactaagttaaaatggggtcattattgtctactttcattcaatgtatttctattattcttggaaattcttacatactgtacttcaaatgttgctttagtagtctttccctagattctggaatttctattagataagtgatataacctatcagtctgtgcctttttgtttttaaatgtatattttttatttctaatatgtcaaaacagatcttttaaaaacctacttttcttgttttattgccatgttttgtttcgtagtttattgttatgggtagtttataagcatagtttatatggattttatgtcttcatttatctccctgggccctactccaatatgactgatatccttataacaagaggaagtgagaacacacacacagagaaggaggaccatgtgaagacacagggagcagaccgccatgcaggagccaaggagggaggcctcagaacaaacctcctctgccaataccttgatctgggacttctagcctccagaactgctttttttttttttttttactttgtataaatgtaagaggtacaaatgcaatttacttacatgtatatattgcatagcaatgaggtcttggtttttagtgtatccatcattagaataacgcacattttaggccaggctcagttgctcatgcctgtaatcccagcactttgggaagccgaggcgggaggattgctggaacacaggagttcaagaccagcctgggcaacataatgagacccccgtctccacaaaaaataaaaaaaaaaattagccgtgtatggtagcacacacctgtggtcccagctactcaggagtctgaggtgaggaggattgcttgagcctgggatgtcaatgagctgtgatcgtgtcactgcactctagcctgggtgacagagtgagaccctgtgggaaggaaggaagggagggagggagggagggagggaatgaataaggtacattgtgcccatgaagtaatttctcattccccacctctcatatgcccagcaacccctccaaatctcacgtgtctataattccacactctatgttcatgtatgcacattatttagctcctccttataagcgagaacatgccgtgtttgactttctgtttctgagttgttttgcttaatataatggcttccaggtccttccatgatgctacaaatgataaaatttcagacttttttatggcagcctctaggactgtgagataaatttctcttgttcaggccacccattctgtggcactttcttatgatggacctagcaaagtaatatgcccaattcattcacagatttttgcacctggttctcagattttctttcaacccagttccctgccttcttcccggatgacttcaatgtccagagaaatggttcattcaagaccttagtaatttaataatccccaaggttcttcttcactcttccagagccatgcaccccaaggacattctttggttttcactcagaactgtttcactattgaaatgacacattcacctttccagcaatctcagtcattttttcttttttgagatgggatcttgctctgtcacctaggctggagtgcagtggcatgatcatggctcattgcagcctcaacttcctgggctgaatcagtcctcccatctcagcctctccagtagctagaactacaggcatgtgccactatgcttggctaattttgttgttgtttattttttttagagatggggtctcactgtgttgcctcgactgatcttgaactcctgggctcaattgatccacccacctctgtctcccaaaatgttgggattgcaggcataagccaccacatatggccaattatttttaatgtactggttctttaaccacttcgtcatactggctgttatcttctagatgttctccctgtatatagggcaactattttcgtgaatttctcccaccttgcttagcctgcatgacccattccttcaacaaaactctgccagcagccctaaccctcttgtccttttgtctttctgctgcatcttctcagcaaacctaagacctggataaatccaaatgcctcttttccatgtctgcaactaggacacattataatttgtttaatgattgttgggcatgtggagattgtttctttttatactactaagactgtgattaatatcattatacatgtatctttgcgtgtttctctgcttacttaagctaaattcctagaagtgtagttacaggattaaaaggcttaagactttggaaaaatgacatcaggttgcctttaagtacatttgtaatgatttcccattactgatatatgagaatacagtatacattttgttgtaaacatcccaaagtagagaaaaatgagtttaaaattttaaatcaacataaaagatgaaaaatgacacttcatggctagggagataacagacttatgtttattgacaacttgttttcctgttttttttttctttttttgtggagtctcgctctatcgcccaggctggagtgcagtggcaccatctatgctcactgcaacctccgcctccgaggctcaagcaattctcctgcctcagcctcccaagtagctggaattacaggtgcccacctccatgcctggctaatttttgcattttcagtggagatgggattttgccatgttggccaggctggtttcgaactcctgacctcaaatgatccacccacctgagcctcccaaagtgttgggataacaggcgtgaaccagcacacccagccgcttaagattctttttaatggactttgtaagagatctttttttcttttctcatacatgattatcagatatattgttgacttaggactttcttaaattcacaagtattctatcttatgagtttgattattgtttcaataatctattatctgctgttcttgcacctgcagggctaccaattatacataaatacaggattttttccctttcatatttgtcatgttctttatttctgtgttcagctccattcttttcctccatattcttgaaaatcatctaaatattttcccaacattttattgatttttccacattttcaatactttttcttttagaattttatatgcagattttaaattatccaatacatgcctagttttcttctcctatcttcttattttatctagttcccttttcttctcttcctgtgtctcagacagcttctgaataatttcttgctatctttcttttcttgtttcatggcctgattaaattttgagatgacaaaaccagtattgctgacaatcttcttgtgaatcttgtagtagaccttttttgaggcatgtggttcttcttcttgaagatgacatttctcttttttgggtggcagaattttttctactggattcatttttttcctgtttctcttctttagtgagaaggtcactcttcagatccgcttttgctgatatacagggcaagcgaaatctccttagtgtctctaactcttcacctggtcactgttagaatttctctcccatgcagcagcctgggttattttatacagatccttttctatttcctgaggctggtggtcatttatatacagcatggctgtgctgcattgaggaaggatcttctgcctctcctgtcatctctctgtgtgaagaggaatttattttagattctctgaagcatcctacagatcatccctttccagaagtggtgcaagaaaaactatcgcctctccatctctgatggctcccacaactctttcttctttttctcatcttacaatagatttgtatcccaggattgatgtcccaccacaaatctgtctttgtagcccagaaataatgctccattagaaatcccccaccccaatcagatagtttttattgaaaacgtatgtgtccaaatgagtacagaaaagaagggcatacttttaattggtggaaataggtggtaaaggggccccagctgctgcagaacacagctcctatattaggttgatggcttttctcattttgaccagagaaagttcttaaactttctgtgatccctgggcagtggtggaaattgcctaatgtcctctccttaagttctgtccacatttggttggtatatctggtgtgctatgaaccagtatttcttatttccaatgctcttgtaattacgcttcttttttttttttgagaggaagttttgctcttgttgcctaggctggagtgcaatggtacgatcttggctcactgcaacctctacctcccaggttcaagcaattcttctgcctcagcctcccgagtagttgggaatacagatgcctgccaccaaacccagctaattcttgtatttttagtagagatggggtttcaccatgttggccaggctgtctcgaactcctgacctcaggtgatccacccaccttggcctcctaaagtgttgggattacagatgtgagccactgtgcctggccgattatatctttctttcagtgttattgtgagtatttcaatgagaaggtagaaaagggtgactataacaccactaatggtccttcaacttaatatggaagtctatatttttcttaaagttatagaatgtggtttaatgaagaattagtgatccttttacatgagcttcaaatatgtaagaaaaaaacatgattgaatttctacgaatgaaggctttcccctacttattacattttcagtatgttttagttgatatagatgtgtttattgtaagttacagtacattctcccgaattcctaagtctttacaggtcaccttcactctataaagaaacttgtggaaatggtcataatcagagttcgacagaactgataatgatcgactttcttcatattaccctgcttgtacttgcatttttcccatcttctatttcaagaggagccatagaatagtggtcaagaatatgaattctgaagccagactacccaaattcaaatttcaggccaacaacttctagctaccggcccttgggcaattttgcttaaccttcctgaattttcatttccttgggtataatgttggattgggaatgatatgtactccataaagttgatatgaatattaaataagcacatagttgtagaattttaaagcagtaatcagcatatggtaagcactatatatgtgacttttattactattagtgctttgtgataaatttaggactatttggcaatttctatgaaaaagtgatgttttcattaggttgtgtgtaaacctgaatggtaacagaagcctgcgatgtaaaagctggagggaagaccattccagaaagaaaaaaacaacaactgtaaagaccctgagataggaatgaatttgtcctgttcaagaaacagcaaggcctgagtaactgtcattgctgggtggcagtgaaatggtacacagtcctcgatgcacataaatactatttatttaatgtaccaaaataattgatgcatgctgtaaagcacccaaaagacatttatgcaaaagacattatatatgggaatgatctgactgatgtttacctttttatgtatgctattcatggtgaaggcagatctaacactctgttcctattaattcttttttttttcattttcttctaggaatttgtaacagaaaacccaacatctgattcaaaaataatagcttctgtttattttgtcccaataagcagtataattcttcgttgcaaaaacagaaaagcagcttaaattgatttaaacttaatgggtaatttattattataatgttgaggtgtctctcagaatacaagggtagaatacaaagggtaacttaggtaccctaaggggactcccacaccattgggactttattttattttattttattttattttattttattttattttattttattttattttgagatggagtctcactgtgtcacctaggctggagttcactggcaccatctcagctcactgcaacctctgcctcccaggttcaagctattctccagcctcaacctcccaagtagctgggattacaggcacgtgctaccacacttggctaacttttgtatttttagtagagatgggattttgccatgttggccaggctggtctcaaactcctgtcttcagatgatctgcctgccttggcatcccaaagtgctgggattacaggtgtgagccaccgtgcccggcataggactttctttctttatatctgcatatctgccttattccctcttactgcagaccagttttctgttttccaatctacaagataggggaataaatggttctgccaaaaactcctaagttcaaatattctcagttcaagaagatcaccagacggctctccaaatttccagaaacaacaataattggctgagtgtgagttggattttcacttttgggccaaccacagtcattatacagataagtcggaaaaaaaggcagtcttcaaaacaggtggtggtgatatggagcgagtgctgggtagacaagataaccattctgctccacacatattctcggattaatccttcatcacaaacttaagaggctaagaaataatttgccctccatcactcattttaccagtaaatagggatgatatttaaatcctgaactgaactacttcaaaactcatgttcttaagtaccacactatgtaaccaacttttaattacatggtggtgaatgaaatgttagtgccttcacatgatgacataagtgagtttggggttcaagaaggaattatacattaagtcatctctgttgagactattttaggataaaatcatctattatccaagcagaagagtttccaaaatggactttaaaaaatacaataattagaatcttcagatctactgcagggaagcactcacctgtcacaacaattctaagtttgaacactgatatgaaaggaattaagttgtaggcaatcagaaaatttcaagaaatgtttatttctgacaaagaaccaagtaaaaattattatcttggttttgagagtatttctaaaagcaaacatcactgggcagaagttgaggaagacttccagtatgtgaaaccacttagggttagtcgtgaagtggaatcacttctcaaatattatcaatgtaaatgtttctactttactggtcaaagagacaaagtttgaaatttgaatgattttgatttagtctatcttactatgtaaaatttgtattatatgtggtagaatcatgctatggccattaagatattctttgtattattaaaaattacagcaaggaaatcaagtaaaacagtaatatcttaagtaatttagtagatcaactcgaaatagtcctacccccaaagtgggttctacaaacaagacagttatttctttctaatatctaagcctttttccaactcccagtgctaatagatgatttttatcctaaaataatctcaacagagatgacttaaaaatcaatccctgttcctccctgccttcctctctgatcctgttctcccaagtgttttcagccagtttccagaagtgcaggtctactacttggtgctctttaacatcttaccatttgacgaggacctgttccattggtccctccagatccactctgtccttcctaattctgctctctacttggaatggctaatttcagttgggtttggccaatggtgatacccagcaagaaatcagagagaaggaggatactgggataagatctttgttgactatgttcttctgtataggcagggtgataatggttgacctgttcccttggcgaaaacctatgtaagtttctttgggtcttttttcttgaactggtcagatttccaaaagaaaattcaaccgatctcttcctaaccaggcaaacttggttaaaatacaatatacatcaaggaagagggcttgagggtcttaacattccgtaaataacctttgatttaattctccattattcagcatggtaccttatctttagtggtgtatggagtccaccagtctagagatcctctgctttaacctttctagagaattaatacaccattatatgttggcatggggaagagcagctgtatagctacaaggtatgaaaatggataaatgaggattttactgctttttaaatattttcaaccaatctttttatgtttagcaaccccctcatttccacttataaaggaacccagtgttacaatttcttgagccttctggtatattttgagatgtcactgtgttgccactttgtttttcctaccagattagaatccagctttctacatttgccagtggtttctatcttcccttttattctctttgtgagtttatgccttttaaaaaaatccctttattttcattgttctggggtttgagaagtgagtagaataaaagactattttcaatccactgtctttaaatctccttaactcttactctccttcagcctactgaagatatagcttctctcccctacaacactcaaatattccttgctgagttactcatgacctgtgttgtcatattcaaaacacaagcccagttttcattttacttcacacttcagcagcatttgtttatgttcaccagttacctttgtaagaatttagcttctgaatttcaagataccatattctcctggttttctctatctcttttgttccttccttgtcaatatcctctgcaagatatgcacatcaatgttggagtccctcaaggcttggttctaggtcctcttttcttttctttttttttttaatttgtggctcaacgtttaatttttttattgttattatactttaagttctggggtacatgagcagaatgtgcagttttgttacataggtatacacatgccatggtggtttgctgcacccatcaacccatcatttacattaggtatttctcctcatgctatcctcccctagccccccgcacctcgacaggcccaggtgtgtgatgttcccctccatgtgtccgtgttaaccttgttcaactcccacttatgagtgagaacatgtggtgtttggtttttctgttcttgtgatagtttgctgacaatgatagtttccagcttcatccatgtccctgcaaagaacatgaactcatgctttgttatgactgcgtagtattccgtggtatatatgtgccacattttctttatccagtctatcattgatggacatttgggttggttccaagtctttgctattgtgaacagtgctgcaataaacatacatgtgcatggtctttatagtagaatgatttgtaatcctttgggtatatgcccagtaatgagattgctgggtcaaatggtatttctagttctagatccttgaggaatcaccacactgtcttccacaatggttgaactaatttacagtcccaccaacagtgtaaaagcattcctatttctccacatcctctttagcatcagttgtttcctgactttttaatgatctccattctaactggcatgagatggtatctcattgtggttttgatttgcatttctctgatgaccagtaatgatgaacattttttcataagtttgttggctgtataaatgtcttcttttgagatgtgtctgttcatatcctttgccaactttttgatggttttttctttttcttgtaaatttgtttaagttatttgtagattctggatattagccctttgtcagacggatagattgcaaaaaatttctcccattctgtaggttgcctgttcactctgatgatagtttcttttgcatgtggaagaaagctctttaattagataccatttgtcaattttgccttttgttgccattgcttttggtgttttggacatgaaatctttgcccatgcctatgtcctgaattttattgcctaggttttcttctaggatttttatggttttaggtcttatgcttaagtccttaatccaccttgagttattttttgtataaggtgtaaggaaggggtccagtttcagttttctgcatatggctagccagtttttccaatagcatttattgaatagggaatcctttccccattgcttctttgtgtcaggtttgtcaaagatcagatggttgtagatgtgtggtgttttttctgaggcccctgttctgttccattggtctatataactgttttggtaccagtaccatgctgttttggttactgtagccttgtaagatagtttgaagtcaggtagcatgatgccttcagctttgttctttttgcttaggattgtcttggctgtgtgggctctttttgggttgcatatgaagtttaaggtagtgttttccaattccttgaaggaagtcagtggtagcttgatggggatagcattgaatctataaattacttcgagcactatggccattttcacaatatggattcttcctatccataagcatggaatgtttttccatatgtttgcgtcctcctttatttccttgagcagtggtttgtagttctccttgaagaggtccttcacctcccttgtaagttgtattcctaggcttttattctctttgtagtaattgtgaatgggagttcactcatgatttggctctctgtttgtctgttcttggtgttgtataggaatgcatgtgatttttgcacattgattttgtatcctaagagtttgctgaagttgcttatcagtttaaggagattttgggctaagacaatggggttttctaaatatatattcatgtcatctgcaaacagagacaatttgacttcctctcttcctatttgaatacgctttatttctttctcttgcctaattgccctggccagaacttccaacactatgttgaataggagtggtgagagaggtcatccttgtcttgtgccggttttcaaagggaatgcttccggtttttgcccattcagtatgatattggctgtgggtttgtcataaatagctcctattattttgagatatgttccatagatacctagtttattgagagtttttagcatgaagggatgttgaattttgtcaaaggccttttctgcatctattgagataatcatgtggtttttgtcattggttctgtttatgtgatggattccatttattgatttgcatatgttgaaccacccttgcctcccaggtatgaagccaacttgattgtggtacataagctttttaatgtgctactggattcggtttgccagtattttattgaggattttcacatcgatgttcatcaggggtattggcctgaaattttctctttttgttgtgtctctgtcaggttttggtaacaggatgatgccggcctcataaaatgagttagggaggatctcctctttttctattgattggaatagtttcagaagaaatggtagcagctcctccttgtacctctggtagaattcagctgtaattcggtctcgtcctagactttttaggctattaattactgcctcaatttcagagcctgttattggtctattcagggattcgacttcttcctggtttaaactcgggagggtgtatgtgtccaggaatttatccatttcttctagattttctagtttatttgcatagaggtgtttatagtattctctgatggtagtttgtatttctgtgggataccccctttatcattttttattgcatctatttgattcttctctcttttcttctttgttattctggctatcgctctatcaattttgttgatcttttcaaaaaatcagctcttgcattcattgattttttgaacggttgttcatgtctctatctccttcagttctgctctgatattagttctttcttgtcttctgctggtttttgaatttgtttgctcttgcttctctagttctttcaattgtgatgttagggtgtcgattttagatctttcctgctttctcctgtggtcatttagtgctataaatttccctctatacactgctttaagtgtgtcccagagattctggtacattgtgtctttgttctcatttgtttcaaaaaacctcattatttctgccttcagttcgttatgtacccagtggtcattcaggggcaggttgttcagtttccatgtagttgtgcagttttgagtgagtttcttaatcctgagttctaatttgattgcacttgatctgagagactgttatgatttccattcttttgcatttgctgaggagtgttttacttccaattatgtcgtcaattttagaataagtgtgatgaggtgctgagaagaatgtatattctgttgatttgggatggacggttccatagatgtctatttggtccacttggtccacagctgagttcaactcctgattatccttgttaattttctgtctcattgatttgtctaatattgacagtggggggtgttaaagtctcccactactattgtgtgggagtctaagtctctttgtagtctgtaagaatttgtattatgagtgttcataacattcataaagtgttcatggaaccctttaccattatataatacccttctttatctcttttcaaccccaaatgcccactcagcatctctatttacatgtcaaaacctttaaaggaatctcaaaattggtatgtctaaaactgaactcaggagtctcctgcaacacacataaaacacacactatctggcccaaatcatgggtctcttctggcattttatatttttgtgaatggcaccatcatccttgtgggtagacccatcaggggtctttctcaacacctccctttctctcatcccacatatccaagcatctccaacttttcttgcttttacctcttatatatctattgaattatcacttggaggacagttactgtctgccctggagagtcacatggctccacagtggattttttgtgaacaataaatatacctttgttgttacaagaaataaaatgttgacattgtgactgcagcactatttacctcatcctcactaatacaatatatgtcatggtttgtaattacacattgctttgagttattaacttaatatattcctctttgactaaattattagctctagtagtgcagaaattgtgtctattttctatttccccagaacctggcacagtcctaggacaaagaaagtgctcagagagtatgttagatgaaagaatggggaaataagacaatatggagctaaatactgttgttgatacaattcttcataattagcttgcattaagtgttggtagaacaactgaataaatgaagtagattttgctattatttataacattttatcaatggaagccttaaaatatataaatctccaatctaaatccagggactaatgttggaaatgtgctagaagcttgggctttattttctgggaaccagtttttacttacataagcaatcatcatccatccacatttggatgtagcagagcttcaatatctgctagttctggtgaaaagttctttgcttatcctctccttggggcaaggaccctagatctgtgttgaaataaggggacgtgaggcagtggctctaaaatcacctggagtggcacctgattgatacagtgttgctccatcaatccctcctaaggaatattctcaaagttggtgtcaggataacatcctcctaaatgcagctgagcttcgcatctcactctctgtgagttaatgggtgcatcaaaccaatatagcacatgtatatatacgtaacaaacctgcacgttgtgcacatgtaccctagtacataaagtataataataaaagaaaatacataaaaataaaacttaaaaaaaagagttgctctcaatggatttcctgaacctttcatctctctgtctactttccctctcattccctagaactggtcaaaagactttctgttctaactcagtcttggttgtgatggtccatgttctcccaatgtgaccgtctttgattgaccttcctctgtccttctaagagttttctgccaatttccaggtacttataaacattcatgcgtacaacagacacattgcaatcttgcttactttctaacctgaatagcctataaatccatccttcagagactgcaatggatttttttattgtgtgttcaaaccaggaggctatttttaaacacaatttacaaattggactttggaaaataaggtggaccaaattctagcctttacaacgaatgcctgagagtccatcccattaaagagtttttaattaaaaagaacaacccacaggtgccttattgttctaacatacaggatcactcagcagcctctgaaagaaacagaatagttcactccatggttaacatcttctagataaatttaaccctagctaacagctgggctggccattacaggctaaggtaattttgtttgaagtgctaccagctcctcactttcatgtttaagtctcccagaatagcacagagaagagtaatcatggcctcaattcttttatttcctcccaacactattttaatgagaatttcaaagaatgccagctgacaatttccactgtagggaaaaaaccagatgcagaaatgcaaacagggagaggatgattttcctctgcactactcaactgtgatctttatgaagaggcaaagattgacacacctttgtgggcccagtaccagctagagtatatcaaacacagtagcctttcaacaaatgtttgttgaataacatttatacaagatttggtagtgctttcaattaataaataaattaacaaatctcagaaagagaaactccctgtattagtctgttctcacattgctataaaaaactacctgagactgagtaatttatgaataaaggaggtttaattgactcacagttctgcaagctgtacaggaagcatggctggggaggcttcaggaaactcacaatcatggtagaaggtgaaggggaagcaggcacatcttaaattgacagaaaaggaagaagagagtgaaggggaatgtgctacacaattttaaacaaccacgtctcgtgagaactcactatcaatgagaacagcaagggggaaatccacccccatgatccagtcaccacccaccaggcccctcttccaatactggggattacaattttttttattattattatactttaagttttagggtacatgggcacaatgtgcaggttagttacatatgtatacatgtgccatgctggtgtgctgcgaccattgactcgtcatttagcattaggtatatctcctaatgctatccctcccccttcctcccacctcacaacagtccccagagtgtgatgttccccttcctgtgtccatgtgttctcattgttcaattcccacctatgagtgagaacatgcagtgtttggttttttgtccttgcgatagtttactgagaatgatgatttccaatttcatccatgtccctacaaaggacatgaactcatcatttttatggctgcatagtattccatgatgtatatgtgccacattttcttaatccagtctatcattgttggacatttgagttggttccaagtctttgctattgtgaatagtgccacaataaacatatgtgtgcatgtgtctttatagcagcatgatttacagtcctttgggcatatacccagtaaagagatggctgggtcaaatggtatttctagttctagatccctgaggaatcgccacactgacttccacaatggttgaactagtttacagtcccaccaacagtgtaaaagtgttcctatttctccacatcctctccagcacctgctgtttcctgactttttaatgattgccattctaactggcgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagcaggttgtgaaaattttctcccattttgtgggttgcctgttcactccgatggtagtttttttttgctgtgcagaagctctttcatttaattagatcccatttgtcaattttggcttttgttaccattccttttggtgttttagacatgaagtccttgcccacgcctatgtcctgaatggtaatgcctaggttttcttctagggtttttatggttttaggtctaaagtttaagtctttaatccatcttgaattaatttttgtatcaggtgtaaggaagggatccagtttcagctttctacatatggctagccagttttcccagcaccatttattaaataggaaatcctttccccattgcttgtttttctcaggtttgtcaaagatcagatagttgtagataagcggcgctatttctgagggctctgttctgttccattgatctatatctctgttttggtaccagtaccatgccgttttggttactgtagccttgtagtatagtttgaagtcaggtagggtgatgcctccagctttgttcttttggcttaggattgacttggcgatgcgggctcttttttggttccatatgaactataagtagtttttttccaattctgtgaagaaagccattggtagcttgatggggatgccattgaatctgtaaattaccttgggccgtatggccattttcacaatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttgctggtgtataagaatgcttgtgatttttgtacattgattttgtatcctgagactgctgaagttgcttatcagcagaaggacattttgggctgagacaatggggttttctagatatacaagcatgtcacctgcaaacagggtcaatttgacttcctcttttcctaattgaataccctttatttccttctcctgcctaattgccccggccagaacttccaacactatgttgactaggagtggtgagagagggcatccctgtcttgtgccagttttcaaagggaatgcttccactttttgctcattcagtatgatattggctgtgggtttgtcatagatagctcttattattttgagatacgtcccatcaatacctaattttttgagagtttttagcatgaagagttgttgaattttgtcaaaggccttttgtgcatctattgagataatcatgcggtttttgtctttggttctgtttatatgctggattacatttattgatttgcatgtattaaaccagccttgcatcccagggatgaagcccacttgatcatgttggataagctttttgatgtgctgctggattcggtttgtcagtattttattgaggatttttgcatcaatgttcatcaaggatattggtctaaaattctcttttttggttgtgtctctgcctggctttggtatcaggatgatgctggcctcataaaatgagttagggagtattccctctttttctattgattgcaatagtttcagaaggaatggtaccaattcctccttgtacctctggtagaattcgcgtgtgaatccatctggtcctggactctttttagttggtaagctattgattattgccacaatttcagagcctgttattggtctattcagagagtcaacttcttcctggtttagtcttgggagggtgtgtgtgtcgaggaatttatccatttcttctagattttttagtttatttgcgtagaggtgtttatagcattctctgatggtagtttgtatttctgtgggattggtggtgatatcccctttatcattttttattgcatctatttgattcttctctcttttcttctttattagtcttgctagcagtctatcaattttgttgatcctttcaaaaaaccagctcctggattcattaattttttgaaggatttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataagtttccctctacatgctgctttgaatgtgtcccagagattctgatatgttgtgtctttgttctcgttggtttcaaagaacatctatatgtctgccttcatatcattatgtacccagtagtcattcaggagcaggttgttcagtttccatgtagttgagtggttttgagtgagtttcttaatcctaagttctagtttgattgcactgtggtctgagagacagtttgttataatttctgttcttttacattttctgaggagtgctttacttccaactatgtggtcaattttggagtaggtgtggtgtggtgctgaaaaaaatgtatattctgttgatgtggggtggagagttctgtagatgtctattagatccgcttggtgcagagctgagttcaattcctgggtatccttgttaactttctgtctcgttgatctgtctaattttgacagtggggtgttaaagtctcccattattatcgtgtgggagtctaagtctctttgtagttcactcaggacttgctttatgaatctgagtgctcttgtattgggtgcatatatatttaggatagttagctcttcttgttgaattggtccctttaccattatgtaatggccttctttgtctcttttgatctttgttggtttaaagtctgttttatcagagtctaggattgcaacccctgcctttttttgttttccatttgcttggtagatcttcctccatccttttattttgagcctatgtgtgtctctgcacatgagataggtttcctgaatacagcacactgatgggtcttgactctttgtccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacaatttggcatgatttcacagtggctggtaccggttgttcctttccatgtttagtgtttccttcaggagctcttttagggcaggcctgttggtgacaaaatctctcagcatttgcttgtctgtaaagtattttatttcttctttacttatgaagcttagtttgggtggatatgaaattctgggttgaaaattcttttctttaagaatgttgaatattggcccctactctcttctggcttgtagagtttctgctgagagatccgctgttagtctgatgggattccctttgtgggtaacccgacctttctgtctggctgcccttaacattttttccttcatttcaactttggtgaatctgacaattatgtgtcttggggttgctcttctcgaggagtatctttgcggcattctctgtatttcctgaatctgaatgttggcctgccttgctagattggggaagttctggataatatcctgcagagtgttttccaacttggttccattctccccgtcactttcaggtacaccaatcagacgtagatttcgtcttttcatgtagtcccatatttcttggaggctttgtttgtttctttttattcttttttctctaaactttccttctcgcttcatttcattcatttcatcttccatcactgataccctttcttccagttgatcgcatcggctcctgaggcttctgcattcttcatgtagttctcaagccttggctttcggctccatcagctcctttaagcacttctctgattggttattctagttatacatttgtctaaatttttttcaaagtttttaacttctttgcctttggtttgaattttctcctgtagctcggagtagtttgatcgtctgaagcattcttctctcaactcgtgaaagtcattctccgtccagctttgttctgttgctggtaaggaactgcgttcctttggaggaggagaggcactctgctttttagagtttccagtttttctgctctgttttttccccatctatgtggttttatctgcttttggtctttgatgatggtgatgtacagatgggtttttggtgcggatgtcctttctgtttgttagttttccttctaacagacaggaccctcagctgcaggtctgttggagtttgctagaggtccactccagaccctgtttgcctgggtatcagcagcagtggctgcagaacagcggattttcgtgaaccgcgaatgctgctgtctgatcgttcctctggaagttttgtctcagaagagtacccgtctgtgtgaggtgtcagtctgcccctactggagggtgcctcccagttaggctgctcgggggtcaggggtcagggacccacttgaggaggcagtctgccggttctcagatctccagctgcgtgctgggagaaccactgctctcttcaaagctgtcagggacatttaagtctgcagaggttactgctgtctttttgtttgtctgtgacctgtgcccagaggtggagcctacagaggcaggcaggcctccttgagctgtggtgggcaccacccagttcgagcttccccactgctttgtttacctaagcaaacctgggcaatggcaggcgcccctcccccagcctcgctgctgccttgcagtttgatctcagactgctgtgctagcaatcagcgagattctgtgggcgtaggacactgccagccatgtgcgggatataatctcctggtgcgcctttttttaagcccatcggaaaagcgcagtattagggtgggagtgacccgattttccaggtgctgtctgtcacccctttctttgactaggaaagggaactccctgaccccttgcgcttcccaagtgaggcaatgcctcgccctgctttggctcgcacatggtgcgctgcacccactgtcctgcacccactgtctggcactccctagtgagatgaacccggtacctcagatggaaatgcagaaatcacccgtcttctgtgtcgctcaggctgggagctgtagactggagctgttcctattcggccatcttggcgctctctcagggattacaattttatatgaaatttgggtagggatgtgaatccaaaccatatcactccccatacgatactgacttgagatagacttcaggggtcagaacatcttattcctcagactatgagggatttttttgtcacctcttctgagcatcttttcaaatagtgctgataagttcactttgttcattagagagaaaaaggacaggacgaaataggagaccataaataggaaggaatgagaataaaatggtcaattaaggaaaggattttctgaaagcaggccctgtcattaataatgatgatctctagctgtaattaaaacacctttgtaaatgtattcatgcccttgtgcctcagaggtgaggtcttcaagcctgtctctatatcacaatcatctggagaatgacaggtccatgttaaaggtattaaatcagaaggtctagggtcggggcccaggaatttgcattttataataaacggtttgcacgcttttgatgcatagctagttaggaaaccacattgcctctaagaatttctgtgagtggagtgacatctctcaacctttagaggagtggggaatcttttcttgagaactttacaaagaatcagctataatatattagaaggagatagctatttagatttatggatgaatgtatgttcatatatatgtatgtatttatagaggaaactatagatatggttgaaattccttctaatttaatagttagaaacagtgaaaatgccattttattaagttatatgtcaaaaacatttaaatatttcaatctggttaaaaaaaaaaaagaggggtgggccagagacttcaagtaggagacagcagctgggagacaggccaagaggatcagatatggaaggggaggaagaacaaagttgtgctacttggtaatttctctagaatacagcaggaaagagggccaggaaaggacaactgtgaccactcaagaaacgggagccaaggccggatcttctttccttggctcttctctgggctctgacttaatcctgccaggtctcagtttcttctcctgaaaaatgagctggatggggaagagcagtgattttcaatttagcctgagaatgtgccttgctgtgtcatcatttcagcatagtcgtgaggaacccagcatgatgacagttgtaattttagtgttcactgatttaaaaattgatgatacctaaagaactataaacttagaactttttaaaattatatttccttttattcaccacaacagcatatatatatgctgtatatatatatatacacacaaacatatgtgtgtgtgtatatacatacatataaatatacacacacatctttagagcagttgtatacacatgtctatagcagatatcagtatcattgcttgaattcttgctttttgaaaaaaacaacttgaatctgactctgaatatcataaaaatgattctgttagtataatcataagtctaatttcagtcataatcgggctccccatcagtcctaggatccctccagtcttcaaccctcactgattgccactgaaatactcattgtcccccaccactcggtccttttacagttgcctcatctgctggttctctgggcgtggtgccctttcaagtctaaaagacctggttgtaggtgtcacctgccaagacttaagagacatagtagaaaactctccatcttatgattctattgctcttccagtctactgtacaatctcaaaatcgtccttacttagatataaagctaccacttctctttcctccctcgtaacttaatttctccaaggggtttagagtttcagaagataaaatgcaggaagaaatttaaacttattctaagccagtggagcacaaagaccctgactaccgtcttggaaaggagaaacacaaatgatttcaatatactataattccacatgtaatgtgtgtgtgaacccatatatgtatatgtctttgtatatgtgtgggtgtatacatatgtatatgtataacatgtgaaacttgttacatttatagattggtggtttctttgttatggacctaaagcctgtggattgggaacctctggactacacagtctctaagatcctttccagccttaatattaagtgcttctgggatctctttgccctttggcattgactttgattgagaattgctgcaacctacaacttccaacaataggcactaaactctctatatgtaatgataatggtaacttgaatggaattgtcattgttgattggttgatttattttctaatctaggttgaaataaaaatatatttggtgtcatattttgcaaaataatggcacaaccttctactaatcacatgtcttgaagcattccttgctctagggacacccaagggattaccactatctacaatagtcagactatggctgtagtgacatatgggattcatccacatgtaaacagttgttcttcaatatttcacatttaaatacgaactttgttacttttggccatggcatgttgcaaaggtttctacacaaagaataaatcaatgtgtactttagaaaaggtcatatgcttttagcaaaatttctaagtatagaaacttacaacatttttagagatgagtttattagcctcattaaagtgtcactgtgtttagactcaaatgtctaaaatgactttgctgtgatccctcttttttttttttcttggcagccaatacaaaaaacaattactcagagtcacagacctgtaagacttgccttttggtattagaatatcatgtagactttcaaaggtgtatgcactccttgtcatatgctcatttgagtaatggcatttgcagcaacaatgctgacatagtcacttgtctatgtataggagggctgagagcgagcaggaatattgatgtgcccaagctagtcctgcccctcgtacgttctgatttccatggcctcctcttcagagcagggagcagctacaggattgggcctcatgagcagctctgggcagggctctccttgccttcttgtgctggtctttgtgactttatcttccttaatgcagctgaggtaaatgcacatttttttttttatcttgacgctaaactctaactgaccttaatggcaaaatctttacaaatttatacctctggtttcctaggtgataatttaacgtcattactccttgcttctaacctacttggaaactattccatttcactttggtcttctgtgtagtatgatttccattatgtaactcccatcagagctgacaagattcccttgccccatgtaaaaggtatataatttaatgacaatattatacattgtaatgaaatgtttacatgtcagaacatatattttaaaataaataggttaaaaaacagactttggagttaggaattgttattctaactcatttctttcttcctttatgtgtaaacaattcagatatgcagttttaaaaaagcaaatacattactactacattaataataaaggaattgttgtagagataatcataaagatgatgttaactgttattaaggtttgcttttaacctgctatgggcaacataaaagtcatgaaacattaaattttttaaaaatgttcttgtgtatttttttttctgggaaagtgctctccattcctgtgttatacagagatcctgactctttatttttctttttttctattttgttttctcatcttttctcctctctttttctttccttcttttgttttctttcttttatttttttcttttctttttttgagatggaatcttgctctgttacccaggctggagtgcagtggggggtcataattcactgcagcctccacctcctgagctccagcgaacctaccacctaagcctcctgagtaattggaactacaagcacacaccaccgtgactggctaatttttgtattttttgtagagacggagtttcaccatgttgtccaggctggtctcaaactcctgggttcaaacaatctgcccactctggactcccaaaatgctgggattacaggtgtgagccactgtgcctggccagatcctgacttttgaaagttcctggtagcttctatcctgtttagtaacacaggcaggagatccacatcaagaaaggcaggcttggtaaaatttcaagtgaatttggaatgaatgatgaaacacacagacacagtgactttatagtagtggttttctgagctataagcagtgagataggcagaatgaactccaaagatgtccatgccctgattcctgggagctgtgaatatgttacattacacggtagagaggactttgcagatgtaattagggtcacatgctttaaaatggagggattatcctggattatctgtgtgggcccagtctaatcctatgaatttttgaaagtagagaactttctccagtttggattagagagatgtggcagaaaaggaagtcagagaaattcaaagcttcagacatactcgactcaatgtttctggctccatgatggagaggccaataggacgaggatgcaggtggctttaagagtctgagagaagctcccaactggccatcagcaaggaatttggacctcagtcctgcaactacatgaagcaaatttttttcagcagatatgaacctggaaatggattcttcccccagagcctccaggccagctgacacatggatttcctccttgtgagcctcagagcagagaaatcaattgagccaccaggacttctgacctacagaactatgagataacaaattgtgttttttaaagctgctaaatttgtggcaatttgttatgacagcaatagaaaactaatataagtaggaagctgtgaccagagtcatagactttagttctgaactggtcaatattgtgaagatgaaacatcttcattgattatgaataggattaacctgttagactacaggtctgggtctgggtactgagatgcatttaggtgagttcatagcagtctagtatgttcagtggctcccaaagagttggctggcattttatacctagtttatctttgtctagcttcttttaatccatagtaagctgtgattttgccccagtattaaagaaaaatatgaataaacatgaacctctatttcagtggaattttaatgcacagattataaatatgcctgttgtgcatttctaagttaaattttaaaataaagaattggaggtcaaaaattaggcagagagagagggatcaatgaaagttgtccatacagagatacttgagtatttgagatgattcacaaatatccataactcttgttgaccaaacacatgttgttcttgaccaaccagagcttttatctctctctttggagccgaatgtctctcaggagttatattttcagattatagtttaagatatagggaaattttgtaattacttatacttttatccaaacagattgaaaacagtaataaaaattagtagacaagaagttcaggttgtaaagatccaatgttaaattactggagaacaaaattcccaatgaggagagtggcagacaaagaaatcaaaatggtaggcagggggcagatcacagaggatcttgtaggccaaggtaaggattttattttgttctgagggaagtaagaaagttttggagaggttcaagcagaagcaagatattctaactgcttttctgtttttcttcttgccttgatgctacattccttgaaaaatattaatatttaccatttcttcttctttattctttgctctgaaagccattgaagtcagaccttaacaaggatgaggttgcctccaaattaccaaattcaacatctcttttcagtgttatgtttccagattcttagcgacccttaatacctttgacattagcttccattctgaaattttcttcatctgtttataacctacttccagtcattttggccctgttagctctgtgaccctggggatactgattcatgtcactgttcttcagtttcctcatctgtgaaatggggaagtaattgtaacaacttcaaagggacattttgagagtaataagagataagcactcaatgcatattaacgattgttacatcccaaaccaaactcccgatcttaattcctctcccagaattgctcttcctccattagtggcatcgctacctgctatggtttgaatgtgtctcctccaaaattcagtgtttccattgtgatagtattaagaggtgggacttttaagagctaatgaggctatgtgggcttttccatatttaatgagattaagaccctttcaaaagaggcttcacaacatttaggctggcttgatcttttgctcttttgctcttctgctatgtgaggatacggttcatcgtctcttgcctttccatctcttcctccatgtgaggaggcgcaagaaggtcctcaccagtcaccaggtgctgacaccttgatttgtacttgccagcctccagaactgagataaataaatttctgttcctagtaaattacctagtctgtggtattatgtcatagcattacaaatggacttaggtactatctaaaccagaaacttcagagccacccttgatattgatgtaatcttgtagattttacctctgagattctcccctttatttatttctactgccatggcctcttccttccaagcacatgtacacatacacacacagctttccttatattacactctggccatactgaactactatgccagctacttaactcctctgcacattttgttttgactttcagtagtcctttagtgatctcactgcctcttgtctgtaataaaaatgaaatgacagtaggaataaatgcaatggtttaccttgtgcctgcatacagtatattaaatgctttccatacatgattattgagtactcacaaaaaccttgtaaagtagttattattattattattattattattattattcctactttacagaaaaggcaaccaaaacagaggaattacataaaaggtcacactcaaataagcagtagagctgggatttgagcccagatacacctgatgtgaaagcccaggcttttacactatgctcttattgtgccctgaaatgaacttaccttgacaaattctcttaaaatttttcttacttgtatatcttatgcctgtgataactgtccgttttgcacaggacaagttaatgttccttagcctggtatgaaagacccttcagtatcttctctcaattgatccctgtaaaatttagtttatgtccttgtttttatttaatttttatatacttgcagttttactgtactttcttttatattatatttctaatttattctagattttttccattctcctcttcctcagtacacacaccaacacacacacacacacacacacacacacatgaatacccacagtactttcagcttgggaaaaattcttcctgaatttttcccgtatttgtacagacctgtacaaatataaatacacatgaatagggcttttgtttgtctgtagcactggaaatattatatgcatgtattagtcagggttctccagaaaaacagaacaaatagactgtacatagttatatatagagagaacattatttattttaagaaattgactggcatgactatgggggctgacaaatccaaattgtgcagagtaggctggcaggctggaggccaagggaaaagctgcagtcatgaatctgaaggcagtctggaggtagaattccttctgtttctggggaatctcagcttttttcccttaagaacttcaactgatttgatgaggcccacccacattatgaaggataatctgctttattaaaaatctacttatttaaatgtgaatcacatctaaaaatactttcacagcaacattgagactggtgcttgaacaaatatctggaaaccacaggctataaaagttgacccataaaattaccaccacagtgtatttctttataacttgcttttttctcaccaacaaggtaacattgacatcccttcatatcaataattacaatattcacctttccatcagcagcatgtgagagaatttttcctttgtcctggtcagcacagggcattagaattatttgtaattaatgcagatcaaatgaatgaaatatggcatcttactatacctttaatattaatttcccagactgtgggaagttgagcatctttttatttatttattaatcatttagcctctattctgtgaattgtattttgagaattaaatcatattccttgcccacttttccatttatttctattgttttttcttatcaatttttgtattcaagaatttaactctcaatatttcacgtcatttgcaaatactattttcctgtctgtcatttgtcttttgacattatttgtgaaatcattgaacattctaaatgtttttcttaaacttccttttataatccaaactgcctttttttttatagctttagaggtgcttaagttcttttgcttaagaactctgttttgttttttaatttttaacgtttaaatcttaatttagctagaatttatttttgtattctatataggatgaagtccaatttccttcccttgaaatagcttgtcaatggtgacagtaaaatttattaaggttattaaatttcaatgaaataaattttaacaatgggagaagggactaaataagccatcctttctccaataaattaaaatgccatttttgtcacatgtcagtttttcatagatattcaaatctttgtctggattctctattgatttatttgctcctgtgctggtctgattaaggaaactttataataaagttttatagctggcaaagcaaatcaacaacctcctcagcttcgaacatacatatgctgtattcttttttctcatgattttatatacttggagattccttcttccatacaaacatcaaattatttcacacacttccaaaaataaaataaataaagtaacctctgctgtagcaaagcaaaaacacaaccctataggattctgctggtggctgcattctatgatgtgtgatgtcggggggagatattgctgtgcttatgatattaaaccttctcatctcaatgaaagttgcttatctgttgaactgccatcatcatagttgcttcaggttgatcaagcctcagggagaactcctctgttatgtctagatgattctacagtactgattcaaaagcattctaataaaagtgggtgaaaatttagtaaaacaaaattttgtattttagcaactttctctgttttctaaagacatgatgtttcctgttagtacacccacaatttattatacgaaagagcaaggaatcccctcccttatgggagccaagatggtcaagaggatgtatttaatcttgctgatttctggagggcagctgtacccttttcccaggcttatctccccctcctgggaaggacccatcccaccgtgcaccctacccctgcttgggagagaaggtgccatcagagctcctctgatgcctctccctcttgcccatttgttcacctgctactctcccagcttggcagcactgtttcgagacctttgcattctgtagacccagaagccctcatgtcacagcagagacaacacaagttggccatacattatagagctcttctctttggtgcgatctcaggacaattttcttttttctttttctttttttcttttattattattatactttaagttttagggtacatgtgcacaatgtgcaggttagttacatatgtatacatgtgccatgctggtgtgctgcacccattaactcatcatttagcattaggtatatctcctaaagctatccctcccccctccccccaccgcacaacagtccccagagtgtgatgttccccttcctgtgtccatgtgttctcattgttcaattcccacctatgagtgagaatatgtggtgtttggattttttgttcttgcgatagtttactgagaatgatgatttccaatttcatccacgtccctacaaaggacatgaactcatcatttttcatgactgcatagtattccatggagtatatgtgccacattttcttaatccagtctatcattattggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccatcaacagtttaaaagtgttcctatttcttgacatcctctccagcacctgttgtttcctgactttttaatgattgccattctaactggtgtgagatggtatctcattgtggttttgatttgcatttctgtgatggccagtgatgatgagcattttttcatgtgttttttggctgcataaatatcttcttttgagaagtgtctgttcatgtccttcgcctactttttgatggggttgtttgttttttttcttgtaaatttgtttgagttcattgtagattctggatattagccctttgtcagatgagtaggttgtgaaaattttctcccattctgtaggttgcctgttcactctgatggtggtttcttttgctgtgcagaagctctttcatttaattagatcccatttgtcaattttggcttttgttgccattgctttggtgttttagacatgaagtccttgcccacgcctatgtcctgaatggtaatgcctaggttttcttctaggatttttatggttttaggtctaatgtttaagttttaatccatcttgaattaatttttgtataaggtgtaaggaagggatccagtttcaggtttctacatatggctagccagttttcccagcaggtctacggccataccaccctgaatgcgcccgatctcgtctgatctcaggacacatttctacatggttcttcatttcctgatggttcagccctgtttgtctttgtgttgctttttaccccttctcaacccacaaaataactcctgggtacatggttttctttgcttccaggaaagcagcccagatgtacggttactcagttaagccaggcctggcatgaaggattcaaagacagaccagcaaataggctgagcagagcctgggccaagattttcctgacccaagggcacagtgacactcaattcagtgcttgcattgtgcccagggctctaagaaagacaggcaaagagatttgccagaatctgtccttgcctgtatagctctttgtatggagatgtttttttttgtccatctgttaccaaatcatgactctcctgacagtcagcctgggtaaagatgcagtggttagctccttgtttcttctgaaggatgacattttccaacatctgcagcctgcatattgagcaaataaatggctgtcagttcactcagggagaagattcttcatttctcttgtgaccaacctctaggacacatggcagggcctgagggctgtctatccttcttgttagtagagcctcctggctctcaggcctgctgcgttgtcaggatgtttgcaaaatccctttattggatatagtagctaatacaatgttatcacttgatatcacaagttgaggctatcctttcccatatttttgaatatttgaaaaagtatcttgtctttggaaaaactagaatgttttataaaaatagacctgttctgatgtcaattttctgcctgaataaaagtgaatgaatattaaacattgctgcaggcagtcttgtcattggaattaaagattctctgttataataaataattctgtaaaaacacaaattttgtctaagcaatgctaagcacgttttttttataaatgtgttttcagtccagggtatatacatttgcagtgtaacgtgcaatcatgaaatgtagttttttttttttttttttttttttttttttgcataagtagcatatattttgaagtaacagcgttgctatctacctgttaaaaagtggtctagcagcagtatggaaaatagatgactctttccagtgggaagatggtatacgtcttgaaggaaaagtgagtcatatccagcactactaaattgttattcacttgaataacatattaggtctccgctgaaataaacgtgatgtgttctgtgagaggaacactggattcaagtcaacagacttgtttcaagtgggtggcagtgctgctgcttgctagctgtgtgacctcgaataatttatttatgctgtctgagcatctcttttattgactacaagtggaaagatcagaccagatgggacttctaaactgcattatttatacatgggcatgtctcaatcggtcgtgaggtagataatttattgctactagaaataaagtcctgacgtttgcaaacaacttacagttgtaacgcagataagtttagccccatgatgtcactctcaccatctcaccttctgaggtagtttcttgagtgggagagaagaaagagagtgagttatggttgccacactggtaagacaagtaccacggccgccaagaattccacatgattgatttcattatttgtgagcctatcaaatgttttcatggacactattcccaggaagttcctgggtatttgtcttgcttctaaacaaatatttttagtcaatatttagttaatatcttgttgacatctgagtgcattctgagaaaggaattcttccttaaataccgccagcatatgtaaactgtagtaaataattttctaacaacacaaattatgttgaagcaacgttaagcccaatttttcataaatatatttttggttcagagtacatacatttgcagggtaatacgtgaacatgaaatgtagctttttgcctaagtagcatatattttaaagtaacaatgtagctatctacccgttaaaaagtaggtaaaatccagctgggctggattgtccctagcattccttctgattagttactctctatgcaggaacacgtgaggattttcacacatccagagtgaagccactgagggaatagatgctgactatatccagaggtggaaatgtgtctggaggcagaaacatctctgtttttcctgctcactgcttggccataaagactgtgatttcctggggtttgaagtactttgagtttcaaattccatattttcatattctagatcttcttagcctctaggcatcttaacaaaggccatattgagtcaagccataatcagtccccaccttctactttcaccaaacacacacacttcaagaagcaccaggaaattgacaaggcaacaataaggaatggtgacatcagccagggtcgtggggacttagcccatctctggccagggctcattaccttatttactgtttattctgtgctaagcagggaggcaagttttacgtactttaaatcacctaattctcataacaacgcagtgaagtaggtaatattaatatctgcatttcataaatgggaatcctgaatcacagataaattaaggaactttcccaactggtagcaacaggcagagattcacccttaggcagtctggctacaaaatcaaggctctccctcagtcttctctgctatgtcatcagcaccctaagtcaattgagtttatgccagctgcttttacataactgtcctctgaagttgttcctattatccctatggtatatttcaggaagccaaggataagtgaaattaaatatgtgactaaggtcacatggctacaattattaataggcagtgaaagagctggaatttgaacttaggtttgtttttttttctttttcttttctttttttttttccacaaagctgcatactttcctccgtcctttcacatattgttttctgtatcttagaggaaactcataggaatgaatgtgaaacactcccagagttgtttttctggaaagattatttgtcttaactggttggagttttcatctatagtgtggcctcctttcctagtcacttgattactgtcattgtagttttgccaagctctaggctttgaatatctgctgaagagtcatttgttctacagcttgggatttacattgcaaatagaagagatagtcagtttctagtttcctctaccctatttttaggtactgaccaccaactgttactctgcagacaaaccacatgtgcggtttggggtcttgctcttctaaggcagctccataagctgcagcttccttcctggctcccactatgacccaccacaagagggaagttctgtcctcattcttgatttttagtcaagttctttgatggaactgggatcttgctcttcatctttcaccactacaaagccatcagcacagtccagctccccttctctgaatgctgactctgtcacttcttctaaatcattggctaggatttacccaaacatctcccccttctacccctgtcaccaccaaaattgatcaattacaatccaccatgactttctaagtatgggggtttgaacgaaacattgattcccactccttcagtactgacgtcttttcaagactctaactgtaacctcagattgttacagattcaagaagtactatgaaaaatcagtagcaactaaaaccatttgctcatagcatcaagagtaataatagcatcaccaacgtgtcatttcaaatttcccattaaaaacagcatgcatagagtgtcacccacatgccaggaccagggattaatgccaatgagtcctgaatcgtgtctctaagcacttgcaaattcctttcttccagcagaggcccattcttctccatttttattcagcttttctgagaagatcaagcgacctccatgtttatgaatctttatatgatgcatttgtccatttggggaaaaaacactccgctccccacatttgatttagaagaggtattgcaagtatttgtggtcagaaattgttagagcagcagagtgagactagggggtctgggaaagacaagacaagtatagaaaagtgaacgtcatcaccttggcaaaggcaaaggtgtcatgggaatagatgaaaggaagagagctcttgtagaatgaatctgggtaggaccaatagattttaaaagacttaggagagatagaatgtgaaagaagtttaaacattactgctgagtctcattctcaacttttaggagaacaagttcactcacagcttctagaaagaaaacaaactaacaaaaaacagctgagaggctaagcatgctgtttgcatcttgaggaccccctgcctctgcctgctgcaagactgcatcacacgagccttgccaacactgcagagagcttcatttaccaccacaaatatatctccactagctggtgttcacattaaggaaaacaattagcaagttaattaattgtgtttttttttatttgcttctttattggcaaagctgctttgccttgatcagtagcctaagcacttttatgagctcaccgagcttacttctagggtttggaatacaaggtttgtgaaaatataacatcttggaaaaacaagctaattaaagtgagggtttaatttctaatgacagtaactcagtgaacagtttctataaatttatatacacttaatttttagaataggaatggagatatagtttcaatttttcttcccagagtttttccttagttgacattcagtattcaccatgagaagcatgtaacattggcagctcacccatttagaggtcaggtttcccgtatttttggaatgaaacaagcccagaataagcaatcaaacagcctgaaatgaaagaaatgacaaaagtctgttaaaaagctcttgcattttgttcaattagaaatatagaatatctcactggctagaggttatgtaaaaaacatgaaccaagttagaagcaggatattctgataccaggaatagagatcaaatcaacacagtgtaaggacaataatctgggatcattaaacctagggacaaataactttccataccttaatattttttcagagcatcacaactcttaaataagaacattgctattcattctcttaatcccatgttctcaagaacaaaatcaaattatgtttggtatatcctttaaaaaggatattatcattaatattctttaccaataattcaattagaatatttttctgaaaggtggctcttaaagaaatgtgatttatcttaaaaatgaatttatgtggactacctcttccatgaaaatgccagatgaagcattactctgtgccattgaacatactgcatccggccttactcataagttaggtaatttactcccaattttaagacggataaatgagttatagttaggtaaacggatctaagcaatgtttgagttttccagggccaagacaaggcatcatcagctcttctgttactgatttcatcctccgcaattttggttgaaggaaaaacaaggagaggcccattgctgttgtctttctggccctacaagttgtctgtttctctctctctctctctctctttccctctgtctcactcgccatctatctctcaatgctcagaattgaagaaagtactcttcactttaggtaagtgcagagtacaaaatttcaatgtttcaccattgtaagtcaggaaaatatcagtacacatgtagcacgacagtaaggcattcaaatttatggaccaacaaagcccaattcagatggattcttcattgtttcatcagtgaagtgaagtggcatgtgtcatgaactgagcatttagcctatgccaagcacatggtaagaatgtgtctaatgtatcctttgcttacataggaggcacatgtatctaatgtttcctttgcttacatagaaagaatatgtgcaatattttatgatatcatttctgtagttcacccaaacctggattctgtttgatattaaccaagtcacgttttgtttttatcctgacattcacccctcatggttagctatcacacctccagcccacagctcctactaatcggctgtgagtcatcacagatttgtctaataatccctccttgaatggtggtatggtgctcacctcttgaataccatatgttttatattttctgagcaaagctgtcactttattttatttctattctaaattatttttctctctttcagatgtcatgggataactctttactatttagtttgttcacaagttcaagtgaccagaatgctggctctgcaactagctagctctgagaccttattgacttaacatccctaggcatcagtttctcactgctatagcaaattatagcccctaaactctcacatgtaacttctacctataaattactattattttgtaattcacttcatacccttcatgataccctaatctttgctcatatctccttaatctagaacaatgctataatcatatatataatcatttggagttcttttttaaaccacctgatgctgggaccataccccagaccagtttatctaggagtggagtccaaatatcgtatttttgattctaatgttcagccagaattaagaacaactaatcttcactaaagcatcctgattttatctttggcatctctaccagtcactattacaaataatcatacagaaagggtatttgtcttttctgtgctgctataaaggaatacctgaggctgagtaatttataaggaaaagaggtttattttgcagtttgtcaggctgtgcaagcatggtgccagtatcagctcagcttctggtgaggtcacaggaaacttccagtcatggtggaagacaaaggaggagctgccatatcacatggcaagagcaggagcaagagaaagatgaaagatgtgccacactctttttaaagaagcagatctcatgtgaactcagagcaagaactcactcattactgcaaggagggcaccaagccattgatgagggatgagcttccatgacccaaataccttaaatacctcccaccaggctccagtttcaacactgaagatcacattttaacatgagatttggaggggaaaaatatataaaccatatcagaaggaaagaggaaactgttctaagatccctctttatagaaacaggggagcaagggaccaggactctgataggaggcaggtaactaataacagaaaagatattgcattgggaaaatataattttataggtgcagaatataacccttgacaagcttggctggttgtgttccaggatatccaagaaaagagtggttggcctctattttaaccactgtttcaacttgttctaaaaagttttccccatgaaaatgcacctccagttttatatggtacggtagtggatataaagcatgctttatgaggctttataaggatgtagaactagaaataccatttgacccagcaatcccattactggggatatacccaaatgattataaatcattctactataaagacacatacacacgtatgtttattgcagcactattcacaatagcaaagacttggaaccgacccaaatgtccaacaatgatagactggattaagaaaaatgtggcacatatacaccatggaatactatgtagccataaaaaatgatgagttcatgtcctctgcagggacatggatggagctgggaaccatcattctaagcaaactatcacaaggacagcaaaccaaacactgcatgtcctcactcataggtgggagttaaacaatgagaacacatggacagagggaggggaacatcacacactagggcttgtcggggggtggggggctgggtgagggatagcactgggagaaatacctaatgtaaatgatgagttgatgggtgcagcaaaccaacgtcgcatatgtatacctatgtaacaaacctgcatgttgtgcacatgtaccctagaacttaaagtataattaaaaaaaaaaaagaaaatgagacatatacaccgtggaatgctatgcagccataaaaagagcaaaatcaagttctttgcagcaacatggatgcagctggatgccattatcctgagtgaattaacacagaaacagaaatgcaaatgctgcaggttctcacctgtaagtgggagcacaacactgggtactcatagacataaagatgggaacagtagacactgaggactccataaggagggtggaagggatgggaaaagggctgaaaaaacttcctgttgggtactatgttcactctatgggtgatgggatcaattataccccacacctcagcatcaagtaatatacccatgtaacaaagcggcacatgtacccactgaattgaaaataaaaaatggaaaacaaaaaataaaaaaaaaagaaaatgcacctccagttttatatggtaccgtagtggatataaagcatgatttatgattatgcttcagggtcaattttactgggatggcactcttccagaaacatgggccatacacacatcttctacaatgctagaccagtgtccatgttgcatgcctttctttctcataaattcttctttcttgaaaagccatcttgcagcagttgaattggaatctataattcagtgctttttttttcttgcctttgaaagttttacatttcttccaatagaaaataaatggttagatttaaagctgtatatgcttagggctgagactgtcatgaaattttacaactatatttgatgacaacaataaagggtgagttacgaagagttcggtttagggtgagcggtgtcatagtgcagcagagaggacattgacttacgtgtccctcaaactggaagttagactgactctgccattaagtggcttgacaccgccaacttctttttcacatttaaaagttctgcattttaaaaaccgtggtattagtgtgacaggatcatttctagggtccctttcagcacacaggttctgtagtctcaaactcatgtgtcactagatgcgttttctttggctaatgaatggattgcttgtccaattgttctttttaagtgatactgaagtttctaagatgttaatgagatgtactcacctatcaggccagaagcccattggctgtcttctcacaggcattagaccaaaggacctcagaagcacagccatattactacatcctgtttgattgtccattttatttcatacaggatttcatatctgcaggagaaatttgattttttatttgtcctaatatgttaaagtccatttttatttttaacatttctaggactgtttccttgggccctcggtttaatgctgtccaccacccatgagcaaaactctttctatggcaagaaacatcgaacacctgtagtgggtgagtgagacaacgtcataatcagcatgtttgtattaacagtgtattctgccttggttaatgtagttttgccttaagtaattccagtttccctaggagaatatttataggtttccatgggccatataaattttgcctgtcagatatgcacaacgtgtgtctttaaaaatcgggaagccaattctctttgatagcttctgaataaatgttcactctcaaaagctttaacattagctaccaattgacacttgaatataaaataggcttttaaaatctctcttcttagttggctagcatctgttttgtcatataccaaatgagcacaggtacataaaagattcatattgtgatgccaacgttcgtgacagagggtttcatggacacagcgaaaatgttaatttgcaccacatccaggcattggttttccactctttcttgtcaagctcccacagaggaaccacagaatcaggattgcccggggcacacagttcagctgaaccaacagccagtgcagagaagttaccaggtaacacagatgcgtattgtcacagtaaagaggcacaaatgccctctgcttttttttcttggcagggaggctctaaaacaagaagaccgacttatgagacagtttggctgtgagcagtgcgagacgttgagttagatcatggcaagaaaaaatccagacatggtttttattgaaataacatgcttctcacgtagagcacattctttatggaggcatacttctgcaccaaaatggattttttaaaaaatttctactatgaagccagcggacagtatcaaaaagtggcattctgacagtagtttgggttagctgttctgtcttgcttaaaatgatcttattatttgtctcttgattcatttaaatgattttgtttccagagggatttgtttgctaggatatggaagattcaatcattcattcagtaaatatttactgagcatctactctgctcacattcgaggttctatttcagatgggaagccctcttgagcctgtattttgagagagaagcagaataaatacacaaataagtgaaagatgtagtgtgtcagattgtgataaatgcattggaataaaataaagccaggcatgaggataagacatgcagtgatgaggagagggtgctattttaaacagcatagtcagacaaagccttgctgagtggataatatatgggcgatgaatggaagaagtaaggagcaggaggtgcatctgtctagagaaaagtggtggggtttggagtaggacagtcttagcagaggtgttgagcagtgacaggttctcaaactattttggaggtagaaatgacagaattttcttccagattggatttggggtatgagagaaaaaagatcgggttgactccgaagtttttggcttgagcaactgaaggatggagttgtcatttattggcatggagaagactgcaaaaacaagtttagaacatgtggaattgggatatgtgttttaggattgtaaagtttgaagtatttattagacatccacgtgtagaaatcaaatgggcagttggatatgaaagtctgggcaagatctgtggtgaagacatacatttgaggctaacagttcttagatggcgttcaaagctgcgaggctggctgagatcatttaaagtagttgttctcaactgagacccaccttcacccttagaaattcttctgtaattggtctgtgatggatctcagactttggcatttttaaaaacctcccggatgattcttatctccattttaaccttgtgacttaggttaagtacctctgacttagagattgagtgttgctagagatgagaaatactcttaagacagagtacaaggcatcctagcatttaaaggtcaaggatatgaggaagaaccagaaaagagaatgagctactgtgagacaggagaataagcagagtgagggattctgaaagcaaagtgtagcatattaaggaagaaggggtgattaaatatatcaacaatgcagacacgtcaaaccaatgaagactgagaattgaccattggatttacaagttgggtctttggtggccttgacaaaagctgtatcagtagtccaacagggtgatgtcttggctggagtggattcaagagagaatgggaaaagacagattggaaccagtccttctaagaccattctttaatgagtttctgtataaaagagagtagagaatcagggagttagctaaagtaggaggtgggggaaagaaagttttatttttttaagatggtaaaaagagttgcatatttgtgtgctcttggaaatgatccaataatagaggaaaatgataatgtaggagaaggaaggaagaattgatggaacaatccccttaggtgaggaagaaagggatgtgtatgcagtggaggctttaatttgggtgacagcatggccagttgctccacataacaggaaggaaggtttgattacatgggccacttctaggtaggcaaatgcttctggtggtgggtgctggaggacagtctcttcagactgtttctgttttctcagggaaataagaagccagggctttagatgagagagggcataggaaggagagattagaggcctgagaagtgagcatggtatgaaatacacataaggaaaaatgaatgagtttattgcagcactattcacaatagccaagatttggaagcaacctatgtgtccatcaacaggggaatggataaagaaaatgtggtatgtacacacaatgaagtataattctaccataaaaaaaaatgagatgctgtcatttgcaacaacatggatggaactggaggtctttatgttaagtaaaatgagccaggcacagaaagacgaacatcacctgttctcacttatctgtgggagctaaaaattaaaacaattgaacacatggagatagagtagaaggatggttaccagagactgggaagggtagttgggagaggaagggaagtgggagatggttaatgggtacaaaaaatatttagaaagaataagtaagacctagtatttgctaggaaatcagggtgactatagtaaaaaaaatttaattgttcattgaaaaataactaaaagagtatagctggattgtttgaaatgcaaaggataaatgcttaaggggatggcactctgtccaccctcatgtgattattatgcgtggcatgcttgtatgaaaatatctcttttaatccataaatatatactcttaccatgtaccccataaaaattaaaaattaaaagaagaaaacaacaacaacaacaaaaatgaatgagtaaatggatggggaaacatagaattgatggacagttcaaggtcacaggtttagtttgagaccagcagctgtatgtgtgcttttcagccacattcggctgcttgcctggtgcagacaacctggagagtcagacttaaccagggtggagttctcaacaggtgaatacaatgtaggaagagtgagccacagagttgaagctatatgcaatggtgtgattataatgatgaaccctgtgatgtatactagcctggggggaaagtgaggatttcagaggagaggagcactggaggtctggagtagataaaaaaaaaaaaatgctgaagccatggttctagtagttcactatggtgtgaagaaagtgtctgtttcgatgaaaggtaaacacatttcttactgaagccaattttactttgaacctgattaagtttttaaccattgaaattagttgttatgcaaaaagagccatagctttgaacattaatatgcattctttcacttacaattatgaaatgaatatattaatgaataatctaaaaacaattagtggttgctagagtacatctcagtcatctgtctcttgtaagttaataaattatcaatgacagaattaagctatcctgagcactttttaaatatttatgcttctttgcaacctcagtagtttggggaaatgatgacaagcagcaaaatgtatgtctccgcctattttgtaaatcactttaattgtgctaaattgctgaaagggattcgctggaatcaagaaacacttttcaaaaatctaattgataaaattgcattatgtaagactaatgccagagctatgagatgcttgactttgaaaagattttgtccattacattcggaattgctattggtgagtggggcattatctactttataacctaatcaaatggtctgacccactgaatgaagagggcagcttggatatgttgctccatgcctacctcctgattggatgaggagtagcagcttcttgtagcattagaacctggcatggtgggtccatgtgcagctgccccatcccccatacacccttaagaccaggtcacttcccatcaactccatcttgcctggtcctggcttatgttctgatgtctgatgccagagcccacctagccatcaaaatcatatcacaggtgtgaggacatcatgaacttgtgctgcttatctctttcattatggtaaaaatatggttcacaattccgtaaaatagagtgtctctttcttgtcttaaaggagttatacagttatacttttgatatcatcaaagttaaagtttcgaatacattcaaaaaccataaaaacacatataaacccaccacaattttgaggttttatttctgtaaaataatctataccaaatacactatcacattcatattctcatatatacctcattgcacagatgtgggtggcaatgtgacaaacctgagtcagtgtacagcagacattgccattgtgtgaagacaccctcagtatcaaagtatggcagtttagatgatcaatgttaatcaatagttgcatgaaaacaagacatatcactacctagaagggactgcatagacactttctaaagcagatcccatcaacaagagagaggaaagaattgaaggggaacttgacagagaggctaatatgtgtacagaatggtggttgggaaacacggttttacactccctcatgtttgaattatgattgttttatgttgtttgaaatagcacctgggaataatctgtatcccttatattgatttatttgtatctattgattgctggattgatttacaattaggaaacaaatcaccacaatacttaaaaagaaagaaaacctgaacttcaatctgtgttcgtcactcaagatagcaaatggtccatcttctgggaattactctcagcaatgtttctcatgctaaatattaagtacaggaatgtctcctgctttacctagggttcaagtgtgtttataaaccctgctctttgtgaggtgtcatggagattgaaaaatatttatgtgattcctcatgaaaatgggttaaaaaatggaaaatgtggttaatgctacaattaaattaattagaaaatagttcacaaaaacttggggacagatgaggggacagagcaactattcattctggtgggagagtttacatctttaggatggatttcactagagggataaattatatctctcttttacctagaatgatttgcattacagtgatagctattttagcttcatgcaccatttgttaaaaacaatacaaaggatcaaaggtagggatagatatattccttaagttgttatggtcatttcaagagtcagccaaataataccgtgctttactgaaattgcatctttgaaccgagtgaaattgtgataatacactggtctgaaatttaagaattgtgttctagatcgaatgtcctaactcactctttaccttgggaaaataacataaaggaaaggcatgagactagagaatctctcagattctagctttcaacatttaaatgtgtagaataaaaggtgggatgcaagtgagctattttttgcctcttgcttaaaaaaaggaaatgtaaaaaaatcttcacacctcagagttggttgctgtggacaaaagaaaatgtcagtacacgttttttcaaaacagactttatattttagagcagctttaggttcatagcaaaactgagtagagggtacagagccttcacatacacccctgtcctgacacatgcatagcgtctcccattagcaacgttctccaccaaatcgataccttgattaaaatcaatgaacctacattgacacatcattctcacccagagtttatcttaggcttcacccttcgttgtttcacattctctggattggaataaatgtataatgacatgtagccactattacagcatcatacagaatagcctcgctaccctaaaaatcctttgtgcaccatctattcctccatctctccccccaactcttgacaacaactgatcttcttactgtctccatagttctgcctttcccagaatgtcatgtagttggaatcgcattgtatgtctctgactggcttctttcacttagtaatgcacatttaaatttcctccgcatattttcatgacatgataactcatttatcttgagtaatatcctattgtctggatgtaacatagttgatccattcgcctactgaaaggcatcttagttgtttccaagttttggcaattataaataaggctattagacacgtctgtgtacagatttttgtgtggccattaagttttcaactcctttgggtaaatgccaaggaatgtaattgctggattgtatagcaagggtgtgtttagtgctgtaagaaactacccaactttcttccaatgtggcttctccattttgcattctccccaacaatgaatgagagttcctattgctccacatccccaccagcatttggtgttgtccgtgatttggattttggccattctaatacgaatatggtaacatcccattgttgctttaatttgcatttccctgatgacaaatgatgtaggtggcaacttttcttacccattcttgattactctaaagcttgaaaggatgttgcggatgtccagagaaatctaaccactgaaaatacaagggaagtatactgtcagtctaacgattgctgacatgtcccttcttagagcagcaatcgggcaagccacagccttatttcatgtcatcttcatctcttcagctaatttagcctgtaatgcactatcagtttgatattctcaggagtgaaattattttccaaggtagggaggcctctttcttggccagaccattatccagggaagaatgaaattcaggcactataaaacataatctcttgcttttccagttgcctctctaattatcctaccatgagcactgacacgtggtagaattagaggaattattcctgcagctttgcccttcaatgcaggcttcaggtttgtccccagcaacttgcttactagtttcctgttcttgggaacagtagagggtctggcacctggtaattcccagttgtcaataatcagccatctctgcagttactcattaactccagcactccatcctcaactcactagaagtttaatttaaacacaattgttcggagtgggtctgccacctttcctcttctcccatttctccagtcttgccacactcttctctcctgatagtttaaattgctattttgggagggaactatttctgtttccagaagccaaagaacagaataaacagaatgttttttgtgttttgtagttcacagtgtactattaaaaattcagtttgtaaataaaaattgtatttatttaagatgaacactgtgatgttttgatatatacatagtgaaatgactatcacactaaatctagttaacacactcatctccttatatagttactgtgtgtgtgtggtgagaacacttaagatctactctcttagcagatttaaactctacggtacaatattattaagtatagtcctcatgctgtacattagaactctagagcttatgtatcctacaggactgaaactttgtactctttgaccaacatgtccccattaaagccctgaagttggaatctctaaatggggaaactgacagagagtagatttgaaggtgaaggacttcgcctgggagagtcttggaagaaatccacatagggagcaagttataatgacaaatgctcttctctctttatagacttgatctccttaagtccatggatgaactccgtaagtccaggaaaagtctctcattcatctttaggtctttagcatgtagctctgtgttcagcatttaggagatgcttgataaatattcgtggaactgatcagaacagagccacacacagttgagccagggacacgtggcagtcaactggcgactgagttcagtcgatgacagagcaatgggaaaaggatggaaataaacttctcacccctgcttatattcacaaagatctttgtgctgcatttttgtttgaagctgtgtgcctagataacccatgaacacaatcaattccaaattgagctgtctttcaaatcattgaaacaggaacaattgttgtaaccatgtttagtgggttatttgtggtgccaaagatgcccaagtgaaagagttacttcccatcatcacttcacagtcatgaagtggtgctggctctttgaaacgtacttacgcgtatttcctgttcagctctgggtgtgattgtgtgggtgatgccttcagtgccgagggtggctgtagggtctgcagctgttagtagacgaatcattattctgatgttggctcctgtccttcacaaataattttaggaaaaaagctgaccctgtagtgaccttttctgatttccagtagccaagtgttcctcttattgctaactgtgtggatgttaacatgggcatcttcacatttggatcagaaaacaatattattctgaaacactttcctttgaatgtctggtgtctcatgttcattcaaaaggattgtctccagtgtccacgtatggctgactctactagtcagttgccttttagtcaaaacagtttctgaaagacaaaagttctgtgttaagcatgcttaggaaaagtgattgcagaaatagccatgtcagtcagaggccagaatgctctttcagattagggtatcagacggaggaagctactgggctttggtcaacgtgtttcatttttaacaggctcgctagggcgcagcagagagagaaatcgtattcacccactgaaaacccagcaactgacttaatgacagttgaacaggagaaacacaaacttcaggttgaggttgatttttgcatgtgtgcattctcttaaaagacatcttctgttattagcatagcctcttttagactgggtggttatggcttttttatattttaaaagtatttattttccttataaatgtcatttgataacaaattagtagtcattaaggtagtaggagcaaccaatcttgttgactttttttttttttaacttttgaaggaatttacagataaaatgttagtcacattgaattttggaatcaaattctccaactgctgtaaccagtagagaatacattttcctgtaccttattctgtaagcctatcaaataatgtaattttgaagggatttgaggcccctcttaattcaatctttatcattaaaatatttctggctctacttagtagggaaacagaataagagtcaggaatcctagattttagacttggcattaccatcttctggctttcttatctttggaacatcatttagttcctctgaaactcagtttcccaaattataagaagtaaaaggatgatagcagctaacaatattgatgatcatatccaataatgtgtgccagagtctttttttaaaatttaaagcattatataagtgttttatgtttaagaaaagatatggatgcaaaaaaatagattgtgtcaatgctgggacacagtgggttgttagtttttaatctgtaaatcacagcctttgaaatgtttccattgttaatgttcttataacaaagagttgtaaaagaaagaaaaagaaacacagctataggcgaccattaggctaagttagaatctgtctaatgtgaatgtgaggcttttcacatctctgtcctgagggctcaatattcacagtaacataagaaaaacaaaattatatttgtgaacacacaccagccttgagatttttttatattgtctataataaagctataaaatgctcattttataccatacattctcggtttcttttaaataaaaatctaacttgttgggctttcgtgacaatccagatgtgattaccctttgaaagaacctgaaattttatttttagtttttacttgtttacttatttatttttaagacagggtctcactctttcccccaagatggattgcagtggcacaatctcagctcactgcaacctccacccccagagaacctgaaattttaaaacaactggaaagttttaccaatgactgagaatttatttccttttgaaaaacccaaaataaatattatccagctactggccagtgcttatgatatatctcttatgaaatagttatctttgtgattttgtgtaaatctcataaattttgatacattacttaggatttctttcattggcaagatggttctctgtaaatagagaacaatggacaacctctgtaaaatttttagcaggttttacatttgcaaaacggaatacagtcaagtttgcaattgtttttgtgtagctttccaaacatttccacttgtcttaacataggacgtccaggccatgtgcagagaacagcttactaaactacctctgtgactcattttaccaggctcacacctgtctgacattaaaccttgggactagatttaagaacttgagcataacaccaatttgacctcattcagtaacaatcaaaaaggatatcaagactgaaatcaggatagacattggttcaaattgctttttccttctctccgtttaatcaacctcactctatttttgtctctttctagggagaagtgagtgagatagactactcctgaatagatatacacatctataatgcatctgaaatcaactatctggattttgaaatttagggtcaatattttgtgtgttgtttcacatttaacatcctatcaacctttttcttaggatttggttatagaaaacccaggtaatgtgcaaagggacagatgagattgaggagactgcttagtattttttaaagtagaataaatggttttaagtgacttttgtgtaaaagtaggttttgcacttttggcaccaaggcaattctgctaattgtaaattagtctgttcttagaaaaattttaatgaacttttttatgtataatttgcataaagtaaatgtacccatttaaaatgtaaaattccaacacccaaatcaagacatagaacatttccttcatccagaaagtcctctcttgcaaactgtcagctaattgctacctcttcccacccctagcaaccaaccgatctgacatttagcactagtgattagttttccctcttttagagcattatacaattggaatcattcaagacatattggtgtgtctgtcttcctttgctctgcattatgtttttgagagccatccatttgtggcaagtatcaatcatctgttccttttcattgctaaatagtattcaattttaagaatatagcatagttttatgaacatctgggtagtttgcagtttgaagctattgtaattaaagctactctgcattttcagcatacattttggtgttcatagatgttttcattgctcttagatgaatacttttggctcatagcgtgtataactttaccaaaaaattgccaaattgttttctaacgtgatgggaccattttacgctcctacctgaaatgtatgagagtttcagtagctcttcatccgtggttgggattgtcatttatttttgttatgggcattttaatgcatattggcacctcattgtggttttaacttggatttcctgatcagtcatgatgctgagcacctttgataggctattatccatttacataacttcttgtgtctaatatccgttctcatcttttccccatttatcagattgtctttatattacagatttgtaagagttctttaaccattctagatgtgagctctttgtcagttatttgttttgcaaatatcttatccctgcttgcttagagaaatatttgtatccttaaatgattcaattcagaaaagactaatggtttgcattgtattttcccaaagtagtatttgaagagcaagaaaatgcttttaagtttattgagttttcttttatggctagtgttttcattttgtattgttttttctcctaggaatcaatgacctacgatagagttgaaaggatttttccatccttgttttgttcagaaatacaattaatttttgtgcattgatttttttgcattattcaacattgctaaattctattcatttttattaattttagtatatttcttaggattttcttaacagataatcttgttctctgtaaacagaagacaatgtcatatctttagcaggttgtaggttaaccctggcctcagaaaattagtgtaggagcattttatcctctaattcctctaagattttatataagattgatattaattttttcttaagcatttggtaaaattcaccagtggaatcatctggaaaactttagttttcttagtgggaagatttttgactataggttcaaattcttttctatttccgtaattagtcttagtaggagattattgtttttaacaatctttttaaaaaataaatttcttatttgttaattctctattttcatttatctctgatctttgttattttcttatttctgttcactctgggattagttcaatcttccttttctaaattcttaaaatagacacttgataacagatttttaatctttctctttctttaattttgtcatttaaagttataaattttcttctgagcaatgctttatctgccttttgcatattttgatatgtaataaaataattacatttcaaaatagatatgtaaaattatttattttgaaaggctttctcattcatctttgactccttttttaatccatgaattatttaaaagtgtattggtaaattttgaaacatttgggatttttaaagatatcttagtgttatcgatttctaatttaactttactatgataagctcacatactctgtcagttttcaagcttttgaaattttttgaatgcattatacactttggcatacagcctatattgatgagcagttgatgtgccattgaaacaaatatgtattatgaggttattgaataaagtattctgtaaatgtcaattaggttaagttggtgaatagtctttttcagatcttctgtatccttactgattttttgcctacttgatctgctaactactaacagagcaataataaaaaactccaaatttgatatctgttttttatttaattttgtcggttttagcttataaattttggagttttgttattagtgcatatgcatttagaattgctatgtctttctgataaatttcctttttaccattatacagtgtctttctttaactcaactaatatcttttgccttgaagaccattttggtattttaatagcctcatcatctttcttatccggactgttcacatgaaaagcttcccaacacttgtactttcagtacatttgcagattaaattaaaatgtatctttctagtttatacagtacattacataactggatcttacttttaaatgcagtttgataatctctgccttttaagtgttcagtctgtttacacttaatgtaccaattgatgttattgtgtttaagatacatcttgctatttttttccctttattcttttaatgtttctttactgtcttcttattttctttgttgagagacaggatctcacctggttgcccaggctggaattcagtggtataagatcaaccctgagcagtggacttgtggaccacacacgtttaaacctttgaacccattttcccgacactctggcagctctcttgccctcaggacccagccattcaggtttcagtagcttcagcaacctcataccctgatctttgcctcctcagatcagcagaactgctgtgttttgcttgtgctgcatttgggaaattgtccccaggcagaattctaaggtaatcatgggcttcgcctcatgagtctctctactctcaattacagcgttgtactttttgttgtccactgcttagaaattattgatttttttctccctaacaacctagtgttaattttctctgattcattatgtttttagtgttctggtttcagaactatttattttttgtacttcttagtttaaaaatttatttctctctgaatttctgtttggttttaaaaatgaaaaaccacagaaatagccaacgtgaaatatatgcttctgtacttcatgaagataaataatttgtggtgtttgtaagtccactgggtacattaagtatcaactactcatattttttcaacttataaatctctgaaggttattagtataaagtgttttcaaagttttatctaagtacatgtcagtttttctctaaaatttataactaatattcatgtacatatatatttacagataaatatgaatggtgataaaaataaaaataacacacactatatatttcatatgttacaataggtatttttatgcctttcttattgaatgtttggaaagtaaatgtcttacatttcaacaaaccattaatcaaaattaaaagaagggaaaatcattattaaatgttttaatatctgttcaatttgaaaattcccttttaaatattatatgtcagataataatatgtaaagagattccttttatgagaatataggtaacattttaaacaaataccttttgtgagattttcctttcatctggtttctttaaacttagggaaataaaattatcagtacagtaaactggaaggctgtttcttttccctgatggcattctctggaagccttgttgagatttgtggtacatttggtttggccagtgagtcatctctcataatatgttcaatgtctgcttgcctcaggactaggagtctgctggcaaactctggcctcttaagtcatagaaatcagcctttgaattaaaagttattaatggcatgcattaagtatcagctgtcatttcctccagggaggagaaatctcatggaaaatttgcacagtgtagctcatttattatgttaaatgtcttttaataatgatagcttattttttaattttattcaagattcacaaatttgagagggtaatttgttctacactataaacaaaaggaaagatacttcagttaagaattttgatagaactggaacaaaaataaacccacagcttaaaataagtaatgccatcatcaacaaaccacgacctggttgtaaaggaaatggggtccccattcttcctggctgccttatggtgcggaaaacaacgtggcattgacgtctctttgaaaagcagaagattctcttttttggttgtgtctctgcccggctttggtatcaggatgatgctggcctcataaaatgagttagggaggattctctctttttctattgattggaatagtttcagaaggaatggtaccagttcctccttgtacctctggtagaattcggctgtgaatccatctggtcctggactctatttggttggtaagctattgattattgtcacaatttcagagcctgttattggtccattcagagattcaacctcttcctggtttagtcttgggagggtgtatgtgtcgaggaatttatccatttcttccagattttctagtttatttgcatagaggtgtttgtagtattctctgctggtagtttgtatttctgtgggatcgatggtgatatcccctttatcattttttattgcatctatttgattcttctctcttttcttctttattagtcttgctagtggtctatcaattttgttgatgctttcaaaaaaccagctcctggattctttaattttttgaagggttttttgtgtctctatttccttcagttctgctctgattttagttatttcttgccttctgctagcttttggatgtgtttgctcttgcttttctagttcttttaattgtgatgtgagggtgtcaattttggatcttccctgctttctcttgtgggcattgagtgctataaatttccctctacacactgctttgaaaagacaggcagagacgcaaccaaaaaagagaattttagaccaatatccttgatgaacattgatgcaaaaatcctcaataaaatactggcaaaccaaatccagcagcacatcaaaaagcttatccatcatgatcaagtgggcttcatccctgggatgcaaggctggttcaatatacgcaaatcaataaatgtaatccagcatataaacagaaccaaaggcaaaaaccacatgattatctcaatagatgcagaaaaggcctttgacaaaattcaacaacccttcatgctaaaaactctcaataaattaggtattgatgggatgtatctcaaaataataagaactatctatgacaaacccacagccaatatcatactgaatgggcaaaagctggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttacacaccagcaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatgctgcccaaggtaatggatagattcaatgccatccccatcaagctaccaatgactttcttcacagaattggaaaaatctactttaaagttcatatggaaccaaaaaagagcccgcatcgccaagtcaatccgaagccaaaagaacaaagctggaggcatcacgctacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaacaagcaatggggaaaggatttcctatttaataaatggtgctgggaaaactggctagccatatgtagaaagctgaaactggatcccttccttacacctgatacaaaaattaattcaagattgattaaagacttaaacgttggacctaaaaccataaaaaccctagaagaaaacctaggcattaccattcaggacataggcatgggcaaggacttcatgtctaaaacaccaaaagcaatggcaacaaaagacaaaattgacaaatgggatctcattaaactaaagagcttctgtacagcaaaagaaactaccatcagagtgaacaggcaacccacaaaatgggagaaaattttcacaaactattcatctgacaaagggcttatatccagaatctacaatgaactcaaacaaatttacaagaaaaaaacaaacaaccccatcaacaagtgagcgaaggacatgaacagacagttctcaaaagaagacatttatgcagctaaaaaaacacatgaaaaaatgctcaccatcactggccatcacagaaatgcaaatcaaaaccacaatgagataccatctcacaccagttagaatggcaatcattaaaaagtcaggaaacaacaggtactggagaggatgtggagaaataggaacacttttacactgttggtggactgtaaactagttcagccattgtggaagtcagtgtggtgattcctcagagatctagaactagaaataccatttgacccagccatcctattactgggtatatacccaaaggactgtaaattatgctgctataaagacacatgcacacgtatgtttattgcggcactgttcacaatagcaaagacttggaaccaacccaaatgtccaacaatgatagactggattaagaaaatgtggcacatatacaccatggaatactatgcagtcataaaaaatgatgagttcatgtcctttgtagggacatggatgaaattggaaatcatcattctcagtaaactatcgcaagaacaaaaaaccaaacaccgcatattctcactcgtaggtgggaattgaacaatgagaacacatggacacaggaaggggagcatcacacactggggactgttgtggggtggggggaggggggagggatagctttaggagatatacctaatgctaaatgacgagttagtgggtgcagcacaccagcatggcacatgtatacatatgtaactaacctgcacattgtgcccatgtaccctaaaacttaaagtataataataatagaataaaattttttaaaaaagtagaagaataatcaaaggcaaatggctccatattttcttactctattttttaatttatcttttgttatttttatgagtttttaatcatccacagaattaaatttatattgaatgcatctttaggttttgtttcagcaagtaaaaagcacttctgcatgaatttgtcacacttctattggcattcacgcatcacacgctgtcgagagttcttgctttatttgtaatcttttccttcttccaccctctgttcacccctatgaagtcatcacctgattataatgtcttagcttcaggtgactgatagagatctttctggtgatcaccacagtgcagtgctatttcactctttggcaggtcgtatctgatttgattttgacctcttattatctttggcttaccatacagttgggtaatgtatgatgatatagaccgaataatcatttaaaaaacaaaaacctcatgtttcaccactgcagccagttattttgaaggaggcatcctaaaggttgggttaatctcttaagaagtcttgagcagccaaacttggatgacacttgctttctttgcaaaaacgtctttaaacttgagatgttttccattatcagttatatttttaaatttttgaagtttgttaagagctggcttcttttttacaaagttgaggcaagtgaaaatagacttcttaaaatgaacctttgattaagggtgggtggtggttcacaagttctagaggttagaaactctaagtggacacttaaggattttgcttctttgagatattggctggcttctctactttaatgaaaacacttgtggtaaatccaatactataaagagacattcctacattttgttaataacactttttggaagcaagtgataaatttttggaaggcaaatatatgaagctctgcaagcgttcatatagttaaacttgtttatcaagatatattttaagcacttcattggtagaagtaaaattctgatgtaagcaatactgctgtctattcacagattccacagattggaaatgcccttgtcagctcaccaagttgggcatgtgatcttggggtcctcatcaacttccttcattctcattttatttatatatcaaaataaaatctatttgtagcttcatctgccgcagcaacccaagttgtctggcatcattggaattgtctcaatgccacctcttggtttgacttttccctttgcatgtcctttgccctgtctctctgctcttggctttggtctgaactattctctggctttgttggtgttcactggtatcagagaaacaatggactttgagcttcagctgatgaatttccctgatggtggccagggctgagactgggagctaccaacatccacgaatttgacctgctatggagccagggtacctggggtgaatcacaatcctttctgtattgaatgtgctcttatataggcccctgggagctacacggaaccgaggagtgtaaaaccaactggtggctaggagcccttaccttctcttcaaccttcattgaacactgaatgatatcagtggaaccatttatttttcctgttttcttcactgtttcatatggaaccaaaatataaaaaaggattaaatataaaaaaggttttatataaaatgtaaatcttcctaaatataaaaaaggatttaaatgtctatagtatgttacaaaaaataatttcttaaaataatctgatatggcattacattttatttgatagtaaacaatttttaaatttttttttaaaaacgctctctcctgaatcctcaatttcccttttcttacaagtagacttctattttggttgaggctaatagtgagtgttaggagagaaagtgccagagcatctgtgatatggctgttttccctggtgctggtgcttagctgttgctaagggagtctaagaaaacagtggctactcatattttactgaacaagctgcacataaattctgattctaaccaggataccgggtactttattgtgaacggagtgactttctaacctggaactcagttctgtatactccatcatattgatctcaattctgatattcagaccacaaaattctggctttaaaaaagtttctatatttataagactatatatatacacacacacacacacacacacatatatataatatatatttatacatgtacaaccatcaaactatactaacacccaattgaaaggttagaacacaactatcaacattgaagacctcatgtaccattttccatttcacaaaatcaccttacttttattataacttcaccataaataattatatctctaaaaattacataagtttgaagatgtttgagacttttaaaaaatgtcattatactttgtgtattcttctgcaactttcttcttaaaattttttaagtgttttattgcatcaaaatgcacataaaatttaccatcttgaccatttttaagtgtacagttccatattgttaaatatattcatattgttgtgcaaccaatctccacaacttttttactgtacaaaactgaaacttaaacaagtcccaattttcccctccaccccaactcctcacaactgtcattctactttctgtctcaatgaatttgactactctatatacatttaaagtggaatcatacagtatttgtctttttgtccctagcttatttcatttagcataatattctctagattcatctatgttatatcatgtcagaatttccttccttttaaaggcaaaatgttgaattatgaagtcagcattatacccatgggctaaactgtgttgatgtgtatagctgttgttgactactttccactgctgttactctatcataccactatttcataacttatttatccattctgttttgtctggacttagagctgtttcctgggttggctgattggtttgtttcctctataatcaatgcccatggagtagtcttgttcatgtcatcgtattcatattgtgtgcacctgtgcaagagtttttctaaagcataaacctagaaaactgctgaacaatagggcacatgctaactttactggatgatgccaaattgatgtccaacgtgtttatactgatctatattcctgcatgagagttcttgttgtctcacatcattgtcagtacttgatattgtcagaatttttaatgcctgccaatctggtgggtgtgaaatagtatctcattgtggttttaatttgcatttttctgattgctaatgaagttggagcatctttttgtgcatctgacttgaatcttcaaatctgtttctggattagaagagaagaaatataagtcgagggaaagagagagagaaagtattctatatccagaccttaactctgtaactgcaactttttaattgaccgtaactctgtcagctcttttccccattggagcagtttaaatatataaaatgagcactgccctcaaatcttgtggtcaacaacttatctcctgatgctgcacagaatctttgaatgaaaggtatcatgcggtccatagccagagcactagaaagctcagaggaccacagtctaatgtttttgactgagagacatatgggaatgtgtatgtgtgtgtttgtgtgtgtaaaacaaatgccacacacgataaagtctcataaaacaattcttacacctactaggtaaaatacagtttgatatttttactttgatttagtccagtcttctttgttttacttctttctttccctctttcttttctttccttcttccctcccttcctctctctctttctctctccctctgtctcttccttcctctctccctccttccctttcttttttcctttttttttctttgagacaaaggagtctcactctgttgcccagactggagtgcagtggtgtgatcttggcttactgcaacctcccctcatgagttcaagtgattttcctgcctcagcctcctgagtagctgggattgcaggcccccaccaccactcctggttaatttttgtatttttagtagagatgaggttttgcaatgttggccaggctggtcttgacctcctgacctaaggtgacccgcccacctcagcctctcaaagtgctgagattacaagcacgagccaccacacccagccccttcctttctttctgattactaccaactaagttgattttacaatccgcagctacaatggttcccaatggggacgttgctgcttccagggaatgttttggatatttgtgagggatttcctggcatttatcagccaagaaccagagatatgatatatgagacagtctcaaacaataaaaattgttcctgtatcacaaaacattcaatatttatatagatgatcattggatatttataaaagaacttcctttcacaaaaagtatattattcatagttttcatatacaatatgcactcatattataggacttatattactctgtcttgtaaaactgtggtctattacccttggaagtggaagctccctgaagataggagaagtgttgtattcatctgggttacctctaaggtaccatcaaaggactttgtatataggaggtaggaaggcagtttagtggagggcgagaaatagactccagttaaagaaagacttgatttaaattccaactgtatcatgtccagttgtcatggactagggtaagctataaagcttttctatccatccattactcacctgcaaaatgaattaataataacacatatcctaaagcttcagtggagattaggtaaaataatgtttgtaaaagagcatatagtaggtgctcaaattatcaaaattattatggctgttaataattatttttatttaataaacatttgttcacttgattttgacccatcttgttctaatgtttttatttaaccacaataataagcactaacacttctgaatgcttacttcatgtcagacataaaaactttaaatggattagtttccttaagtgaatatttgctaccaacctataaagtaattataattattatttagctggggaaatttaggttaacagaggttaggtaacttgctcaagatctccctgttagtaaagaaggaagccaggatttgaccaaggaagttcaatgtcagcatctatgtcttaaccatttttgtgttaattgttgatattgaaaactttaaaaaattccatagtaatacagtcttatactttaactggcttcaagtttgacaaatcttagacattgttcctcagaaaataaaatatactgatacaaagcaagaaaaaatgcctgtggccaagaacacaaccataagaaaatgtgtaaaatatggcaaaactaacttatgttggaaatcaaacatccaactccaaaatttaattggtgacttaggattgaatgtattatggaatcttgtttttctaattgtaccatatcattaatcagctaagaactgaaatatttggctaggcatggcggctcattcttgtagttccagcactgtgggagactgaggcgggtggatcacttgaggtaaagggtttgagaccagtgggccaaaatggtgaaacctgcctctactaaaaatacaaaagaaaattagtgtggtgtggtggtgcatgcctgtagtcccagctactcaggagccttaaccaggagaatcgtttgaacctgggaggtggagattggagtgagtcgagattgtaccaccactacactccagcttaggtgacagagtgagactctatctcaaaaaaaaaaaaaaaaaggaagaaagaaagaaaagaaatatttaaaacctaacatacttggatatgtatccagattacaaaattgagcatgaaaatagaacttcaggcaaataatacagagcctttacaacaagcttggagggagcatgcagtatttggttcccatgctgatgagtctagcagttcttatctcatttctctgggtgctggtctatatccctctgacatatgatcattaaaagagttgtatttttcccgtggaatactatgcagtcataaaaaggaacaagattatgtcctttgcaggaaaatggatggtgctggtggccattatccttagcaaactaaggcaggaacagaaaaccaaataccacacattctcacttataagtgggagctacgtgataagaacacgtgggcacatcgaggggaacagcacactaaacctcagctaagtagcaatgcaaacctctaatctcagggacatggagcaagaagtctgattggatgggccacaaattcatccccactcctggaaacagcattcaaagtatctcaccttcctgggggctcaggcaaagcttcttgtttaggatgcattctttgcatgtggtgaatttatgcataaggagggagtagatgccatgctgagctccagaaccaattcatagcagtactttagtcacagcatcagatggcaggcaaggctgtctgtacattaaaagagcttatactagtcagtccagtaatgttgcacaagtgttcatccaatttaatttttctgggaatgacatgtgatggggtgttgatgtgcaattaagttaagcaaggagaaaagaaacgtgcagcagagctggagtcaatatggtggctgaactgccccattgatttgacaaaaggatctgtgagtgcagttcatcttaaggtccacgtggcccatacatgggaggttattggaaggtgaatgttagcagaacagctgaggcaaaaactaaagtcatgccagaaagagagtcttgaggagagggaagggggattcttaatgacaggcaggatcctaagcagggtgtagcgttggaaatgggagccaatttcagtgaacaccttttagctcctttgcactgtttttaatgaatccatgtgtgtaggaaagttaggtccccaagtttcttactataaagtgactattgtcattagcccgcacaaatactggaaatgggaatgaagataaggaaatccctcctccatccctttaggtttatgttaatttataaaataaaatctattccatttttggtatttctttaaaacttacccatggtgaacttagtagtttctatcaaatattggtgattctataatagatatttttaaagcttctaaaaagtcttttgtaagggagaaagagtaaaatttttctcactatctcaaggtttatggctgaaacctctataacaaagacaaattaacaacagaaaagcccatcatacctatttaaccaaagtcttacattacacaggagccttcagaaatgaagacccaaagaaataggaaaaactgtagtgttatgcctagatttgatgaagagtggacagtcatggagaaggaagattggacaaaaaggggtaagatctaatggtcataaactgagggagcttagcaaggcctgtttgttcagattttcctgagtgtatctgtatcctcattcctttcctacaggtataggacagggcacctgtcacaggaggatcttatgacctactttcaggggaagtaggtcagagagtttttatggttgtctctcacacagcaaggtaggagacagagtgattttcttgcttcttcagcttcctcagtttccatgacaccatattttggggtagtatttcctacacctcatcactttctagccctggcacttgggaactgggatagcttcccttatattaaatgaaaaagaaatgatttcatacaatgtcagccatatatcttcagattatcaagagctggcaaacgaattttctcaaagtttggaatttctgtgctagcatatactaattgattaccatgtagctcttgaagtagaatgtttctggatattctgaaatatttttgcacagctcttctctatccctggcaaacagtaacctagaggagttctacaaactgaatgacttttttttgtataagtctgcagtttgatgatgaaccattattatgtcttcaaagggcatgccagctgtaaaggcaattggtatttaagatgttttcacatcagaaagaaagtattgcatatgcattgcctgaaataatatcagaaacacagtgaatgctctgtacacattgatgatggcaatgaaatgacaagactgagctgctttagctgtagtcttctcttatgcatatgtaacatgattttaacagatacccgcatagcaataattaacacttacagaacatgttatatttgacaaagctttgctaacatatatttgtcgggataggctatgttttactatacttacaaaaaactccaaaatatttttggtttgacacaacaaaagttatattgtattcatgcaaggccagctgcaaattttagaacatcagttggagcctcttttgcttcaaacacttccacatcaaggtgagctatcagagtcatggcagcaggggaaagagagcaggaaaaccatgcattggttcttgagtacttccacctggaagtgacacaagccccttctgctcaaatttcattggcccaagcaagtcacgtggctacatctgacttcatggagggcataggtacaatcttgtggcccagaaggaaatgagaaaataaaatattggtgagcagcagcaatgacaccacatctacattatcttattgaccatttaatctttcaaagagctctatgagggtcaaaaatcttttattcttgttttacagatgaaaaaagactcagtttaaaaaacttgcccacagtcacccagttggtaagaaatgtaccacttggacaccagtcctctaattctaaatcttcttttttttttttctacccaccatcatgatggagtcgattgctgagagtgtgtttgtttttagaagcagaggtcccattgaattgggattcttcttttctcttttcctttttttttttttttttttttttagcagagtaatcacttaccatatggccgtgtgtgtagttatacctaatgtatcagtatgtagcctgtcatctgaaactaaagtcacagaaggggctgcttttttttttttctttctgcagagagagttcttgggtgcagtggggaagatctgcccaggaccctggatcacatgcactatctcttgagagggtatgagcagtgagtctagggagcttgtctctgcaagtctccccactcacaaatcagccctttgtgtacccggtggcatgtcctgccccacacccacagccgaggagcctggagatgaaggagatcaatcatcagctggacttccttcagatgcccaatgtatggtttatgctttacagatgatgacagcaggtcttcaaaaaggttcagtcattcgcccaaggtcataaagctaaaggaggtggggagggaggacccagggctacacaatcctcagggaaactccttcagttgcgctacattgcctctgaaagatgccccacaggatgctctgccacaggcttctgagagcaaataaaaggtagggagatggattatagtttgcacccatagctagaaagagcccattctttaatggaaaaagagaggagttgaggactatatcattcactaaacagtagtatcattaccaccatccccaatgactttaaaccattgaaaaacaaatgttaaccattcccccaaaagtccaagactgagatgactttggtagggaagtgtgtgcacacaagcactgtcttagtccatttgtgctgttataagaaaatacctgagaaatagcctgagacaaggtaatttataaagaacagaaatgtattttctcacagttctggaggcttggaagtccaagatcaaggtgctggtaggttgagtgactggtgagggcccctgtctctgattccacaatggccatcttgttgctggttcctcacatgttggaggatggaaaagcaaaagggcccagctaattctctccagccccttaataaaagattaatcatatccatgagggcagagccttatgggctaatcaccttttaaaggtgattaagagttgcatcacttaatattgttgcattggggattaagttgcaacataaatttcagaagggacatgaacattcaaaccataggaagcacacacacacacacacacaaaaatacacatacacacaaacacgtacacaccccaaacacatactcaaggcttttctcataatctcatgttcctaatctcttcattactcactactttcttggaatatccaaatgtgaaatggaatgtacttaaaaaacaaatgagaagtagagaaagaaattttattttgtagatggtcagggttttttattgttatgtgtgtaaaactaaaattatgataaatttttatttctgtttgtgcaaagtagtttagttaccaaaaatatttcacaaaatccccagtttgcaatttcttatagaactgtgtctaggaaaatagttctggataaactacttaagaaagttgaatgtctccaagactaaatccccaacatgcatttggttttatgattggtgtggggtaaggagcctgagtgtgtgagagcagtttgtagggcaagacaagcaaaactgcagttattactgctggagctctcataggtatgtgcacataatggagaagaaaagtcttcctgtcgggctgatgtaaaatccctcatcctggctaaatttctttgtaattgatgatcatacagaccagtgccaccatgactgggttcccttacattctatacataccttttttgagaatgcttggaattcaatgggctaaattttattatagagggaatatttataagaagcaaaactacctttctcagtgactgaaatatttatacactgagggcttgagggtgccagtgtatgtgaagctgtctgaggcagcgtacagtcatttatggatttctatatataaataattgacatgaaaactgcacaccattctcccatgtgtattaaagcaactggcctaaagacctttattggactgctgctttgcttgagttattcaacaaataggctgcatcttttcaccctcctttcttttgtctttacctctttccttcttttcttcaacattttttttgagggctgtattagtcagggttctgcagagaaagagaaccaatatgatttgtgtgtgtgtgtgtgtgtgtgtgtgtatgagagagagagagatggagagagagagaagaggggaagacagggagagaaacagcaagagagagagatttagcatgggatgtggttcatacaattatggaggtggagaagtcctatgatctgccatctgcatgctggagaaccaggaaagccagtggtataattcagtctgagtcagaaggtctgagaaccagaagagacaatggtcctggtctgggtccgatagcccaagttcctggagtgctgatgtcccagggcaggagaagatggatgtcccagctgacacagagagagagcgatgtgctctttctcagcctttctgttctatttgggccctccacgggttggacgatgcccacattggtgagggtgatctttgctcagcctaccgactcaaacgtcaatgtcttctgaaacaccctcacggacacattcagaaatgttttaccagctacctgggcatcacttaatccagtcaagtttacataaaattgactctcagaagggctgactatgtgcctgctcctcttctaggcttcccctatggggaaaaaacaatgaacaagaaaaaactctcttctcatggagttaacattcaagagtaaaggggaaacacagcaaaaaaaaaaagatgtgaagaagaaaattcttctttgcttgagatgggggcttggtagtgaagccatattgggtaatcagataatgaatctctaaagagtttgcatttgcaatgtgagcaaatgaccgtaagaagacctgaggagagagaattccaggcagaggaaagaggcaaggtgaaggcagatggcagggaggcaagtgtaattacaagagcccgtgcagctagagctgaggcaatggcaatgacacaagtagagtgaagggaaggtggtcaggactgggtcatgtaggggtatctgatgctaaggaatttggatggaagagtctatggatgtattgttttttttcaaatcttttccataatttggatttcatcctcttagctatgcgtcctccagtttccaggctaatactttccccttcagaactggtgctctcaatccccagtgggcaatggcatcactgtctcctcatgttcttcccacctcttggactgctctttctctgcttcttcactgactcttgttcctcggctcaccccttaggtgttcgcatgcccagatacaaccctcaactgtttactttctcttggtaccctctctgggtgactgcctttgagtcatggcttcttttctaatagttctccaacccagccctgaggtctcagctgaactcacagtccagcaggacatctcccctgagtgatgtctagtctcttcagtgtcaacattttcaatatctccctatgcacaatgcagtaccaccttactcctgcaagaatggcctaatcaaaaaatcaaaaaataatagatgttggcatgcatgcggtgaacagggaacacttctacactgttggtaaaaccactatggaaaacagtgtggagattccttaaagaactaaaagtggagtagaactaccatttgatccagcaatcccgttactgggtgtataccttgaggaaaagaagacattatacaaagaagatgcacaattgcaaaaatgtggaaacaacccaaatgcccatcaatcaacgagtggataaagaaacatatatatagaaagaggaatactactcagccataaaaaggaataaattaatggcattcacagcaacctggctgagactggatactattattctaagcaaagtaactcaggaatggtaaccaaaacatcatacgttctcacttgtaagtgggagcaaagctatgaggattcaaaggcataagaatgacacaatggactttgcagactcagggggaaatggtgggaaggggatgagggataaaagactacaaattgggtgcagtgtatactgctcaggtaatgggtacaccagaatctcacaaaacaccactaaataacttactaatgtaaccaaacaccacctgttccccaataaccattggaaataaaaaaaattaaaaaataataaaaataaattaaaaaaagaaaaactaactgttgggtgctatgctgactatcttggtgacgaaattactcatattccaagcctcagcatcatgcaatatactcatgtaataaacctaaatgcataccttccgaatctaaaacaaaagttgaaattataaaaaaaagaaaaatgaaagtcgtatagaaaagaaagctaagggaatgatggtttccagcttcatccatgtccctgcaaaggatatgaactcatctttttttatggctgcatagtattccatggtgtatatgtgccacattttctttatccagtctatcattgatgagcatttgggctggttccaagtctttgctattgtgaacagtgccgcaataaacatatgtgtgcatgtgtccttatagtaggatgatttataatcctttgggtatatacccagtaatgggattgctgggccaaatggtattgctagttccagatccttgaggaatccccacaccttatcttccagaatggttgaactaatttacactgccaccaacagcgtaaaagcattcctatttctctgcatcctctccagcatctgtcgtttcctgacttttgaatgatcgccattctaactggcatgagatggtatctcattgtggttttgatttgcgtttctctaatgaccattgacagaaaaccaaacaccgcgtgttctcactcataagtgggagttgaacaatgagaacacgtggacacagggaggggaacatcacacacgggggcctgtcaggggcgtgggggctggggaaggatagcattaggagaaatacctgatgtagatgatgggttgatgggtgcaacaaactaccgtggcacgtgtatacctatgtaaaaaaacttgcacattctgcacgtgtaccccagaacttaaagtataaaaaaaaaagaaaagaaaagaaagctaagggaaaaagtagataagcgatttcaaaatctcaagtaaaatggccttctgaagaagcagaaaaagtgggaatttctcaataggaagagaaggacaggaggactcccaaggaaacctctgcatggctctgactagattgtgtacaacgggtccagctgcatccctggctgcagctgccactgtttgtcaggcaaaggcaagtgattctccctaacctaggagagacttcccttaagaacaggactctcagttaagtgaaaagaaataaaatactctgagccagaaaattaaatcctgggtgaggaaactcaagttgtgatgaatgtcaaggaagatggagacagcctgcagctgttttcttttagtaggacgttaggtgtaagctggttcatccattcgactgttatgaacagccgcagacctgagggctgatttctgatggggatgtctggccccgtaacacataaacaagctggccaagagggaaatcaaaccccagggtccactcttagcagcaaaatgctcaaatcagatggatccacttggtgggtttgaaaatgatgggcttcaaggctcctccaaggatctactgatctgcacccattcaggagtagagtcagcaatggccataccctggaattgcagggattaaggatgactgcctatcccccatctctaactcaatttggatgccaccaacacttaatgtctacaatgtgccagatggcgagtcaagttctagcatgtattatttcatttaatctgtataaatattctaggatgcaggtatcactatcccaattttaaaggctaaaatattaaagttagaagaagtaactggccccagaccatgtctctgctaagtccaaagccaggattcaagtcactgggccccaaattcagagatatttatttgcaaagccttggcactgtctacaaggcactaggactggccttatttactgtctgcctccaggccctttatccctttgagatactaggataccacccaaaacaacctcacttctccacatataccccgtaggggctttgaattagaaatgttttcatcattgacagcttcaagccttctgtctttgaaatgcaagcaatttccccttctcactttaccatcacatatgagaatagatgctatacgaaggacatgttttttatgtatgtgtgtgtgtgcacacatgcatttgtgtgttgatagcatttttgtttctctgccaagccattctctttccttacccaattcccaaatgaaaaatacctaaataaagtttgaagaaggaaaatgtatttattatatatgtatttggcaaaactggactggcatcacccagtggtttagcaaagcatttgatgcagctggccttgccttttttcaaggttgaatgtctaggcatgtaatttattattattccattaagatggccgaggacatgtgatgccttcaactcttccttctgtatggagcggtgctttgcaatcagtaggcaggtgagatgagagttccttgtcaagaaccccatggctctgtgctggtatgagttgagttgtgatagcactgattatttcagataatgatgaacaataggcaggatgagtacaaatcataccctccactacaggcctgtggcatcagcgtaggaggcagccacttagcttactaggaggtgtagctcgttgacatgcaccccttctcttcctcctcttccatttagtggttcctggatgctgttatccaataacagaaataaagtctcctggctccccagttttgaggagaactttaagtgcaattgcccctgagggaagtaaaacattgacctaaactgacattgaggcaaaggtttccagtggattaggcctccaattcttagccttctagagctgttgtctactcagatttaaatgagcatttaatatagtccattaaaagtctggaagcagcaaaaataacagttgggaggctcaaaggtaaatgttgtggctccatttgtttatttttttagaactttttttttttggtttggggttatacgtgcatgtttgttatataattgcgtagtggtaagtctgggcttttggtgtacccatcatctaaatagcgaacattgtacccaagaggtactttttcaaccctcacccctctcctactttttcccctttttgagtccccagtgtctgttattactttgtgtccatgtgtacccattgtttagctcccacttacaagtaagaacacacagtatttgattttctgtttctcagttaattcacttaaaataatggcctcaagctccatccacattgctgcaaaagacatgatttcattctttttatggctgcatagtattctatggtgttgtgtttctatgtgtgtgtttcaaaggtaaaattttaagacagtgtgaaataaaataatcatttgcctttcaatgagattgaaagaatgaaacacacattcctgtgaaaagaatttgagaaccagagtaagagtgggaggaaacggagagcaatcatttagacactggctgcaggaggggaccacaatgctgactgtcttagcttcacttcactgtcctttgtaaaagcagtgccacagtctaggcttgctttggctagtctgtcactgacgtttttctcagcctgtcagtttctcttctgagttgtctatgtagcacccaacacagcatctctagcaggaggaaaaccatgttatttccttcatttaaccttaagaacaaaggtcaccctgcgggtaacttgtcttctactaagacagcctgtgagtttacagtgacgtgtgacagccagccaaaagtcttaatggagaccttgctttgactgagcagaattcccccaggggctgcattagcctcccagactgcagggcacaggcagttctggggattctctgggtcagtgataaagaagttgtcatactgaatcaatcccagagcacagacagccgatgaagtacatgagtttatattggcaataaaggcgacaaaggctatcatagtttaccgtgttgtttttttgtttctgtttttgttttttactaagtgcttttctgttccaaaaaaaaaaaagtaaaagatgctctccttttttgtcttacctctgcaccccacaacttgccttattaacgtgcatgggggtctgtggattttttggagatgaaagcaagggggagtgagaagtgtataataagaatgattgaattagaggaccggggctagaatggaggggtaagtgaggggtgcccaaaggctacagaatatcctgggttgttggggcaccaggcaggctgctggagaaatgtctggttctaaaatagcactgtccctctcgattggcatgtaccctaagagagaaaaaacatcagccagattctccacatagactaataaaaatatgacttgttctctcccttttctcattctgttttttacacactgggaaggtggacaatcccatgggggagtctctttgggggttgggggagagcagggaactacttccttctccttctacctgttgtcctcacacagggaaggcatggctggctgttcttattcattcagctcttcctctacgtaaccagcatgtacctggaccctccctggagccaggtggctcctaggtgccaggggtgttgcagaaacacagaggcatgccctgcccttgggagaaagggacccagccttaccatgctgtgctaagtgagagaggagaggaaactcaacctagtctggaggccaagtaagactgtccaagacaggggatacagaagccaagattggaaggatgagtgggccttggtcattcttccaggcagaggaagactcttccaggtggaggaaactcacctttagaggcagagtgcagcttacaaagagggctgcacaggggtgtgatgggccacatctgaggtcagtcaccaacatgcacaattccacctttttccttgacattggtttagaatacttttctaaagataggatctcactctgtttcccaggctggagtgtagtggcacagtcatagctcactgcagcctccaattcctgggctcaagcaatcctcccacctcagcctcctgagtagctgggattacaggtgcacatcactgcactggctaatttttttaatttttgtagagataggggtcttgctgtgttgtgcaggctggtctcaaactcctggcctcaagtgatcctcccactctggcctcccaaagcactgggattacaggtgtgagccaccatggtgggctggttcaaaattttaacatcagctgtaacccagccccgtggctctatgcacataacaggatgctgcagagtagtgatcctccctcccctctttcactccagcccaggtttaagaacagtgtaaataccggtgcaacacccagtgcttaggtccatggcaattctccttttcagttaagttcatcccccaaagaaggaaatcactgctgggcaagctgccagtcttgatgtgcaacattcacttccagctgcctgtggagcaggactgtggacatttgtagatgctgggatgctcaagggagattttgggtgagtagatgtaggtttgagagtcactagatctattgatttattgaagaaataagatctatctgcaggaatgcctagagtgagaagaaaagaaattatagacccgacctgtgacagaagaaagagaaccctacaagaaataagaaaagaaaaaagaagagggaagaaaggaaagaaaggaggaaaggaaggaagaaaggggtgaggaagacagaaaaagatcaaggggaggttgaaaatgacaaacatgaaattgctcagaaacagaacaagcggtcaatgctacaaagaggtcatgtagctaagaaaaaagaagaggtccttggatttagaaataattggatctttagcaaccttggcaaaggcagttgcagcggttgtcatgagctgagatgtagatgggaaaacaagagtttaccagtgagggagatgtgggggggagggaagtcgtggatgtttcatacaggctttttgttattgttattgttttaatattgtagagatttggatatggtaaaatgctattaggaatagaaaaaggagatgaggggaaaactgatgaaatccaaataaagtgtggtgtttagttcacagtattctaccaacattgtttccttaatttgggctgatacaccaaggtaatgtaccaagataccatgtgcatgctagggaaagatgggtaagggtatatagaaattctctgtactatttctgcaacttttctggaaatctatagctattccaaaacaaagggtttactttaaaatcagttattgggaaggtgcttctagagatggaatggtaacctagggcagagaaaggtgcaagactggcaggaaggcagggccgatgaccagacccaggaggaaagtttgggcagagaggaatacctttgtagaattgcctgtgggaagttcaaagccagctcgtagacagtatctgctttctctgtcaaggagaaggtcctatcattggttaatatgggggaagggagaagcacaagatttaggaggtggaaattcttttaaaaaccgtgttataatggcagggaaagaatacctagggcaatgcttaagaatgtcagaatgccaaggatgggcttttaggtactttcttggctgccagttatcaatattctatctgtcactttaaaatattcagcctccggttgcatatgccacagtccaggttaatactgtcagattgtcttcttgccctattccaaggaaaaaattaaactgaaagcagccttctagattgactgatgtccaatgagggtgagctgaactttcagttgtctagatttatagtaacagacacagacacatccataaaattctctaacctcatttcaattacggctttcaaaggtaagttaaggccatatttgaatttgcactctattgttcatgctttgcctgtcttactctggctctaagcaaatcttcctcatccttcacagcccggctcagttggttccttttctgcaatcccacctcaggcaatgtgtctcttccttcctggtgcattcacaccactttatatcttcttcaactagaggtagtgtggatctcactgaattgcagtcgcttgcttgtttatttaatgctctggtagtgctagattagaataaatacatagtacctttcaaacactaaatatgaaagtatttccttgtaaaggtcactgtaagtggtgattggagagtttcttattcatgtagcctacatatgctagcacccagatacattttattaaaaatgtttggctggcagggcgcagtggctagtgtctataatctcagcacttagggaggctgaggcgggcagatcacgaggtcagaagatcaagaccaccctggctaatatggtgaagccctgtctttaataaaaatacaaaaattagctggatgtggtggcgtgtgcctgtaattccagctacacgggaggctgaggcaggagaatcacttgaaacagggagttggaggttgcagtgagctgagatcgtgccattgcactccagcttggtgacagagtgagattctctcaaaaaaaaaaaaaaaaaaaaggtttgtcttagttttctttctatctttcctccctttcatttcctttcctttccctccttttttcttcttatagaatataatatacacatatcagttggactacgccaacattttcgtgttttaacatattttattatgctcccacttcattttagtgcgttaatgacactctggtggctatcatgaccaaattaaacaagaaatggtagaggaaaactgagataaagacagcattgcacgcagacctccactgagtccatattcagaatggaagtcttgctgaattgcaatttccaaaaccatggtccctcactcagaaggaaccactctcatttcagtccagagagcttctagggcagtagggcatctgagacaaggggatactcaggttcttactcctcactctgaaattctcagattgcttgttctgtgaatacttggcagcaagcctagggccttgtgaaaagagggcagtggaagaaggaaatggagactctggactgatgtgggagcagcggccacagaggaagaggtggtgagatgcaataacagattggagatctggagcaagaactctgactgtgcgagtgaaaagtgactatagttttagtttggagatgtcatttcccagagctagtgtgctgcaggcaatatgaaaggtcaatgcaaaagagtcagccagagagttccaggaaggtaacacagggctctccccagctgtccagacagctgtcgctgacaaatggtgtctgtttctcgctcccacagcacatcctatgtgctaagtatgaccagcaagggaagatgagaaaccactctcaatgcctaaagctgtgaagggcctatgaccctttgtcttccatttagagaggtatgatcacttgagtactttgctttagggtttgtgggatgtattatgtatgttcgtatagagagatgtatggaatgaacaagaccagttttagcttagatgcatttaaataggattcatgtttacaattgaaaggcaagacattttttatcccacaattttttttttaagagacaggatctttctctgtcactcagggtgaagtgcagtggtgtgatcatggctcactgcaacctcaaagtcctgtgctcaattgatcctcccatgtcagcctccagagtagctgggactttttttttttttttttttttaaagagatagggtcttgcttcattccccaggttgttctcaaactcctgacctcaataaagtgatcttcctgtcttagcctcctaaagtgctgggataacaggcatgagccgctgtgccctacccttatcccacaattcttagagaaaacaaaacaagcaaaacaagaggctaatgagaaattggctcatctccatgtgaaaaataaactttgaaaccactagtcacaagtggatcttgttctgagaatgaagcataactgatgcttgacctgccctttcgggaagctgtgtttagccgtgataacctttgcatgcagtctgctgcagtgctgggtcacagctgagaccccttgggaatgtcaccattcccacggtagctccagtaggaaggctactgtgaatgcttgcgctgtcatagacctgctgtcggcatcaggctgttaccagctcctgctaagacaaacacagtgaagtccagcatgtacccagcactggatggaccatgaataatttcatacccacagatagtggcaatagtgtgatctttaagaattaaatatatacacacacacacacacacacacacacacacacatatatagtaagtgacaataacagcacccctttttcctccccagtaaatcatccagagagcaagtttgctgacagcagatgccaagacaattgtctttgcacctccagggctgctacagagtcagagccaagtccctaagcctaattagatgtctccccatacaaggcttaaacaagcacatggggaagccaggtctctgatgagtaaagaaagagaacacaggctatatcagggtcatgtggacaggcattggtcacagatacagatgactcattttcagtctgagatgttgaaagaaatggaaatgactcccccatctcccaacctccagccccacattcagtgtctattgtcattggtttgggtctgtctgggtgaaggcttatctcatcagagaggaatctgagagtctctaataaggaaggtggcaaatgtcaagtgttaggtgtgcatgtttgaagctagggtcattttttttttaagttatttatttctcttggctgcaaccaacccccaccccactaaatctcaattcctcctctaaacccctaatcatcgactgggtgcagtgggtcacccctgtaatcccagcactttgggaggccgaggcaggtggatcacctgaggtcaggagttcaagaccagcctgggcaacatggtgaaaccccatctctactaaaaatacaaaaattatctgggtgcagtggcatgtgtctgtaatcccagctactcgggaggctgcggaaggagaattgcttgagcccgtgaggcagagattgcagtaggtcgatattgtgccactgcactccagcctgggcgacaaagcaagactccttctctaaaaaaaaaaaaaaaaaaaaaaaaaggctctgcagattcatttactcattcattcattcattcaacaatattcattcatacatgccaagtgtgcaggcactgtcttatgctctgggagcagatgacagtgttcattaacacaaggctttagttccaaaccctattctttcggtgctacccaaagagagctgacctgaatctagaggagcctcttcaactagaacgactgcaaaattctgccccatgacacctttctccttggccacctagttccttccttcctgaccttctccaggacacagtacttgcttgaacttgttgacatctcagacacaatttttacagggcacaatccagaaagagagggcttccaagaaatgccaatcccagggtcagtcctccaagagaagattccagaatgggtgacttaaagaggctttgtcatgtggactctgaagtcattgaccctttgctccacacccagctactcaaggacaaaatgtcctcagctttgaccctcttctgcaacacagtgacatttaggtttttttgtttgtttgtttgtttttgtttttgtttttgtttttcttgcccagcacaccttaaggaggactcaggtaaaaggagagggactagaagcccttttgtagggtttcatttgtgaccatggagatccagcttcagaggtagacatcggacacttttgctttagtctctggtcatccacttttagcttctctgtcctttcttttggtaaggtcgctgactggctagattgattaaagtgtattctatttctggactgataaaattttgttttgaaggcaacctgagctttttgggtggacataggattcactggtctccttgaggtctttcaggttaatgacttgtggtgcgtcatcagatcacattagacttggccttagaatgattagataccaagcttataagaatctttgaagacattaaggctaattccttcttttgtctctctatttatctcttaaatcccctctgccacactctgagatatagttgtctgacctccttttgaacagtcagtgacagggacttctctgtctcaagatggcccagtcagtccactgatagctctaatggacagagttctcctgtgatgggaacctggtttcagctgatatggcctggctgtgtccccacccaaatctcatcttgaactgtagttctcataatcctcatgtatcatggaagggacacagtgagaggtaattgaatcatgagggagggtttttcacatgctgttcttgtgatagagaataagtctcatgattttataaagaacagctcccctgcacacactctcttgcctgccaccatgtaagaagtgcctttgttcctcctttgccttctgccatgattgtgaagcctccctagctatgtggaactgtgagtccattatacctctttttctttataaattacgaagtctcaggtgtttcttcattgcagtgtgaaaatggactaatacacagcttatattaaactttttgtttgttttaaagtcaaaacatcactctctttatatagaaccatttcaacaactggcaaatttgtctctggtgaagtgcatatgttgggatttctatacccaatagaaaatgaatgatttctcttagggatttggtcagggacacagaacacccctttcctgcagctggagctcaaaacagacaactgtgggctcattgaagtcctattttctgatccagtgagaagattccatcagagagagaacttgtgttttcctgactccatctgcttgaataatttagcttaagattccagcacattgttgtcacttccttctctcatggttggtgttgcctatcctctcttgtactgatattttagggccagtgcaaggccatatttcttaagcttcaccaaatatttcttaagctttgccagggaaatgagaatccaatcagtagaaggctcaaatagcctctgttcaaaatgtgtgatactttgagctgggggctgagcatgttattctttctgcaggcccatgagtttcttcggggagggtgttcagggatgagcaggtgcacccccctggctgtttggttgcaggttagtgcccattgtcttttcagaacagaagccccatgaacatggttcatagttaaccactcctagcattattagcaaaacagtgctgtttgccaggttgtggctgtgtggacttgtaacataataagaaatatatatttggtcttcatctcttgttcctgacacaagagcttgtaagacccttggaatcctagtagtgataaatgtgtctttttgtgtgctaatggatgattggtggctggggctcctagatagcttcaggatgggagttgcagttgccagaggtaccagccatgtgatgagagtgtcagaactttcaccccccaccccccaccaacagcctcctgggagcagagagtggctggagatggccaataatttaatcaatcatgactacataatgcaacctctggccaataatttaatcaatcatgcctgcataatgcaacctctgtagaaaccctaaaagaaggggttcagagagctttcaggttggtgaacaagtggaagtaccagaaaggtggcatccccagagagggtataaaaatctctgcaccagctctcataccttgacctccatacctcctcatctgaccgttcatttgtatcctttataatatcttttctaataaaccagtaaatgtaagtaaagtgtttccctgagttctgagagctgttataggaaattatctaacctgagaagggggttatgggaattctcatttggtaatcaagtcagacctaagtctgggtgacatggggaccctctctttggaattggcatctgaagtgggaacagtcttgggggactgaacccttaacctgtggggtctgtgctaactcaggtagttagtgttagaatgaaactaaattgtaggtcacccagttggtgtctacagagaacaggagaactcctgggtatggaaaatccacacatttggtgtcagaagtgtagtgagcatagaaaaacaatttcctttttaatgtctttgactcaagagtggagaacattagaattcagcagatcttgaagattataagggggatgcttttaatgacagaaaatgttgctaaggaacatggcggcctgaaataaggtaaaggaaaacctatccagaactaggcacaccagctacaaacaaaggaaaggatgatataatacttaaaaacaaaccaaaacaaaacctagttttgatgcatattgtaaggtaaaccaagaaagacttttattttattttaatagttttgggggaacagatggtgtttagttacatggataagttctttagtggtgagttctgagattttggcacacctgtcacccaagcagggtacactgtacccaatatgtagtcttttatccttcaccccactcccagccttccccccgagtccccaaagtccattgtatcattcttatgcctttgcatcctcatagcatagctcccacatgtcagtgagaacatacaatgtttgggtttccattcctgagttacttcacttagaataacggtcaccggttccatccagggtatttaggctcgttccatatttttgcaattgcaaattgtgctgttataaacatgtgtgtacaagtgtcccaagaaagaccttttaaaataagaactctgtgctccgaatggtgagaaagtcacactgtggtagggtggataatggcccctcaaagatgcctacatccttatatggcaaagggaactttgcagctgtgtttaaatgaggggttttgagatggggagatggtcctggattatctgggtgggccctaaatgtgatcacaggcatctttgtaagaggtggcagaaggagatttgactacacacaggatagggtgatggaatgacagaagcagagatggagagatgtgtcggaagaaggaggaaggggttgcaagccacaacaacaggtcaccactaaaagcttaaaaaggcaaggaaatggtttctccccctggagctcacagcagtaaccagccttgctgacaccttgactctagcccagtgaaactgacttcagacgtctgacctccagaactgtaagggaacaaatctgagtggttttttgtttgtttttgttttttaaatttgagtatatttaatttattgaaaattttaaattggatattatttgttgcttttatttccaatggcagtggcatttggaagtgaaatttaaaatgtaggattaggaagtagctttcacgtttacctttattttttgcaaatacctattcatatacatagattttcaactatgttttcataggatttaatggaaattgtcaaaaatgtctcaagataattatgatttttaaatgttatatttagaattactgatcaatttatgatcaaaactgcaaacaataattgtaaatattttgaagttggtgatactgtatttttccccactatttgctactctgattctttttttttttttttactttaagttctaggatacatgtgcaagccactgtgtttggggtaatttgtggcggcagcaatgggaaactaagataactgtctttactttttaaagtaattagaggaaagttgatgaaaatcttggagactgatcaaaggaaactacaatataactaccagaatgaccaaagaacaaatgaaaaagtctaatcatgaaaatgaggtgtggaagtgaattttaagtcttctctataagaagaaaatgtaggatttttaaatgcctctatagtgtaagaggaagatgtaaagatgataccgattttgtgacaaaatgagagcagtagagtctgagttattttagaagtagtgaccttaaggtcaccttatttgtcctgtcagatgagcaaaattagacatagagaactcaaggaaacgttcaaagtcagacagtaggaccatagcgagctgggaccacaccttgcttcctgcctccaaatttcatgcctccagcgctttttctcctactccaggattaaaaagtttgcaaataatctgtatgaaaaagaaaagtggtgcagatgattcaattgcacctcagtaacaggcctatatccagtctcctttatgacactgtttctgagtctgaacaagggagcaggaagacattactgaaatttgcaaatgctattaaactaggatgtggcgttagctgttatggaaaaaaaaataatgaatttagaaatattcttaaattttagaaatttttaaaagtagatttacttagagaaaacttaaaaaaaaatccagtagccaaaatagcattattttgagagatctggaaacttggcctgtttttcccattgtacagaaaggaaaatgtctttgaggtgaaatatcccaaatttttagtcccaaaagtgttcatattacttagaaatgtggaagaagaagatggagaaggaggagaggaagcaagacagaaggaagatagatagggaaagaaggagaaggaggaggaaaaacagcagcaatgtcagtagaagcagaaggaaaaagataaggaaacaacttacaaaggctggcaatttcttgctttccttcttctctttcagcatacataggcatgcccctgatcaacaaatatttactaagccagtgccaggccctgggttaggcactagagaggcatcaggaaataaaactcccggagcttcattctagtggagagacatgaaagaaattatagatatattaagggccgatacatactaagtcctgccttctgccctcaacccacctcctctctgcattctgcaaggatcagtctcttttgactgtcgctggacttttccaactcgtttaatacatttccaagcttttgaaagacttttctgagtgaattgcagcttaacaaagttcacttttatgctgtgttccatgtttcgaaggcagaggcatcagttttccctgagcctttaatcatccttcaggacttgccatctcagaatgaggtgctgcccttctgtgatcatggagggaagaagtggaacacgccctaagtgactgtagacagactggattcatttctggtccctgtctctttccagctctgtggccttaagcaagtaaatgaattcctacaagcttagggtctgggatccaaagaggcccaataaaataatactcctcttttctgcaggagttttgatcagctgagaattgatgcaaagtagtaaagcaaatgggtgtcaaaacagcacctgtattctgagtcaaagggaatctggcttatatatgaaggccaataaactttctcatactggatttcaaaatgcgcatacttacccacaccccatcactgtggtcctcgatccaggcagacctccccatactgaggcagagactgcacctggcaaagcagctgtgaaaatcagctcaggtgcattggtcctcaggaaaaagaaggaagaaggggaatctacacaggctcagtatctcctccctgttccttaattagattcagtcagttctcccacccagggccgggatgggtggagggggctgggaaaaaataaaatacaggggcagaagtgtagccacttaatttctctgcatacaaaaggaggcaacagaagtcaagaaaagtctaatacttgagtttcttgtctttgaaacaggattaatacacatctcatatgaaaatgatgaccatgctaagaatgatagagaatgctgtcaatatttccatatgagatgtgcattagtcctgtttcaaaggtaggcccggagcagtggctcacgcctgtaatcccaacactttgggagggcgacgtgagtggatcacctgaggtcaggagttcaagaccagcctgaccaacatggtgaagccccgtctctactaaaaatacataaattagctgggcgtggtggcaggcgcctgtaatcccagctactcaggaggctgaggcaggagaattgcttgaacccgggaggcggaggttgcagtgagctgagatcatgccattgcactccagcctgggtgacagagcaagattctgtctcaaaaataaataaataaataaataaataaataaataaagtgcctggaaaattgttacctgcttgcctcccttcctccctcttttcttcctccctcttttcgatccttcaatctttatctctcttcctctgtgtttagagaaagttatttgagacagcagtctatcctatttatttatctgtttatttatttattctttttttgagacagggtttcactttgttgcccagcctggagtgcagtcacgtgatctgggctcactgcagcctcgacttcccaggttcaagcaatcctcccacctcagcctcccgagtacctggatccacaggcatgtaccaccatgcctggctaatttttgtattttttgtagagacagattttctgatgttgtccaggctgatcttgaacttctgatctcaagtgatcctcccacctcagcctcccaaagtgctgggatcctatttataaattgctatgctgggatcccaaagtgcctggtctatcttatttattttaactgcctgaaaatttttactataagttatttctgttccagcagtagttccattttctctcacaaggctcaccctagcaagtcatagggtgtgtgtgtgtgtgtgtgtgtgtgtgtgtgtgtggccaaatgttttctatacattgaggttctcctcttgcattaccactgatcattattctatttaaagtgtaacgtgaaaatattatgagaattagtgccacacaaaactagtagtaaatcagaggtagattttgaaggatcaaaatcaaattttattttcctgtgagagaaggatgacatgctgtgagatgctcatatgtgattgaaagtgattatgtgagctcatgaaagtagaatcttaaggaagacaaaatggtgatgcactaggcttttggttatatattttcaggatgagatttataaaccctctgtcctttcccagaataaatgcttctgaatgttttcttgctttgagctccctgaatgtcacctggtttccgtgttgggggttctgcagcagattcccatataaacagatgtgctattcaggcctccggagacagtaagattctttttcaggcttacttctgaaactagtgcgcgataaaccaaatgtcacattgaacataagacttgggaggaaatacacatataaaacagctaattaaatggaaaaaatggtaatcataagcttgcctaattcaatcactgaaggacttgtgctgttaaactttaggccagatgcagtaactcgtccacccagcagaccagcatcatgggctgctggcagggtacttgatatctgttaaaaagcatagcttaaaagaaacaatggctaagctgtctacctctgtaggcttggctggcttttgcctaatcatcaagcatttcagtccctctttgagacattgtgcttgtgtatttcacaaggaagccacatctggcagctccttcgagcagcacagggtcccctgagagcagtttaggcttggtagggccacggtccagatggactgggggaggaaacgttgtttctagctctttctttgaaagcaaatcacatattctagtggaaaatattgcttttcaaacagttacctgagaaagcagcttcccagaatttgcggtgaattttagttttccgtggcatgatagatctttctctttgctaattgcttgatgaattgttcatcatgcaattagcaaatgatgatttgttcatttatttgtttatataaatgtatatggtcattcatttaataagtagttattgagcacctactgtttgcaagacattactctagggcctggggatggagtactgaacagggcatgacaggatccttgttctcctgtaacttaaagtctttgaagatggaaaacggtcaatgagcaaggaattacactcatacaattacatagtgcttactacgtgtcatgcccccaacaacctcatgaggtagataccattattatccgcattttacagacaaggaaactgagacacttatagctcaagggttcacataagtagtaaagaccttgaacacaggcaatatggttccagattttgttttgttcacttccacattgaaaatttaaaaagggcaaggtgatagccactctgtggccatcttacctggagaggtctcagaaggcccctctgtctgaggagatgacctataagttgaggtctgaatgacaagtcaactatgcaaaggtctagacaacgaactgtaagggcagaggttccagcgtacacaagcttggcatgatagaggaccagaaagaagatcagtgtgccaggcaaggcagaaagaagaggtacaagatgaggtggttatgcagaggccaaatcaggtagggccttgtaagccaagaaaaggagatggaatgtttattattattattttaatattgctatgctaagaaataaaatgaagtaaattgtaaaacacaaaatctctcatttattgtcaattattcatgcaattcttcatggctaaccaccacaaagtctgcatcagttagaaagaaaaaaatatgaactcactgaaataatggattttattttattttttatttttttttattttagactaagggggcacatgtgcaggtttgctgcatggagatattgtgtgatgctgaggtttgggcttctgctgaacccaatagtgagcatagtacccaataggtagtttttcaatacttgctcacttccctccttcctcacttttggagtccccagtgtttattttcccatctttaagtccacgtgtacccagtgttcagctcccacttgtaagtgagaacatgtagtatttggttttctgttcctgtgttaatttgcttaagataatggcctccagctgcgtccatgttgctgcaaaggacgtgatttcattcttttttttgtggctgcgtagtatccatgaggtatattttctttattcaatccacagtggatgggcacctaagttgcttacatctctttgctattgtcagtagtgctgcaataaacgtatgaatgtaggtgtctttttggtggaataatttattttcctttggatatatacccagtgatggggttgctgggtcagatggtagttctgttttaagttctttgggaaatctcggagctgatttccacaacggctgaactaatttatattcccactgatagtgtataagcattcctctttttttgggaaatctctgagctgatttccacaggggctgaactaatttataatcccactaatagtgtataagcattctcctttttctacaactttgctggcatctgttattttttgacttttttgctaatagccattctgactggtgtgagatgatatctcattgtggttttaatttgcattgttctgatgatgactgatgttgagcatttttttcatatctttctcggtcactagtttgtcttcttttgagaagtgtttgttcatatccttcacccacttttaaatggggttatttggtgcttttcttattgatttatttatgtttctgaaataagggatttaaaaaatcaaccccaggatctttaaatatatatacagaaaaatgtcaaccttctataacatctgtttctatgtcatcttatatagttattatctaaatatgcaagctaaaaaattgtcgaaagtcctcatgaagggtggtggtgcttccaaagagctatgtccacatttgttctacatcctgtattatttgctctcaactcggcagcagacattttttcacattcgaatgtttctaaaactggtttgcatcttacagtcaagatgcacacagatatactagcaagataattggcagggcctttcagaaattacaatttctgcatcttgcttggaaagggcaatatgagaagtgagttatttacaatttgcacagaaatcagagtcagtgaaatagacttttccagtgtatctgtgattcatcaggaaaaagacattggaggacattctcttttccttcattgcactcgagctctgatttacataagttaactcagtgggaacatggactcctgagggtgaggcctggatttcctgcccttaacaatcatgtgaccttgttgtatgtttcaccttcttagatggccctttggtattgagcctgtccttcctcacgtgtgcctccccttggtctcctgaagatacacccaattatacaggagttctagttcattgtcttttttgcaattaaagaatacatgcatatcttaagtctggtggaactatcatcatattgaatgtagcaacagaatattctattaaatacttttctataattttctatagttcctacttctaggctgcaagctaactcaccccgcctgcttctaccatgtcttacttataacaacaactagcatttattgggttcttcctaggggtcaaacattatgttaaattcattacatggatgttcttgtataattcctacaataattctgagtgataggtatcagcattagcttgtccatttcatggataaacaaactgagccccagagggaaagagtgacttgtccttgatcgcataaccaggaaacagcaaagccaaaatttgaatctagaatctggggactttggtgtgtcctccactcacctatgcccttgcccttcacccctgtacctaaattgacctggagaaagaagagtcactgtgtcaaggccatcccatctaacatttacctacaccctgtcttgcactgatcatagtgtgagctttatccaccaactagactggaaactccttgaaataggaattatgtctaataatcttcctgcaccctcccaatgcctgacacaaatgtccacatggtcatgatagggggatggattatccctggtcagctataggaaacctcatcagattgacccaaaagtgtctggttacctatcacaaacgagccccactttcctttctcatgggtggggttagtttcatcttctcgtattttactttaatatatggcagatatgcagtttcttaaaacttttgtgtatcagtaagagtcctggcaggaaacagatggtttactcaagctgggaaattaaggagcatttactaaagggattgtttgcaaaggcttggacagtaaaggataatgcagtcctccagggctggaggatacaagagctgtcactacccccctgtctaaagggacaaaaaatggggccagttaccagactccagaaaagaccagctggcaagagctgtggcagttggtaaatgaaacaaccagagcagcccggcagggagggcagggagagagcagaagaatgcacacctgggcttctccctcctccaacttccatctctgctggtgcctcctcttggctgaaggtaaccagaagctgaggggcaagtgagtccttggtgcagtcctgaagttgacctcctgggacaaaggtgacatggagaagggcaaagaaggcatttggtggagaaaggggttgatattcatcacagcttgtgagaaaagtcaggactgtcgcctgcagggtccaaaaatgtaattgatgaaaatagcttagctctcgcttatttaatacaattttcattcattcatcaactatttgttgatggtcccatatgtgcccagcaaaatgtacaaattgaaccagaatcttctagtcttaaaaaaaaaaaagtgcaactttagagatttgtgaaaacattcactgttaaaagccacttgagcaatataatgtatcctcaactctgggcctaatacacaactttgaagaaatgtgtgtgtgggagtgttgaataactggtaaaaatttaacatataaactttcccagaggctgttaaaccctattctcatggagcattttctttatgatttttagatagtaatattttagcatcatcttaccccataccactgacatttactatttgtttttacattaaaaaacatgagttctgaagtcctgagatgttatctcttttcaaagtagccaaatagattatattaatcattactttctagttggcagatataaaagacctggttgcacaactgtgtgagtttctttagagcatcctggccttaaattcctacttgggataataatgaagcaaaaataaataagaataaaggtgcttagaagaattgataaatatgaaattggaaccatatgtaaggaccacccttgtttttaggttgttgctatgacaggtaaattgaataccataagaacctggtatgaacgattggttgattagctagaactatgggcagtttataatagcacaaaagctgtagaggctttgccttagcatcacaacattgctgctgattgctattattttggcagttttacttctcatataataaaatcagcttattatctgctaggcgttgtggagctagggtctgctcgcttgcatcccagctttacgtcttccctgcaagctgtgtaatcacattctgcagggagagttgaagagagaaatgaatagagtttcagaccaaataatattttttgaaaaacttcagaggacaatgccatctttaccggaagggtgcgttagtttctgagatgactgtactgctttggactagggttccagagacccaggacgtgctcctggctaggtgaccagtcactgctcctagagcagggctcctacctctccaagcctttatttcttctattgtaaaatcattgcacttacttttaatgatcactaagtttttttccagttctaaaattacatgattttctgttaattgcaacaaaagccaaaattcacaaatgggatctaattaaactaagagctctgcacagcaaaagaaactatcatccaagtgagcaggcaccctacagaatgggagaaaagttttgcaatctacccatctaacaaaggtctaatatccagaatttacaaggaacttaaacatatttaaaagaaaaaaaaatcccatcaaaaagagggcaaaggatatgaactgacacttctcaaaagaagacatttacacaaccaacaaacatataaaaaaaagctcaacatcactgatcatcagagaaatgcaaatcaaaaccacagtgagataccatctcatgccagtcagaatggcgattattaaagagtcaggaaacaatagatgctggtgaggctgtggagaaaaagaaacacttttacactgttggtaggaatgtaaattagttcaaccattattgaagacagtatagtgattcttcaaggatctagaaccggaaataccatttgactcaacaatcccattcctggatatgcactcaaagaactataaatcattctactataaaaacagatgctgcatatgtttactacagcactgtttacaatagcaaagacatggaaccaacccaaacgcctatcagtgatagactggataagtaaaatgtggtacatgtacaccgtggaatactatgcagccatcaaaaagaatgagatcatgtcctttgcagggacatggatgaagctggaagccatcatcttcaccaaactaacacaggaacagaaaaccaaacaccatatgttctcacttgggagttgaacattgagaacacacggacaggagaggggaacaacacacactagggcctgttggggggtgaggggtgaggggagggagcttagagaatgggccaataggttcagtaaaccaccatggcacacgtatacctatgtaacaaatctgcacattctgcacatgtatctcattttctttcttttcttttttttttttagaagaaataaagaaaaatatattaagtggtctttaaagtatatatatatatatatatatatatatatatatgtatatatatatatatgtatatatatatatatatattttttttttgagacggagtctcgctctgtcacccaggctggagtgcagtggcacaatttcggctcactgcaagctctgtctcccgggttcacgccattctcctgcctcagcctcctgagtagctgggactacaggcacccgccaccacacccggctaattttttgtatttttagtagagacggagtctcaccatgttagccaggatggtctcgatctcctgacctcgtgatccgcccacctaggcctcccacagtgctgggattacaggcatgagccaccgcgcctagccaaagtatatttttttaaagttctgtagcataaaacactaaaaacaaatgcaaataaattcatctagcctccatggataaaatctgtcatggatactgagggtggggttgatgactccaaaaacctacaagctgttcatattacctccatcacattgggtgcatttctatttaagataagtacagtctatgttctataaataatgagtgatgtacataagtacagtctatgttctataaataaatgattgaaaagcctaggaaagtgatggcaccttccgtgtgtggaattcttggccagtccgaaagctgagaaaggcaaaatatggataaggaagcacttacagacgatgggcttatttgtaattattaaactgacttcaggtcaataagaatggacatgtttatccaaatatcagacttctgcccacctcagatcactgcgagaaaaacacatctaagcattttgaagagctgctagcaaacatcttctttaaagaaatgtattttgtctgtactcactcgacatttatcggctctgatttcacctgaaattctcaatttaatatgcagtgtaaccaaaaattttataaactagatgattgtatctctcagaccaaagtatattagcaacaaactgggagtcaggttaaaaacaaaaacatgaaacacttggaagtgcatataacagcaagggaagtgagacttcagagacagtatctgtggtattgataaaacaaataaaaggtacacagaaaatcatataattaatgtttataataaagttcctgtataattaattatatactatttgcacctgcatatatttaagaagcagtgtatagtattatctataaaggctttcattaaaataattaatttttcttttggtgctatgagtttcaaacattttttaaaatcacttttctagaataactgaagcccacctaatggtggataaatgtcagggtcccaacagaaaacagatggcacatacacattatgataatctagatggtttgataataaaggtcctgattacaaaagagactgcaaggtagattgcaggacctaataggagccatgatgtatccccaatccctgtccaaatggcaagaggaagaatcttctagaaccaggaaacagtaaaaatacagcaggcagcctgaggaccttctgttaaagcacacaacaacactgggagccacctcacaggagggaagcaggtcagtaaattatctggctacagtcttctcagttattccagtcagctcctggggtcctcattcactaaacacagctagaagccagaggtcatggggacccatgatgtcacccataaaggtcagcctccagggactgagagaatggtagggaaaggtggagtgtagaattgagggtcaaagaaagatatcttgcatactacctgtactgggttatattacattaccccccggccccaacaagagatatgtctaggttccagccccagtacttgtgaatgtgacctcatttgcgctcttgcaaatgtaattaggttgtgatgaagtcgtagtggattagcgtgggttctaagttcaatcactggtgtctttataaaaggaagcaaagggagattcagacacaaagacacagaggatacacacagagaagaaggctgtgtaatgctagaggctgagattagagtgacgcctgtaaagccaaagaacaccagggattcccagcaaccaccagctcctgggaagaagcaaggaaggattcttccctggagctttcagaggcagcgtggtcctgcagacacctggatttcagactttaggcctccagaactgtgagataatacatttctgttgtttcaggcaacacagtttgtgataatttgttatggcagccccaggaaactaatacacacagaaagcactcatgttgtttagggccatgataatacaaatacagttgaagtctcctttcattctttttttttgacagtgtttctctttgtcacccagactggagtgcagtggtgtcatctcagcttactgcaacctccacctcccgggttcaagtgattctccttcctcagtcacatgagtagctaggaccataggcacctgccatgatgcctaatttttgtatttttagtagagacaggttttcgccgtgttaggcaggctggtctcgaactcctgacctcaagtgatctgcacgccttggcctcccaaagtgctgggattacaggcatgagccaccatgcctggcctgattctttctttcaagtggtcttatgtgagctaggttacatatgatgtaattatagggacggagctttttaggagtgagggaggagcgcacctactatgactgaaaaatggtgttcaaaatcccttgggttggagagtagcatggggacacaaacaaacactcccatacctggctgcttggtggcacactgaccacccagccttctggtttacctgaaactcattcctagaaccaaggctccaaattccctgtggttggcccatcttttacttgtcttccttccagattctgtcctctgtcacgatatacatccggcagtactgtcccaattctgttcaccagaatctgcaccttacctagccccactatcccatgttttatatgttgcttacaaaatggaaaaagaaaaagaagccaggttataaaaggtggctgagaagaggctccatagaacggcccattagtctacttattttttccccatggcaccttaacttaatttggcatcatcataagtaaatgggaacttctgcttcaggccaaattgggataacagggcccaggtttaccttcccaataaaaacaactaataacctggtgaaaatataagaaataatgattttcagacattggggagcaagcaatgtaggacagggatgcctgagagaggggaaacaaatgagatgaaccctgggattgtcccagtttatttccaggaatcggtttccagactttagcacagggagagggaacccagtcaaaactgagaggaattgctgagctaagaagatgaagttgagagttcagggcaggccaagtgtcgagagttcacagggcatggtattagtaaagaaagaagtgaatacaaagagagcactggagatacagagaaggcccctcccatcttctgcttagtataaccagcatctatatgttgggaaacttcttaaggttggagaatgaaccactcaaaaggtcacgcagaactttcctcagagctcacgcaagacttggaatagtcggtgtttccaccaggcaaaataggaatgtgtcataatatatagggaatcagatagagtgcttcgatgggtattgagccaggcaaagtcaggaaaaacaatcagctctagaataaagtctgctccagtgcagttaactaatcttaaatgcaagccttgattgaatcaaaatgtttccaggtaactaaatatgcccaagaacaaagctcgtacataggtaagtatgtatatacaccgagacctctatgtctgtgcattctgcatccgtggtttcaaccaactacagaccaaaaatattgaaaaatttaaaataaaaatagcagtacaacaataaaaagatacaaattttaaaatttgtattactttgtatataatacagcatacaactatttatatacaatgtagcataacaactatttacagggcatttacattgcattaggttttataagtcatctagagatgatttagagtaaaaaaaaaaaggatgtgcctcggttatgtgcaaatactacactattttatataaggggcttgagcatcctcagattttggtacccatgggagagttctggaaccaatcccccttggataccaagagatgactgtgtatatgcatacgtatatgccatattcaacaaggtaaacttcacaaggtatgacattcaataaaaattaacagttgtggaagaaagcagggaaatatgacctgtaatgagaaaaaatacatttaaaacaatccaaaaataacacagaagatagaattagtgtattaggacattaaaacagcttttataactatatcccatagagtcaagaaagtaaagaaaaacatatttgtatcaagaaagacatagtagataggttgtgctaagttaaatactgtaagccctaacaccaccacttaaaaataaatacagctaataagccaacaaacacgtataatgtaataacaaaataaaaatccaaaagaagtcagaaagtaaaaaaggagcaaaaagcaattggaacaagtagaaaaaatagcaagaggatagatttaaacccaacaatatatttttaaaatcacattaaatgtaaacagtttagacatcccagttaaaaagcagggagtgttagaatcaacaatccctatacggggaggcatgcatgtgtgtggtgcatacttcaaatttaaagatacaaacatattacaagtaaaaagatagaaaaaggtctaccatgctaacactattcaaaaggaaactgtatagctatattaaatatcaaatgcagtagattttaggagaaagaatatcaccaaggataaatataaaacaatatttttatatttatataacagtacataaaatataatttatttttaatgataaatggatcagtcatcaggaggacatcacaatcctacatgtttatatgcacctaataacagagcttcaaaatacacaaggcagaaacttacaattataattagaaatttcagcagttgttacttaattagtgataaaacaagtagacagagaatcatcaagtatatagaagacttaaacaagacttcaactaaattgacctaaggaacatacataaaacattcttcccaaaaacagaatatacattctttgtaagtgcatacagaactggaacttttactaagaaaggccatattttggacgagtagctatattaaatataaactatttattaaatattaatatttactgtttagtaaatatgacacatattaaatatataatattaaatataaactatattaaatataaactgtgtagctatattaaatatcagatgcagtagattttaggagaaagagtatcactaagtataagaggtttattttttaatgataaatggatcaatcatcaagaggatgtaacaatccacgtgtttatatgcacctaataacagagcttcaaaatacatgtagcagaaattcacaattataattagaaatttcagcagttggctgagtgcagtggctcacgcctgtaatcccagcactttgggaggccaaggcgggtggatcacctgacatcaggagttcgagaccagtcgggccaaaatggtgaaacccggtctctactaaaagtacaaaaattagccaggtgtggtggcaggtgcctgtaatcctagctattcagaaggctgaagcaggagaatcatttgaacctgggaggcggagtttgcagtgagccgagattgcgccgctgaactccagcctgggcgacaacagagagactccgtctcaaaaaaaaaaaaaaaaaaaaaaaagaaaaaagaaaaaaagaaatttcagcagttgttacttaatcattgataaaacaagtagagaatcatcaagtatgtaagacttaaacaagacttcaattaaattgacctaaggaacatgtataaacattctttcccaaaacagaatatgcattatttgtaactgcacatgaaactggaattttactaagataggtcatattttggacaagacagaacaagtctcagcaaatttaaaaggattccatcatacaatgtatattctgtgacaagggaattattgatttaacaatcaattacagaaatatctttgaaacttcactcaactagttggaaattaaacaacacacttctgaataatccatcatcaaaggagaaatcagtgtgtaaatatctattttacaaactctttctgactactgtcataacatttcaatttcttatttctatttctgtttatgactgtgccaaactaaatgaaacaatcaaaacctaatgcttctgaaccttcttccaagtttcttgatagagcagctctgtctgcaggcgcctgcagagaaaagtggttcaagtgcctacagccctgctagaggtaaagcataggacattacattacttacttaggcatgggcaaagctttcgaggcagagacttcaaatatttaactatggttgttcagacagtcaaattatgggtaatttttgtttttcatagtatatttgaaatttttaaaatattatctacagagttaacaatacgtttataaacagggaaaacatcatttttattacaaacaaatatggaaggcttctgggttcacgaatggtgacgtagattggattgaacaaatcgtgtaatgtaatagcaagtataactcttagcagaatataaacaacaattattcaaagttactacagagtgaccaaaaacacacagaaactggaggaggtttgaccctggataatgggaccacattgaatcggactaacatttattccactttttccataaggctacccccttgtctgggtagcactggatgatgagaacttaaatatgtttgcattcatactggtttgacatgtcacagtgactggaaattgaggatgaccatctcggggaggtgaccacagaatgtagagtgcacatatttgcataaaaaatcccctaagaattttagctgacccctgaacatacatggagaatcccaggagcccagcaaaaagtggcaggtgaatgatttaaaaagctcagtagttcaagtactgcacggcacttagaagagagtttggaacttaaatttagtcatgttagagggccttggtaaacataaaattttccattgaaatttcaaaaagccaaaccttaggaatcaattctatatcccaagactaaacattcatcctaaaaataaatgtaaaagtgaaacagacttgccctaaccaaaggagaaaacaatcttccacaacgtcaggacagtcaaccaataattcaactgcctgctagaacaaagatctacaccgcacagaggaagaaaaaagaatccaaagcctctacaatatgtaatttactatttgattaataatatgaataatatgcaactcaatacatattacatataattatactacaattgaatatagtaacatggaaattgtgtcagtatatcatcaagatactagacatgtgaagaaacagacgtgaccaagaatgaagataaaaaactgactagaaactgtcaatgagatgccatggatttggagactagcagacaaagacttttaaatagcttctataaatatatttaagaatgtaatggaaaaggtggtaataatgagtgaacaatgaggaataccagaagagaaatgaaaactttcaaaaagaaccaaatagaaattttaaaagtgaaaactataacaacagaaattgtaaaatcctctggctaggcttcacagattgaaacagaaaacaagatctattaatttgatttcagatcatcagaaattatacgttatgaaaagtagagttaacaaacaacttcagtggagcagaaaaagtatctgaagaaatagtagccccccaaatctctaaatttatgaaaaacctaaacttacccatcaacaaatcttaagacaaccaattctgagaaatcaaacacacagtctctctcaagcacatcacagtaagattgctagatgtcaaacacaaaattctgaaagcagccaaaggaaatgatacattatatacaaggtaacaaggataggcaatgatgcatactctcctgacttctattcaacacagtattgaaaatcctagtccatgcaacatgtcaagaaaaagaaacagtctgggcacagcgctcatgcctgtagtgccagcactttgcaaggccaaggtgagagcatcacttgaggccaggagttcaagatcagcctggacaacatagtgatatcctgtctgtaccaaaaaaaaaaaaaaaaaactaaaaaaattagctgggcattgtggcacacatacctgtagcccccagctactcaagaggctgaggtgggagaattgcttgagtctggggcttcaaggttgcagtgagttatgatcacgccactgcaatttagcctggtgtcagagtgagacactgtctcaaaatttaaaaaaaagaaaattcacatatattttatacatgtggaaatataaggaggaataagagaagggaaaataaaaagtaaaagctgtttatatttacagatgagatggttgtttatttcgaaaatcctaagcaatgtacaaaacaactactagaacaaataaatttagcaaggccttgggattcaagagcagcatataatgatcaattgtatatttatacagtagcagcaaataattataacatgaactattttaaataaaaagtagctaagaataaatttaacaaaagatgtgaatacatgtacactgaaaactataaaacatttctgataggataaatagatgatctaaataaatgaagagatataccatgcccctggattagaaagtcaatattcttaagatgtcatttctcccaaaatttatccatagatttggtgcaattttgattgaaactgcaacaggcatttttggcaataggcaataaattgatgaatttattctaaaatttatattgagaatcaaaggtcctaaaatagtttaaaacatcttgaagaacaaaattggaaaatccatactacctgatatcaagacttctatgaagccaaaataatcaggacagtatggcagtgtggtaaggataggcagagaatggatacataaaaggtcaattgatttttttaccaaagtgccaaggcaattcaatatggaaagaaagtcctacctacacatgacgtggaaacaactggatacacaatgaaaaactaaacttttccacctacttcatccctcacatacaaattaatattgggtggacccaaaaataaaagctaaaactaaaaaacatctagaagcaaatataggtcaatctccttactaaactggctaagcaaaattttctttaagaaaagataccaaaagctctaaatgtaaaagaaaaaattgacaaattggactttaccaaaattgagaacttctcatcaaaagataatgggcattaataaatgaataagtaggccgggcacggtggctcatgcctgcaatcccagcacttagggaggtggaggtgggcagattgcttgagctcaggagttcaagacctgcctgggcaacatggggaaaccccatatctactaaaaatacaaaaattacccaggtgtgatggcacacacctgtattcccagctatttgggtgactgaggcaggagaatcacatgagcctcagaggcagaggctgcagtgagcgagatggcaccactgcattccagcctgggcaaaagagtgagaccctgtctcaaaaaaagaagtgaataagtatatcagaatatgtaataagctctaaaaaaaaaagcaacaaaaaatacacaaaacatctaattaaacagttgaaaaatacttgagcacatgcttcaccaaagatatacaaataatgataaacatgtataaaagtggtcaacatcattggatattagggaaatgctaaataaatccacaatatgtcatcatttcacactaactagaatggctaaacttaaaaagattaacaacaccaactataggtgagaatattaagaaactggaaccgtcatgcattggtggtacagatataatgggaaaaaaagtttggcagtttcttataaagttaaacaagctgggtgcagtggctcacatctgtaatcccagcactttgggaggccaaggtgggtggatcacctgaggtcaggagttcaagaccagcctggccaacatggtgaaaccctgtctctactaataatgtaaaaattagccagacgtggtggtgtgtgcctgtaattccagctgctctggaggctgagacaggagaatcgctggaacctgggaggcggaggttgcagtgagaagtgatcataccattgcactccagcctgggcaacagaacaagactctatctcaaaaaaaaaaaaaaaaagggttttaacatacatctatcatccagtaaatccacttctaaatatttgacaacaacacacacacattcacacagacacacagatacacagaaaacacctctacaagaatgctcatagtagctttattcacaatatcaaagtggaaataatgaaattttcatcagtgggagaggataaacaaactgtgctattttcataaaatggaacacaacacagcaataaaagaggtaaatattgatacctgcaaccacgtggatgaatctaaaatcattaagcaaaagaaggcagacacacactaaatactgtattattccattaatatgaagttcaaaaagagagaaaactaatttatggtgatagaaatcagagcaatggctgcttatggaaggaggtaggcattgattgcacagggacataagggaattttcaggaatgatggaactgttctgtttcaattgtagtggcggttacgaagtgtatacatttatcaaaactcaacacattttacgtttaagatctgtgcaatgcaaattttacttcaaaaaactcatctcagggaactccaaggggttattaaagttcttttattatgcaggggaggttttttaaatcaaatgttgtttaatataaaataagtggtgcatttgctggaacctggaaatgattctcctgtacttcatttctaatagtagtaatagttattattttaaagcaggattccatacaaaaatatgacaggggtgtgacagggctattcacaggaaagaagtagagagtctaatctggcatatgaaggctaatcgcaactgggtgagtgctctatatatatccttctacctgttttcagctcctaggtcactttaaagcctggattttacatcctgagactatttgactgtagagcttactctagtggttacttaagttccatgtcaatagtattaggctggtgaaatagtaattgtggtttttgccattaatagttatggtttttgccattaatagttatggcagaaaccacaattactttttcaacaacctaatagttataaaccacaaagaatgcatttttaccatatccagtttatgaaacgtggctcactttcttctggcagcttcctagacttctctacagccttctgcccaaggaaaatccatgcatgctgtgtgcctccaatgtctcttccgtttaaaaaaaaaaaaaaaaagtaaaggagctatttggcatataggaaaaaaaaaagtaaaagagctatttggcatataggaaaaaaaaaagattgtgtagaaaacaacctgactgagtctcattagggcttcctgatttatttcaggggttcagatctgtgtaagtgtttaattatatatgcattcatttttaatttatattttacccatatacacagccattctagagtttaaattcccttacttataacaagatattttcaagcaaatataattcatgtctttaccttccagagaaattaaaaaacagtatggcactgtgtcgaagtgatcactgctaagtgttgttttcatcatttaaaatatcattattattattattgttatgcttacctgcaggacaacattatcatcacataacagcctacataaaaactcttcaagagcccataacaacacatctttctgataggtaaaacattttgttaatattctagtttgaaggaatggggtcaggaagaactttggagagaccatttttatttttttgagtaagaattcaaatactatatgacatggttttgctgtgtccccacccaaatctcatcttgaattgtagttcctacaatccccacgtttcgtgggagggacccagtgggaggtaattgaatcatgggggtggttacccccatgctgctgttctcatgatagggagtgagttctcataagatctgatggttttagaaggcgcttttccccattttgcttgacgcttctccttgctgccaccatgtgaaaaaggatgtgtttgcttccccttctgccatgattgtaagtttcctgaggcctccccagccatgctgaactgtgaatcagttaaacctttttcctttataaattactgagtctcaggtatgtctttattaggagcatgagaacagactaatgcactatataaggattgaatgtttataacatgagaatgaattcattcatctctaataaaatgtatttatgactagaagaaaagatgtagttaaataaaaagcttccaaagaacctttgtttagctggccaaaaccacgattatgactttcagcagtaagtattgatctcattagccaatttcccatttctttgacttgcaattggagtaatcacgttatgtgcaatccatagataaatatgccaggctttccttttagccggtcctatacatttcatctcataccaaagctttcacctaattactcaaagcagcaaaagtacattattttacatttcataatctttcctctcctctttctttatttcaacaagagatatcagtaggtggtgacatcacaggagcaaactgcagtagtgttaaaattataaaattgccattaaattatttcatttaataaatattgattgattgccttactatgtgtcaggcactgctcttggcattgagacacagatgggaacccaatggataaaaatgttgcctgcctaaagcttatattctagtgtagggatacagacagtaaacaaggtaagtacatataggacatcataaatggtgacaattagaacaattataaagaaacatctaaataaagggaaattactggctcccatcatctgcgagccctgactgagaagaggttctttttccttaactgataaactcaggtccttccaatattggtcatttacttaatcacaacatgggctcagaaacgtgtcttccacctaatctgatatgttatctgagttcttacacacttcttacacacaaaattatattagctattgccaatttgtttgctttcgtgaggttgtttggactgagtgtttattgcaccagtgggaacctgggaagttagtctgttagtaggtaagggcatagattctggttcaaatcccagctctcaccagctgtgtgaccataggcagaatactgaacttctctgtgcttcagtctctttagccacagagaggggatattatagtaccaaccgcatagggttgttgtaataatgtgtattcaaagcagttagagcagtacctgacaaatagtttattaaataaaacaatacaaagaagattactttgagcatctgcttaccagggtttcaaatttaggttagattgaaggtcatgttcaatgcctcacccacacctaaaatattgccagtaactgccactttgttaactacataccttggaatgatgctagatttagtgaggttttttgtgaaactttaaagagatgatggatgtgtttcctagttacaatgtgattttgaggggaaaaaaagagtttctgtatcaaaaaggcttatctgctgtgtattcattattgccattttccctccacaagaaggtaagctccatgaaggcaaggtttttagttttgtttggttttggtttttgctttgtttctgttgtttacaaatgtatcccacatacctagaatagtatatatggcacgtggtaggcattcaatgcaatggttcaataaatgaataaaataatagataaacaagtgaatgaataaatgagaaaaagcaacatttaaaacctggttattaaaccaggtttaatttcagcttagtcactacacccagtagggctccatgacttacctatctataaaatatactcacttctgtaacttttttgaatgctaatgtatacaaggtaatctgctaaactgtgagccctcaaaaaactcacaatttggtagcacagatatgaaaggtacctaaataaataatgcaatgtactctaaaaagaaaaagaaaaggaaagcgagagagaactggcggaatcagagaagattccttactgacctttcaccttttagggatacttgaattgattcatatgatcctcccatgaagtcttcttcaatacatttgttgaaaattaagatatttgtgaatttcacaaaccgtgtgaaaccctgacaaaaaatacctgggaaattctagcaaaacaagataccctcatgtacaaaagcaaagaagccatgaaagaggacagttgttttctgggaaactcggatgagattttgtaagcctgattattttttagttgatttatatgtatttacagtttcagttgtttgttacttctcaaagttatttatgttatttagtttgtagaaatacacacgactgtgtgacatacgcatggtgagaattcgtttccctgacaatgattacttatatttgtacagaataacattacaaatgcattaaatccagacacccagaagaaattgcagccataaattttatttgctagaaaaaaaatagacaggaacatttttttctttgttttacctttttttaagattaatttttatgatattaaagaaaagactgcctggtgtgtttaaaagcaagtatactaaaagtcatttatgatcatgataatgcaagtactgtgaatgaaattttttattttaaaaagttgaaaagtgttcagtgttgtatataaaaagtgagaaatattgaggtgagaaaattagaacttctttgtaattaaatgctctagtttgtttgctgaaccatcgtcagatgtattatgaagtgaatacggtgaactggcattaaactctggaatcacaatgatagcacctaccacttactgagcattccctttacgtcaggaattcttctaaggcctttgtatttactaactcattgcatgcttataagactcctgtgaggtagatgattttatcatctcaagcgtagattaataaatcaaatgagaagcattgggaaattgcaatcgttcagggccagtaagtgatagaggagaaatctgaaccaagacccctctaatcccacaaccctgaatgactctacaccaccgtgttgacccaccatgatagtagtggtgatttgtagttgtaatcatggcagtgatccagcctctgcctataaagtttggggatttcttccccataagattactagcatttctttggtaatcgttacattgaagtgctgtagaattctgtgaataatgtataaaaagcagcttacaaaaaaagttcaaatgctaaatcttggcaaattttgaacatgtcttctatgttttcatggtgttagctttcaatcacatcattttttttttatttttttcccttggaatgtaatctcatcatttctaatccactgaggttttaaacacataaacgactcaatcacagacagggatacgggaggggaaaaaaaaacacgtattgagcacgaaaattgggccgggcctgctctaggggtttactggctttatctcaaataatatacaaaataattatattgttcatgcatgcatgcattcatgcattgatgaatttcaagttggagatgtataggtaaaaatgggttagggttagaagctgggaggggactgaccctgggctcaaaactatgaaaagggatggggtggggatggctttgggatgacattagagacggtttatcactatctgaaaaactgtatattttacttacttgtttattgtctgtttctctctagtagaacataatctccatgagggctcagattgttttttgttttctttactgttgtattttcagggtctactctagaacaaggcctagcataccataggcataaatactttttgagtgaatgaataaaagaatgaatcatttcataaatatttattgtgtggtgccagtcactccactggtgctggggtgttcatgatgtgagacactgcccttctcttaatagaattatggtctagtataagagatgaacaaacaacaggatattatcgtttggtatgaaaggcagtactgtgagaacaggaattccaaaagctctggtgtgatcctgtggacctaatcccattctggggaggcagagtggctttcttagatgaggcaagagcatctaagctgaaacctaggcaataggggagtagccagacaagtaggcaaaaggaaataagaagaacaaggctgaaggctaggaggaagcacagcttctcctaggaactccaaggttgctagtaatgtcctcattttagttatgagaaaattaaagctcagaaaagtaaaatgattggcccaaggttccagctcaggggctcacgcctgtaatcccagcactttaggagcctgaggtgggcagattgcttgagcccaggagattgagaccagcctgggcaacatggcaaaacgctttctctataaaaatacaaaaattatgccagcatggtggtgcacacctgtagttccagctatgtgggaggctgaagtgggagaattgcttgagcctgggacgtggaagctgctgtgagccatgattgtaccactgcactccagcctgcaagcaagcaagcaagcaagcaagcaagaggacgattccagctcagttctgtctgtgtccaaatgccatgatgtttttagtctgccgtgtgcaagacccacataccagagtttccttgtgcttgtgtgtcaaatcccctccgcaagtggcaatagcattttccaaatggaaaatggtgactgtttaattcctgcctagtatccttcatctcatctcttactattgaaaatattcctcagagaactgcaaagctaacttttcattgtttttctatgtggtataggctgggaccaaggtaaacatacatgaagttgtattcactttcttaggactccagagatccattgtgtggactaagatgtacatttaatcagtgtagcttaaaggattagaagaattcacccgccttcccgaaaggctgatgtttcccctggggaacggcttacatatggggattatcattgagaatcattacttaacaatttgctctaccaaattctgcaataaccagagactaactctaatggaagattggggatgttttaagataataccatctgcgatcccagcatttattccgcatgatgtctttgccttcttcgggagacttcatttatcctggcccacagaaccacacattttctgagttggaagtgtttctgtccttttattttgcatttctgggataaccattgcttcccgtgttctggactttgctgtcttcccttcacctttgtgtgttcagcgggtgtctcacaaaggtaggaatctgtaaaaggtagccggatttaatctgtctttgaaaacatggggggctataataaggtccactgctgagagaaatcactctgaatgcttcaaacaggcaattctaagtacctgaatgctcaagggtttttctatcatagcattattgacaagacccttcagtactcttcctggccattttctccatttagggacaagattgggaaaatctgagtctcagctttagctctgccatctagaattatttcaccttcgtgagcctcagcgtcctaacctgtaaaatgggaatggtaacagtggatttgcctatttttgtgttgttacaaggaacaaatgagatgtatgtcaacatacttgtaaactataaagtattctgtagatgtaagctgttaatattgctattactacccatggattgagatacaagtggatattttcatttcagctttcttattatgacaagtggtcatttcaagcatgaggacttggctcagatggtgtagaaacatgctgctgaatgtcagtaacacctctgtaacacttggactgcattcattcacaaaagtgaagaagaacaacaccaaatgcaggaattttgcatgaggagttctattaatgtcacttcttgtctacttcctgagagaagacagttgagaacttctagaattctgatcagtgatatcttacatattttttaaaggactaactttagaactgaggactttgtaaataagaagtaaattatccagaaggtataacataacagttaagagtttgggctttggagtcagcccaatgttctaacagtgttttagttgggattgtattagcttatgcttcatgaaaaaattaaccgtgaaatatcagtggtttaacatattatgcttgttcttttgtaaaaactgatgcaagtcaataacgattctcctccattcagtgtctcaggaatccagggtcctttcagcttaagacattatctcaatatatggctctcaacataccaaggaaaggggaaaagttcatataaaatagatacattagctgttgaatggctagaggtatcagctatgattgccatctatgtttcattgtctagaaaagttatatggctttgcccaactaccaagatatgggtagtgtagtcttcccctgttgccaggaaggaacggaccattaaggggaaacattaggcatattttctatacccgactcaactagccaagtgagttttggcaacttagatgttttcatgcataaaataaaagtaatagtagtttctactttatatggctattaggcacataaaatgagataatgtacatccaacatgtagcatacctggcacagaataagtgcataattaatgttagataatattattgttgtactgattaatggattaattgacccatactcagttatatcaagtgttaatgaagaaactccacggctgacctctgaattacttggagatttctcagcaccagaaccagctttatttccagaaggctttaccttttttcccacaattatgaaaaagttatacatcttacaatttctagagtatcaagagtttctcagtgaagctcttctcttgctatgaaaccaacaatcgtttaatttaaatctgttttatccaaaggtcagatgaaaatgcatttgtgtaataagatgtcaactcctgaagggtttgttattttccatatccactgagcaagaacatggtgggccatttccagggggctgctttgtttgtatttaaaaccatctgagctttcttcttctagtaagtcaatagacggaaagattaaagcagatgcacccagcaggcagaaaaattatgagtcctggccattgatgctagagcctcaatgaaagggaaagggggccgggcatggtggctcatgcctataatctcagcactttgggaagccaagctgggtggatctcttgagcccaggagttcaagaccagcctaggcaacatagcaagatcccatctctacagaaaaatacaaaaattaccaggtgtggtaatgtacatctgtggtcccagctgctcgggaggctaaggtgggaggattgtttgagcctaggaggttgacgctgcagtgagccatgagcatgccactgcacttcagcctggacaccagaaagagattctgtctcaaaaaaatgaaggaaagaagggaagggaaggaaggaaggcagaaagggagccaggaaagaaggaaggagggagggagggagagagggaggaaagaaggaagaaaaaaaaggaaagtgaaactaacatgtagattatctgctctatgctgggaacttgacatgtcactttaatcctcggagcaaacttgcaaggtgagttttattcctcagtttgcagataagaaaactgagtctcagaagggctgagtaactggcccatggtctcaaggctagtaaatggcatggcttggatttgaaccatgttttaagggagaggaaaaataatagaaagaacatacactttgaaccaagaaagagctgagtttgaatcttggctttgctactgattaacatggtatctagattaagttacttagtccagtttatctatctgtaaaaggaagataataataataataatgggcaataataacaagttatgtaggacttactgtgcccagttttttatatgccttatgtatattgctctacttaatccacacaaccacctgattgaagcaggcaacattattgtccctcttttatagaacacaaaagttcacagagggggtaagcggcagagcatgaattcaaaaccaagtgactggctccagagtccaagtccttagctgatagctgccctccattcacaagaataatagtatccagaacaaatgagagaacatataaagtgcaatgcatgcctattttagggcaaatacatgtcgttatcacttttctactctacaatactggtgtggtatttccaaggggatagcttccctccaggaagaagcaatctaacttgggaaccatggagcattgacccagctatgaatgatgcttcgctccttttatccatcaaaacgtttccatctcacccttatattgtcttggattctattcttctatggaacagacatttgcaatttctcccagtgtaaaggaaatcaaatacaggatgggactgtgctgtctccgttagtctgtagctggtaggtcgtctgcccaatgggaaggctgcgggtgatgatgtgggaggagattaaggcatttgagagaccatccatcaaacggcaagttagctggatagtataattgcttggagattttatcatatatttggcttttttgctaaaggagagcttaactataatccttttaaattgattagccattatttctgttgttgagccaagttgttaagaatccgtagttcctcattccctttcggttcattttatcacagaaatctgaaagatgaaggcaagttctactttcagacgtgcagttaaatggacagaaacaatcagaggcctgcaatctttagattcgagatggtatctaatgaattgggagggcactgtgaaagagagtacccttttctagctgaacagagagatgattaactacgttgactacaaagagcagtcattgtaagttactatggaaatattttccaaacctctaggcaaaagcacaggctcagtgaagacaaataactctcaaagttctttttttaggtgagtccataagggagctgcaacttaggaacactctctaatggccttcttttaatcttcctttatgacactgaatttaaaaagtaaaagtcagggttaagagagaaagcagtcttttaggatagctttgtgtccttacctctcaccccaaatttaagacctagaaaataaacagtacacacacattcacacacacatacacacacacttactttagcattgtgtatcataggaattgctagctgtccttggtgacttataggaacattagagtagtttcattcagcaaacataattgaagacatatcctgttcaaggcagtgggctaattacctcactgcattaaaaaaaaaatgtctacagcagtcaccttgatactgccttctaacccccttctaatcagttaccaaatcctgttgactctactgcaaagacattccctgtattcgtctgtttttgcattgctgtaaagggatacctgagactgggtaatttgtagagaaaagagatgtactgggccacggttcttcaggctgtatgagaagcatggtgccagcatctgcttctggcaaggacctcaggaagattccagccatggcagaaggcaaagggagccagtgtatctcgtggcaagagtgggagcaagagagtgatttggggaggtgcaaggctttttaaacaaccagctctcccatgaactcagagaacttactcattacgaggacagcatcaaaacattcatgaaggatccatccccatccccaaatacctcccaccagtctccacttccaaaactggggactacatttcaccatgaaatttggaggggacacccatccaaactctatcatcaccttcactttcttccagttgccacccatgactcgggcctgcaccaccccactggctcctcaccaggctccccatgccattccccttcctttgaacatcagtctgtcctttcaaaggcagatttcattctgtgacggctccattgagaactcttcagtgattcccagctgctctaagcagaacaacggaatccacctcacgctttccagagtcccgtgtgtgctggccctcgtgtgcctggccagtatccccacatatgccccttctggcttccctgctctccagtgtcacttgctgtcagtcgtttcctccaacaagccctgtcgtttcctacctcatagtctttatggatctgtgacttctgcctgcacaacttttcaccctgacttcacctagctaactcctagtcatcctttaggttcttaccttaaatattattttctcaaaagataaataaataaggctgggtatagtgactcacacctgtaatcccagcactttgggaggccaaggctggcagatcacctgaggtcaagagttcaagaccagcctgaccaccatggtgaaaccccgtctctactaaaaatacaaaaattagccgaggatggtggtacgtgcctgtagtctcagctacttgggaaactgaggcaggagacttgcttgaacctgggaggtggaggttgcagtgagccgagatcgggccactgcactccagtctgggtaacatactgagactccatcttggaaataaataaataaataactcccaaccaacttttcctttctcctccctcctcccatccaggcatacacctttgaacaccctttgcttttctcacctatttctctatcatcatggtttagttacattcttagttgcataattaatttgcaacccccacaaaaaacaaaccaacaaatcttcagaagaaggtggctgactgctgtgtcctcagcaccccacatacaagagttgctaaatatttcctattcgacaaataaatgaaattacattccattccctgagagaatgagaatatttgcaggtaacctcacatgaagaagcagaaaaagtaatactttgggagtatacttaagagagccattaattccctgtagtgggactgatgaaatctccatagaattaaagtggacttttaaggacaaggagaattaagagatgcaaaatagagggaaggtcctgcctattccaagataagtgcttggccaaagcaggcaagcatatgtcacttttgaagaatggtgagaagtcaaatccagctcatacataaggtgctgtagcagactgggtgcaggtgggtgggaggaagactgggttgaaagatggctttgaatgccacaccaaaaaattggggcaagcacatagataagaggcaggcttcaatgtccttgtgagggagtacacaggattttagcagtgctttataggtgggtaagaatgatccagatgaaaaatagtgaaaagcctggactaggctcatagtaagtacaatgaaagcaaggaacaatttaagagacagtgcacaaagcaaggtttctttgtatattgaaatcaaatgcacatttaatatcaatttgttgagaaaaacgtgacttttcccctgtgaacaattcattcttttaaaacaacattttctaaattttctggaaaatgagagaaagagagagagagagagagtgagagattgtttggttgattgtttctgttgcaagatgaaaaacttaacccgagcgagtttaggcaaaatggggaatttacaggctctcataccatgcgaaagctgatttgctgctggaagctctttttatttcttgctatctttcatctctgctgtactttgggcgtcagtttttactctcgcagacaggctcttcctgagctgtttcatgcacaggttgtcaccacacttcttttaggtgctagtagaaaactactggaaggttctcagtgatctagtagggtgtctcatccactaccgagcctggaagatgtgctctgtgccagccacgctctcgaaccatgggcctgacattgtctgctggactggatctcaaaataaagaaacatttcattatggaaagaaggaaaaggtgaggcaaagcagtggatgtcggctccatatactgtgacctatgtgctgaataggtcatatttgggggctgtaggtcaacacagtgtaggggaggaaaagattccctttcttacctattgcctggttcatggctgaggcctctataataaaagatatgctgggcacagtggctcatgcctgtaattccagcactttaggagactgaggcaggaggattgtttgaggctaggagttcgagaccagcctgggcaacatagcaaggaattatctcagtttaaaaattagccaggcgcagtggtgcatacccttagtcccagctactctggaggctgaggcaggaggatcgcttgagcccaggagttcaaggttgcagtgagtgccactgcacttcagtctgggtaacagagtgagaccttgtctcttaaaaaataaatgaatgcatagatttctaaatgacagataagagaaaaacacacacatttatttatttcatgtaaattttacatgacataggagccttccaaaatgaagacccaaagaaacagggaaacttgtgtatttttaggctaaatttgatgaagagtggacagtccatagggaggtatgactggacaaagtgggtaagatctattgtccaatcttattgttaattaagtgggtgattaactcgggggagcttagcaagccctgtttgttcagattctccttggcatctccttgtcttcgaggataaggacgtttctttcctctgggtatagggagaatatctctggaatgaaggtcttttgacctacttcagagaggaaggtcatagacttcttttttttttttttttttttttgagacagagtctccctctgttgcccaggctggagcgcagtggtgccatctcagctcaccgcaagctcctcctcccgggttcacgccattctcctgcctcagcctcccgagtagctgcaactacaggcgcctgccaccacgcccggctaattttttgtatttttagtagagatggggtttcactgtgttagccagggtggtctcgatctcctgacctcatgatctgcccacctgggcctcccaaagtgctgagattacaggtgtaagccaccacgcccggccagaattcttttatagcttcctgcaggggagaagggaaggaggcaagtcagaaacaccttcttgcttctgctgttttctcaaatgccaaggctggagtgcagtggtgagatctcggcttaccgcaacctctgcctcccagttccagcaattctcctgcctcagcctcctgagtagccgggattacaggcacgtgccaccacacctggctaattttgtatttttagtagagacgggttttctccatgttggtcaggctggtctccaactcccaatttcaggtgatccgcctgccttggcctcccaaagtgctgggattacaggcgtgagccaccacgcctggctacgttttcattcaacagagttggagatcaatcatttcactccagaaatagaagaatatttgtgtagtaaaggaaatagctgaatgtaatatttctgcttcttctgatcctactgtgcttcataattaaataatgtcctagatagccagggccaataaataaatggaatcaatattttacttaacaaaaacaaaaatagatgaatatggctagctgcttaatagttcatctcatatttcatgtaatcattcttacattgtttattttacaataagaaaatgggagctgacatctgtggatatgaactactgtatctaaggacagatagtttaaaacataaatacttaaaagagatatattgctagccttcagatatcaaagtcactaaaatatgaaattacactgcattgagaatgttcaaattatatttttatggattataaattataaaatttttataaagcctccagagaattttagaatttgtattggaagccattctgtggaattccataaaacactttaaaggtaggaattttcataggtcactaaggacttctgtagagccccataaaaatgcaatttccatgaaataccatgttaatgcattcccagtttatttatcttcttgcctttcctccagctgtaacctaacaatcatcctgtcttttcctttttacgttgctttcttgcagttgtatccagatgtaaatgagtgcattcattatatttcatatgcccttttgaggaccttattatccaaaaataatatttgaaatggcaccaagaaacattttttaaagccattggccaacagtgccatgcgtggggagcaggttgaagcagagacctaaaaacatttctaaataaaatgattagagagccatgaatttaatggcagcctctataactgtagaaaaattattttgcaagccctgcattcagaggtgtctctggtgctctctgtgtgtgtgccataggttggctggcaaaagcacattttcccatgtgttcttatacttataaactatctttaaaataacccttcagcttttttgtaatgtgataaatcaaacagatccaattaagcttaggaaaactgttctttttggcagcagctgagctaaggtggtatatgagtttcaaaaagttgccgtaacaaagcactgcagagtgagtggcttaagcagaaacatatcatctcacagttctagcggctggagtacaaaatcaggtgtgggttgggctgaatccttctgagggctgtgaaggatctattccagacctctctccttggtttgcaggtgctcgtcatctccctctctctcttcactttgttttccctctatgtacctgtttctgtgtctaaatttccccttcttataaagataccagttgtattagattatagttcaccctaatgatctcattttatctcgattacctctataaagaccctttctccaaatacagtcatattctgagatactggaggttaggctttaaacgtaagaatgttgggggcactcaatttaacccattacaaatgtgttgccctggccgtctggccgtgcaggctgactctgaccaatggaattactaggcattattctcatgtagagtagtgaagaaatgtaggccctagagttgaagagcctggattagaatattgctttggcccttcttacctgtctgaccaacgacataacctcacatagcctcagtttccacatctataaaataggggtatatgaagtacctacttcattgaatgttctgaggcttaactgaaagtgcttaatcactagaacagatattaactcaaacatggcaccttcttgttatttttatcatcaccaagttgtctatctgttgttattattgcccttctttgttggaaattttccataataacacattttatatgcatgttaacacaacaaatgggaattctcttggtctatttcagtatttatagctccgatgaacttcaagaaactatgactgaaagatactatatattgtgtctcaaatctgattattcttagaaaactagtgacagattgaatgaccctaccccgtatcccacccaaggagtacatataaaatattctgattccatctatgccttaaaaattactttgcccacacagaactggatgggaagttaactggattggaaattctagtccagattctactacttgaggtctgtgtctgtttcctcttctgtatagaaaaagataactgacttgaagctaaaattttatattttttagaacggaacatgaccagctcccctttaactagttccctgtaatcaggcagagcatacagggaggtggacaccaggtcagatcttgtgtcatttgtattggatattttacatgtagaatgttattagaatataaaatctctaaaagaaaaaagaaaagattttcaggtaccaggttgtgatcttcttaattcaagtattaggttgaaccatagtgaaacatacaatatttgaccttttttcgacctacaaaaataatggtttcatatggttcagcttaagagttgaattttttaaatacatattttaagttttgggatacgtgtgcagaacgtgcaggtttgttatatgggtatacacgtgacatgatggtttcctgcacccatcaacccatcatctacattaggtatttcttctaatgctctcccttcccttgtcccccaccccttgagaggccccggtgtgtgatgttcctctccctgtgtccatgagttatcattgttcaactcccacttatgagtgagaacctgcagtgcttggttttctgttcctgtgttagtttgttgagaatgatggcttccagcttcatccatgtccctacaaaagacatgaactcatccttttttatggctgtagagtattccatggtgtatatgagccatattttctttatccagtctatcattaatggacatgtgggttggttccaagactttgctattgtgaacagtgccgcaataaacatagaggtgcatgcatctttatagtagaatgatttacaatcctttgagtatatacccagtaatgggattgctgggtcaaatggtatttctggttctagatccttgaggaattgccacagtgtcttccacaatggctgaactaatttatactcccaccaacagtgtaaaagcgttcctatttctccgcatcctctccagcatctgttgtttcctgactttttaatcatagccattctaactggcatgagatggtatctcattgtggttttgatttgcatttctctaatgaacagtgatgatgagctttttttcttttctcttttctttttttttttttttgagacagagtctcattctgtcaccaggctggagtgcagtagtgcaatcttggctcactgcaacctccgccacccaggttcaagaaatcctcctgcctcaacctcccaagtaactgggactgcaggcgtgcaccaccacgctcagctaattttttctttcttttgtatttttaatagagacggggtttcaccatgttggctaggatggtccccatctcttgacttcatgatccacccgcctcagcctcccaaagtgctaggattacaggcatgagccactgtgcctggccgatgagctgtttttcatatgtttgttggctgcataaatgtcttcttttgagaagtgtctgcttatgtcttttgcccactttttgatggggttgtttttttttttttgtaaatttgtttaagttccttgtagattctggatattagccctttgtcagatggatacattgcaaaaattttctcccattctgtatgttgcgtgttcactctgctgatagtttctttattagatcccatttgtcaattttggcttttgttgccattgcttttggtgttttagtgatgaagtctttgcccatgcctatgtcctgaatggtattgcctaggttttcttctagggtttttatggtagaacactatgtaacagttgaatttttttttttgtcttgctctgtcgccaggctggagttcagtggcaccatctcggctcactgcaaccgccacctcccaggttcaatcaattctcctgcctcagcctcccgagtagctggggcttcaggtgcatgccaccacgcccagctaatttttgtattttttagtagagacggggtttcaccttgttggccaggatggtcttgatctcttgacttcgtgatctgcctgcctcagcctcccaaagtgctgggactacaggcgtgagccaccatgcctggccaacagttgaattcttaatccagtgccttagaccacttggccatgcaaccacccataatagttgaattctaagagacagaaagaatacgaactttatcttgaagctggttatagtgggatgacttctattagaggcaaaggaacagaaaatgactttaccccgtcccccagctgcacattaaaggtgaaaatatagtcacacaaactatcactgtggagttgcagcattttaaatgttataaactgcatttctgtgattaggaccaactggagaacaagtgcagcctgaattagcaaaaataaaaatacacaaacacacacacatgtataattttagaatgttgtttcaaaaagggtttaaagctgtgcctggcagattggacaaacatcatgctgcatccggagggcctctgcgtgtgttctctgggaaagcgtgacctgcagatcccaagggctcataaccaactgtatgtttcataactaactgagtgcagtctcactggcaaatgccctataaggcctcttgttcctggggccgtcaacggcagcagaatagaaggcagtttagtcattgtggatagagaggcttgtactttggatgcctttttgtttccagctagtttccaccttaaagcctggacctggacatcactctacagctgtgtgtggaaggagctagagatcacatcagggtgttttaagtaactggaattctgctacatttgaaaacaattagatcagaaacaaaacgttgccatctcaaggtgcttatcttgaggtctacaaggatgcaggaagcaaaataaaagagcaaaggcatagcagtaaatggatttttaaaataacccacagcaacacatcttcagcacagagggagtgggaatgctgccttctgtggtgacctggagttatatagggcccagtttctagtgcttgaggctaaggatactggggaaagaagcaccatactctgtacccacagggtctctgcagagtttgccatccggttaccttaacatgtttaaaatgcccactaactttcagcaagagtgggtaaaagtgtccctgtaacagacactgatttaatggcttgaccttgacagccatgattctttctaaccatgacaccatggcatgtcttagcccatattgccaacattgctcctaggacactggttgtcagtggagctgctgagcacatccctgctggcagacctggctttatgagtgtgtgggctgtgcagtctcactgagccctgtgcttagaagggccctgtgcctggtttaatgatctgttgtctccatctggagattcttaatttttgaataagagccccacattttcattctcccctgagatcacgctgactgatagacaacaagcctctgtgggcactacctttggagaggatctgccaagagactgagcaaaggctgtaagcattgttcgtggaattgagattaatctaaaaaatgggcgtgggggtaatgggactctgaagtctctaagagagcactgtttggagaaagtttcatagaaaagcacatgggaaaaggaagggccgggtccacataccaacccaccagggtgggctgccgccagtatgacacacgtgtgctctctcaagcagtagccatcagactacctgctgtctaccgtcagctgacagcaggtgctcttcccctgccctgccctgcagtttgcagccttcattcttgctatgaagcagatgtatgaagcttgagaataaaaacgatgctctcatcccctctggcatacagtcaatacttgttttcccaagctccattcctccctagaccttctttagtcttccagagaaagaggaagaagactggagattatagttttatgatttagactggtgaaggcctctgtaaccattcatcccgaagaaagtaataatgtagtaaggaactatgaagggactatgtgatgatgtaattaattctttttgggcagggattcaaatgaatattattcaaccatcacaggcagttttggttttaatctctgcaatatgtaggccatgtgctgcttcaaaaagtatagagtctttggtttgacaagtgacccttttattttaaaactaaatacatattggaaaagtggctaatctggtgttatcataaaattttgattttatacaatcagtattaataaataaataaagaattattaagttttaaaagaaaaaacacttggaaatatagaagaccctccccttttaaacaactcctcaaagaaaaagtgaaaacaaatggcaaaattgttagaaaatgataatcataaaaacatgacatatgactaaatatgtcatctttaatgctttacccatcgaaattaaatgaaggaaaataagggaactaagagtccagttcgataagtagaaaaacaactataaacaaacctaagaaaatagcaagataacagaaatgaataagaagatggtatgaggttttagaaaattacatggtaatttattataacaaaaacaaataacagaaggagacatatttgcaatacatgtgtctttcaggaaaagcatgaatttcttcaggtttatttttaatagaaaaataatagaagtgcaagaagtccacagaaaaagaaatacaaatggccaatacataaatgcaatgatacttgacttcataaagaaattgtatttaaagtggaagtgtattcaatatcacttattagaatgctaggtagtattgccaaagatgtggggaaatagcatccctctactgtgctggtagaagtgtaaatacaaacagttttggaggacaatttgacactattattttggaaagacatacaataatgcatttattttttaatgtttttcattaacagaaaaattctgaattacaaaagacaaatttaacctgcttattgatattgtttagaggtgaatatttacattttatttggtaatatataatttggtcctctaattgcttaggcacttagacattaggtaagttctagtgtctcaagcaactcacagaataatatattaaatgtgtgtgtgtgtgtgtgtgtgtgtgtgtgtgtgtgtatggaggacatgccttttttaaaattttactttaagttttgggatacatgtgtggaatgtgcaggtttgttacataggtatacatgtgccatggtggtttgctgcaactatcaacccgaatttgactctattaattctcctgcagataacctatcctatgtatatactcacaaagtgataatcccaacagaataccaaagtatgcatatgtgtgtgtgtgtgtatatttataaattcatatgtatgtgcatatataaatctaagaatctatattgcatcaaaggcaacgcttaaaacattctaagtatacatgttgaggaacatagtttaatatatgatgaggcatttacagaaaagaatagcaagaaactgtttaacaatgaatgaagttgatgggtatatgcttgatagggaaggctctgcaagagttatagctcatttctttttctttcttggctacgtagacgggttttatgtaagctgacttatggaaagcacccagtgctgtcttcttttttgtggttgtttttgacagctttattgagtcataattcacacagcatactattcatccatttgaagtgtacagtgtggtggtatttagtctatccacagagttgtgcaaccaacaccagaatcaatttttgacctcctcataagaaatcctgcatccattagcggttacttcccattaccacccaacccctggccctagacaatgacgaatctactttttgtctctgtatatttgcctcttttggatatttcatacaaatagaactatacaatgggtggtcttttatgactgacttctttaattttgcatcatgttttcagatttcatccattatgtagcaagtatcaatacttaattcctttttattgccaaacaatatttcattggtaaagatacactatattttatttatctattcattggttgatggagacttaaattacttctcctatttgaccattatgaatgataatgttatggatatttgtacacaagttttcatgtgggtctatcgtttttgtctcttgagtacatacctacaagtggaatttctggggcacatagaagctctatgttttttttgtttgtttgtttttttgagatggagtttcactgttgttgcccaaactggagtgcaatggcacgatctcggctcactgcaacctctgcctcccaggttcaagcgattcccccacctcagcctcccaagtagctgggattacaggcacgcgccactatgcctgcctaattttttgtatttttagtagagacggggtttcaccatgttggccaggctggtcttaaactcccgacctttggtcgtccacctgcctcgcctccccaagtgctgggattataggcatgagccaccgcgcccagtccgaaactctatgtttaacattttgaggaaaggccaaactgtttttcaaattggctgtaccatcttacagtcccatcacaatgcatgagggttctaatttccccacaacctcaccaaaatttgttattatctgtattatattagagtcatcctagtgtatgtgaagtgatattgtgattttgatttccatttccataatgcattttgagcatcttttcatgtgcttatcggctatttttatattttctttggagaaacgtctattcagatcttttgctcatttttaattggttatttatatctttactattggtctgtaagagttctttatatattctgggtaaaagtccctttatcaaatatatggttttcagatattcactcttattctatggattgtcttttcattttcttaataaaatcacttgcagcacaaaagttgttaatttctgttgaagttcaattgtattagtctattttcatgctgctgataaagacatacctgagactgggtggtttaatggactcacagttccacgtgggtggggaggcctcacaatcatggcagaaggcaaagggcacatcttacatggtagcaggcaagagagagaatgaaagccaagcaaaaggggtttttgcccttataaaaccatcagctcttgtgagatttactcactaccatgagaacagtatgggggaaactgcccccgtgattcgattatctcccaccaggtctctcccacaccacatgggaattatgggagctatagttcaagatgaggtttgggtggggacacagccaaaccatatcaccaattaattgatttttttcttttatcatgtgtgcttttgttcttgtattagaggtcaaatgcaagatcccaaaggtttactcccaagtattcttcttagggatttatagttttagctcttacatttagttctatgttctataatcaaatatgattcaacttttaaaaagaagaaaagtttgtcatttgctatctggaggaacctgggcaacattaggctgaaggaagtaagtcaggcacagaaagacaaatatcacatgatctcatttgtatgtggagtctaaaaagtcaaacttgtagaagtagagagtagagcagtggttaccaggagctgggcgaggtgttgcttggaaggggtaaatattggtcaaagggtataaagtttcagttaaacagaaaggatatgtttttgaaatctattgcacagcatgatgactatagttaataataatgtattgtctacttgaaaagtgctaagacagtaaatcttaaatgttctttccacacacacaaaaatgataactatgtgaaatgaagaatgtgaatgtatacccaaaataaaattctaaggccaccaaccaactgaatagacccctcctctctgccaagggcattctacagtaaacctaaaacactagttcaggccatgataggcataggtggctggacatacctcatttcgtcagcagcggtaagtctgtacaggtctgcagcaacctcagttcttgcctcctcaggagaaataattcaactgagggggggataaggcagagtgaggagaccaaggcaagttttacagaaggagtgaaagtttattaaaaagctttaaagcaggaacaaaaggaaataaagtgcacttggaagagggccaagcgggcgcttgagagatcaagtgaatgatttgacctttgacttagggtcttacatgttggcatactccagggttaaattacttctcccctgagtcttcccttggggttgttttcccgtgtgcacagtggcctgcccgcccttgggaggggccgcgtgcacagtgtgtttatgaggttgtacacatgctcttttgaggcgctcttcccttaccagttgaatattcctagaaggtcatttgccagttaaactccaccattttgcatcttagtgctcatgcttgagcccactcgcccaattcctgagatcttattgggaagctgctgatcaccagcttcaggtgtttctatctattgggagacaacctttccctggcccccatggcaacaaattattactttagagagatggctaaaaaatgtgtgatcatcacctacctgattggttgggggggaacctcctctgccctgttcatgtctgcctcactacctacagtaacaactataccttccttcccttggaattcagtcatggctgaccagtattaacattaaaacagagaccttaagaatgacaaaacagactctatagcaattggataccaacatgacagattgtagactctgagagaaatcaaagtattttaccctaaaatttattttttgacatattttgaaatggtcctgcaaagctatctcttgtggggaaaatctacattatgtagagaatccccttcccttcccaggtctttttcttgatccaggagaaaattaagaggttggcacctttttaagtctgaaaagaaatatttaccacctattctctctgaaaactgctacctggaggcttcatctgcataataaaaaccctggtttccacaacccattttcttaacccagacactctcttgtattgattccaggtctttaatcagaaaattctggaatccacctatgaccaggaagtccccacttcaagttttcccacatttctgaactgaaccaatgaatatctaacatttattgattgatgtcttacgtctccccaaatgtataaaaccaagctgtagcctgaccactttgggtacatgttctcaggatctcctgtggctgtgtcatgggccattggtcactcatatttaactcataattaatctcttcatgtcaaccattgtggaagacagtatggcaattcctcaaggatcgagaaccagaaataccatttatcccagcaatcccattactgggtatatacgcaaagaaatataaatcattctactataaagacacatgcacatgtatgtttattgcagcactatttacaatagcaaagacatggaatcaacccaaatgcccataaatgatagactggataaagaaaatatggcacatacacaccacagaatactatgcagctgtaaaaacgtatgagatcatgtcctttccatggacatggatgaagctggaagccatcattctcagcaaactaacacaagagcagaaaaccaaacactatgtattctcactcactataaataaatatagatatatgtaaattttattatacttcaataacctggaaaaaaagattctgcttgaattgaaaaggttctctttgaaccaacccaaagacacatgcacacatatgtttattgcagcactatttacaatagcaaagacatggaaccaacccaaatgcccatcagtgatagattggataaagaaaatgtggcacatacataccatggaatactatgtagccatgaaaaggaatgagatcatatcctttgcagggacatggatgaagctggaagccatcatcctcagcaaactaacacaggaacagaaaaccaagcactgcatgttctcactcataagtgggagttgaacaatgagaacacatggacacagggagtggaacaacacacactggggcctgttggggtttgggggtgaggggagggaatttagatggcaggtcaatagatgcagcaaaccaccatgtcacacatatacctatgtagcaaacctggaacttaaagtaaaatttaaaaaaaattttagaaaagaaaagtttccatttgaaaagccatctttgatttttttctctttcacttcaaaattgtgatatcactttgtcagctaatactgatgaatttaaagtttttttccgcatccttgttatgtagatgcagagaattaagtttaggagggaaaaaaatagctctaaagagggaaaagagaattattgaagaattttagcctatcgttataatcgtagctaccatttattgtgcacttattctgccttgcatctattattgtgtttgattttaaaaacaacctgtttcacagattaggaaactgagactagaaagattaagtaatatccccaaagtcatgctatttgtaaatggtagagctgggattcagaatcagatctacctgaatctaaaacccaaagatagattaccgttcattcctgaagtggttcccaacctcccatagggattgtgcagaaattctatgaaaagcatcatacattagagaacaaatacatggatttgtgcagataaaagacattatttgcccacatcgaggaagatcagttagcaaattcttatgtcattgaatatacttcaaacaagcactgtgttcacttctgcaaaggttattccttatcaccgggaatcagaggtaatgacgagaaactgtggttcatgttgaatgcctatttgcttctctcaaatcagatttcacatgtctgtcagcaatttttttcctataggaccacttctagtcaaggaaaaaaaaatatgacttggaaaaaaaaaaccctctcatttcacctctagaaggaaatgaagacaccttccgaccagtcctgcatgttcaactctctgggacaatcctagaatcagatgttaaccaaatagcccccaaatacatgaacaatgtttaaaatgttgaaaatggaaaaggatgagactgctttggaatacaatttgggtttattcattaaccaaaagaaagatgcatttgtattgattatgcatctaccccagactgaaaaacacagatgtagaggactagttcttagctgtaaggcacctcattactaatgctgcatgatggaggttttactattgggcagaggagtgaaagcgtgtgttgtgagaaagtgggtttgaagtctatgcccaacaactcctaagatgctaaccttggagaaattacaaaattcttcaaatttcagtttgtctatagaatgaggatgctaacaactatacaatacatagcctcaagagaccaggggcctgggctttatattagcttatttccaggtttaatcctggttccttcctttatttcaacggtgtgatattggacaaatagctaggctctctggacctcagttgttttcttctacaaatgcggttattaatttaaaagggtttataaggatgaagtaagataacatgcacatacaattaaggctgggcccagcacagtggctgacacctgtaatcccatcattttgggaggccgagatgggaggatcacaatatagtgattcctgggatcactatattgcccaggaacttgagaccatcctgggcaatatagtgacacctcgtgtctgcaaaaaataaaaaataaataaattgagcctgctcagctcatattatatgctgaaaaatgtgtgcatcatttattgtttattgtcatcattatgaccactgctactgctgctactatgtgaaacaccaagtacgacgccagccataaagtaggaactcagtataagctacttctttctccctactttataatatgaaagaatactcataagggtaatgattatccttcccccccccatagataggcatctgctctttggccataatgcaaatgtggaatatttatggctctttttcacgagccctgggtgtagctgtgctatttctttctctttagcagctaatttcagagttttagttgaattactcaatgcacattgcagacagcatgcctttcctgggtcagtgatttatacagctgatatacacagaaggaaaagagctaaggagatggcatgccaatgtccctactttttacatgggaaatgtgtattttcaatttagaaacaccatggaagtcactggccccagaggcagatactatttttatcaagagaagttggcccctcaaactttgtttgctagctgattttactgctccgtgggtctcttgtctggctccccgcactcctttctgactggaagtgagatctcgtttcagggaaatgcttggctggcgggcaggcaggacacattgtataaaaagctagtatctgaaattaagatttcaacctgctgtcccagcaggagcttcttccaaatttttcttcctaaccttcaaactaaatgagaaacaccaaattttctttgaaaataaaaggtaaataatgaaacatttccttggttctgattaaaatgcacaggccaatgcttccttaacttccttgtatgagtgagtcaaaggatctcaaaaagaggagctcagatcactttcaaagcacttaccagggtagaagggacttcccatgtcacatgctgttggtgggaaagaatgtgaaggtcaagtattccatgctaactttgagataccattgattatactcagagcctcacgggtgcctactaccactgaacaacacacctcctccatattatatttgtgttcctggagtcagggatgtctattctttttgctttccttctacttgaaaatgttacaatggaccccatgtgacatgaattatttatctagaaagaggcagttccatggcaattgttagaattccatgcccaattctctttttgatccattgcacccattttcttgatgacctgtcagggctggccattcaactctaggagctcactagtctatgtagggactgctcttgttagcactccttgcctgtctttcaacctatcatccacagatccagaatgaattcagagactcccagctcaatgtcaaaacgaaataggaccccacagagcaacagatttcatcctctcactttttgatgaagaattgctcaatgtcagaactaaatagaaccccgcagatcagtggattttatcctctcactttttgatgaagaatcgagttgcatcttaaggagataaagcaatttatccagtcacccaagcagcctgttgcaaaactaggactagaaaatctctgttcatcattccagactgcccttcttcctaagctatgggaatttactaagcagaagtttagctggacacattcttcctctacaagattataaatggtctattctcaaataaactgcaactgttaacttgttcatagcaacttaagcatattaaaatatgataatttgtacccacaggcacatcttctatttataggcagatgacacatacacacctatgccaaaactctccctcttgactcaggctcacataatattttgtatacaagacgatattcctcaatactcaaccagtacagatttaatatgtacctcctatattctctgcagtcttccaggtacagcagagagtggaggaaaaagaattattaggacagatttagaaaaatgaagatgtggaggaaatttggagggaagaagtctaaaggctttggtcttcaaagacattctgtattctcaaatgccaatatctgctgataggcaggtgggaggaaaggcacacagattttctgtaaagtcctactgaagacaatgctatctcacattgaccaggtcaagggaaaattcttgatgctttaagatgaaatatactttactttgcttaaataaggactctgtatgtgcatttaacttgctctaaaggagcagaggagcaaagtcatttgcagtcagagagctaataaaaccccatacgacaccactttctttctcagcagaataacagtgaaaagttaaagatgattatgacttttagtctgtgagcctttctgctgacggagatcttttttatgtatgttttacatttaaatggaatgatgagtatccttaaaaaaatgttatctctagaattagatccttcttggttccataaggatgatttgtgacccaaaatttgaaaagaattttgatttggttgtaagaagagaagcacatcttgaagttatttcaaactttgtcaaacttctttaatgaataaagtgccatctttcatgcttagtttcttagaatgtcataaatctataacctgaagtttctaaaacactttcattttcctgcttagagaggaagggagggcaaatatcattaccttcatgttatacatgaagaaactaaacttcagagaggttaggtgacttgcctgaggttgtacagctaataagtgacagagttagatgagagtgaagtctttgctgatttcatctgatattctttctgtcacactttcatgcttgagaactaggaacaagaaaggggaaagtaacaagaaaaaagaaggaatgagactaatggatacttcctagggtatcccagctttccaaaaagtaaaacagttggaaaagaaaatctactctgtttttatcttttaaagccctcacagtgttatataaaatgaaaaattaatgagcacctgtaaaagatttcattgcccagctctctgaggccacaatttaaagttaatgttattttctgtattaatagctgctcccaatgatgtttcccttttaagttaatgcagatgccaggtaatttggaagagaccaaatagaccaggaggagcagctcagactgctcactcagcagccctctaatttgaaaagagagcttcaggagtagttactacctttgggaccttgtctggggttattagatgtacacaggctactccttaagaacaacatcccctgtttcttatccttcagaaaaatttgcagctcctagtaattgtagaatagaattccattatcacagtactcccactgagtttctcttccactctccattttaaaaacattttctttaaacatgactgtttgttccagcactgataagggagttgggtgacacattctgctcataaaatggcaatgatcctcatcatggtgatttcggatgaggaatggttacttcctcagtcggagacccaagcttaatattcagagacttcctccagattctgcaaactctccatgttctgtctttatgctggaagagctgaagcttcaactcacccttcttgaatcttcaacctgacctcctcgaggaaggaagaacctcctaaaagttcccaggtttattggtgattttttctttcttctggtcagagacataattatttctgtgactaggaaacaaggaaaatgtgtgggtgtcttttctgatactggcttgaagttattctgataaattagcctaaattagagtggaattcctcaagtgcagtgaatcttttatgttgaattcatgccaggctttcgtatgaccctggccctttcctgtcagtttctgggtctgcttttagagcacaacattacaggaagttaatggactggttgtagaattaatagactctgaatgttgccaataatatttaaactatatatatataataccctatacacaatctttatatatataatgtacatgagctacactgcaaatacatactagtatgtgacatgcttttaaaacatacacagaaagtgcaaactaaagacaaaataactataaatagaagttgtgttttccttgtacttcaataagtaatttaatttcttccttaccagaggttttaaagctctcctatgaggccactgagctaaccaacgtgttctacctgccatgttctctctggtggctctgtcggttatggaaagaagagtagtctgaatgtattttctttgaattattcctacttgcatgtcacctgggaagcaaagtaagctgggcacatgggtggtgaatgagcctcatgttcccatgagccttacctggatcatcaggtaaggaatactgcaactgagacttacctgtgtcttctcctcaaagacaagtctcaaatgaatgacaaaaggtcttgattaaattgctattatatcaaatcactttgagccactgaaaatagaagaagaggaattaaaatgcattcttcccaacattccttagacttaaagactcaggatttaagtggaaccataaaagtcacgttgcaggtgcaaacacagcgtcctaaagaggtgacttcacccgcccaagttgacatagccagtcccagtgagtggaagatctaatgctcaaatcctgctgtgctccttcctgctctaggagaatttatattttaaggtggagaagtgttggattccccaaacacaaacaaccgcatttttcgtgtctccttaatttcttcctcttcatgtctttcttaagggaaatatatgttgtaataaagttttgtgtatgtcattcttttttttctgacttaggatacttttaaaaaccattttattataaaataaaacgttgatacggaaaatcatacaaaacaaattttgctgttgttgttttcccaagagggacttggagccctctttcctgacccttcacaggtgaggtgtgcttgtccctctctgcccagcctctctcacaggcttgtctgccttctgccaattgataccgtagtgtggaagccaaattgcaagattactctctcccctcactcccttctgaatccatgaattcacctatttgtagatgcaaagctctcaaactgggaccttcctttgctgatttcaattgattttcttttccttttttttctaatttttgttccttatttctcatatcttttgctctgcttcctggaagatttttttaaactttatcatccagcttgatgatgggctattttaattttatttttcaaaaagtatttatcactgattgtttttcttttacagcatcctttggtcatttcacgaataccatatattttcctcttcctctctgatgacaggaatgtgtctatttcaagtgttccttggtcctttgcagattctcattttcctgtgtgatcctttcctcctgctgtttgttttggtctgtccctttcaggcaggagacttcactccgtgtctaatgaccttgcctgtctgtcccgagaatgggacactctcaaacatgcttgactgagctcatggtgggaggggctgagtgtgctgacaggtttcaatgtcaggagatagggtgactgatcaaacaaatgtcagatgtcattatctggagactgtttttctgaggtctcaagtttcctcagagcgaaagcatccaacttgacttgctgccagcattctggaagcaggactaaggaaggtgtctgaggagtccagccttctacatgtagggtttcactcatcccctgcatcagcctgactctatctgacaatcacggtgtctggtgccttgagaccttggatcaccaggagagtgtccctcgggttttgtgtggaaagggtatgttgagccgggtggatgaaaaaaggaggaagacagccatgttgtaaggcatcagaaaaaccaattcctctttccaccagccccctactttggcctcatttgccttctaaacccctcacattcctgatacctgttgtttctgagagcttggtgttcattgattctacaggcgaatcagctcatccttgatggcaaattatgacttgggtcacaattccgttcagctcaatctgttatcatctttacttctctttcccatgtctaatatctgttaaaacttctcatctgtagctatctcctccaattctctttctcgtatggttaatgccttttgggtcttgaaatagagatcaatgggtgtggttacctttgctatttttactctgaaatctatggagttcatttgtcttctcaacattaggcaatatgtccatcaagtaactttagttgcgtggtcaattgttcaccgttgcttaaagtttaaaaataaaaccgtatttgcaccaaagcagagataaactttagttaaggcatcattggagcctttacaaacacagaacatttctgcttactcaggtagcaatgatttgaaactgttgaagatatttatcaataatatctatatacaatttattttggtactttctgaaattgtaaggaaattttgtttaatttaggtattcatttgaaattataatactttagataaatcttcattttaaaagatattttcctgaaatagctgctttgaagttttaacagcttcatctctgagttacaaccacaattttacctttagaaagcatccactagatttagtcaaccaaaatgttatctcacagtctttgttcaacgtgggcagattgggaagtttctgtatttttaacataaagaagctactggtgacctttaattcaaaggttaattttgagtctgcaagtctttgtcatgtctatacgcaagtgagggtcattttcagagcaggtaataataagctaaaaaatgcatttcttttattttctgtaaggattacaacattaattttttatggtcagaacaaaggagcttgttattcagcctggagtcggctctattttccccctggaaatatataacttcctttacacatgtcaagaccagccctgtttgtggacaatctgtactctgacaagacttattggcctcctaacacagaagagaactgtgcttgggcctccacttttcactattattcatttcttgggtttgctcatgaaagttccagttaaaatgcaaatatatcagtaacattttcagctacttctgtctcaggaaaattagtacagctgagttcaccagggccttaggagactgggacagataaaattttaatgggaccaaaccaaagaaaatgatggtacgttaaacactgcctagcgctgcagagttgagaggtagagagcaaaaggaacctcccaaaagctgagaatggaactggctgctgtagtagtggtgagccatgtgcctggaaaaattcaagcagaagctgcaggaaatcttgtggtgactctgtaataataatagtgcccctagtgacatagtgcagtactattttcaaattgttttcagatccattatttcattcataatccaatgaatcttatgaagagaacaagttacaactgttaaagaaagaaactgggtatcagggaatctgtgcaatggtctcaaagtcatacaattaatgatcagtagtggaatcagcattagcacccagtttgcctaactctagtctagggctcttcactaaacactgtgtttttccccgatgattccctggacagcagtgggagtgacgctggcctctaaagtcagaagttacagtctcaagagacccaaagccagtgtgagatttccctaaagtcttgtgttttatctttaaaaatagtggaaactttgtatttcctctgtattgctctgttttttgtttctctctctctctctctctctctctctctctctctctctctctctctctctcggctggagtttggcttttgttgctcaggctggagtgcaatggcgtggtctcggctcactgcaacctccacctcctgagttcaaaggagtctcctgccttagcctcccaagtagctgggattacaggcacccgccaccacacccagctaatttttgtatttttagtagagacagggtttcagcaggttggccaggctggtctgaaactcctgatctcaggtgatccacccacctcagcctcccaacgtgctaggattacaggcatgagccacagcacccggcctctgttttttctttgtagcaaacaactcaaatatctcaggacttatgatatccggtttatttttctcactcatgggtctgtgggttgaccatggttgtgtggacttggctgggattgcctagccttgatctcggctgggttgggttcaggtttgctgcagaggtcttctcattctcccaagactggcagtgaaccagggcatgttctatgcatggcagatcagaggtgtgcaagaagaacaagcagaaacaggcaatcctcttaaggcagctgtcacctctacccttcttctgttggttaaagtacatcatagagcgaagcccaaattcagtgggatgggatgcatattcagcttgctttactgtactgcaaagtctcatagcagaggaagtaaaaaactgaaacaagtaatccaattgtattagtttgttctcacactgttacaaggaaataccttagacttgaaactgggtaatttatcaagaaaagaagtttaattggctcatgattctgcaggctatacaggaaccatagtggtttctgcttctggggaagcatcaagaaatttacaaccatggtggtaggcaaaggagaagcaggcacatcttacatggctggagcagaaggaagagagagagagaaggtgctacacacttttaaacaaccagatctcacgagaactcacccattataaagtaccaagggaagggggaatggtgataagccattcatgagaactccgcccccacaacccagtcatctccaaccaggcccctcttccaacattggggattacagttcagcgagatttgggcagggacacagatccaaaccagatcactagtagacagtggccttccctcttgactgcaaacattcaccctgtgacccacatgcagaatacattcacctccatgctaagactccaaaaagtttcatcttatcccaagaacaggatccaagtcctgaatctcatgattgacattaggtccatatgttgctcttcttaatatgggcttttaaactaaaaaggcaagttaactgcttatgcccaatgcccacacacccatcactgtgtacctaatacgtaatagtaaaagaggcagagattaaattttgcaaaaacccaaaacaatcccatttgaaaaggttaagactgggaggtacatagcagtcactagtccactgcagttccaaaatccactggacaaaggttgccagggcataggtaaaagaatattctttgattacatctagttctgatccccagaaagcagctcccaccacactgttctccatggctcttcactccaccctacgagagaagcttccttttccatcctctttcccagctgcatcttaagagggcattggcaaatatgtccttcctggtgactaagaagttatctctgtctattcctgcctatatactgttggtgtcctataggtctttttacagccaaacagtcacagtctctttcatttaaagctggcagtaccttgtcaatttaactatctcaaaagctttgatttttaatactttgggtatatacccagtaatgggattgctgggtcaaatggtataaaggcacatgcataagtatgttcattgcagcactgtttacaatagcaaaaacttggaaccaacccaaatgcccattaatgatagactgaataaagaaaatgtgtcacatatacaccatggaatactatgcagccataaaaaaggatgagttcatgtcctttgcagggacatggatgaagctggaaaccgtcattctcagcaaactaacccaggaacagaaaacaaacaccacatgttctcactcataagtgggagttgaacattgagaacacatggacatagggaggggaacatcacacactggggcctgtcaggggttgggggcaaggggagggagagcattaggacaagtacctaatgcatgcggggcttaaaaccgagatgatgggttgatgggtgcagcaaactaccatggcacatctatacctatataacaaacctgcatgtttggcacatgtatcccagaacttaaagtattaaaaaaaaaaaagccttgaatgttttccatgtatttgattccagtcagttctatgtgcctaagccacaaccaccattcttttgggacatggctctctatagactaaaagaagtcctttgagctgaacaggcttctaggagactataccttcaatctgtatagaggcacttttccagctaaaaccttctcttagagccactttaattctttcagccatcttaaaaagggtactaataccaaggtcttgattttgtgcttgtcctgagcttgtatattaatgatatacaatgccctttagtagaccttttcctgacacagtgtgtttatggctacatctttgatttaataagaaacactttcatatgtcaactctacatgtcctagaatttctggactctcttctatttgcacactggtctttttggagttcatcagactcttgtaatactttgccagaggaactaactcattctgccaaccttttgcctcaaaagcttctcacctgacacaagttgttatgaatatttttccatgttctgagttaccacagaggacagacttaccaaatggcttgacaattacctaacataggtccctattttttccattctcctataatggtttccttagttcctgtcagttgatctcatcatcaacgctgcatagtagaagcactacagaggcactccacttctaggtactgatttctgtattagtcgatattcaatgcataacaagcaaagtcaaaatctcaatggctgaaacaagtatgtggttttcttggttctttgggtttccttggctccaggttgaggttggattcaagtctgctgcatgtttccttattctccttggtccaatggcttcctttcttctcataaagccttagaggagaaggttgtcactgtcattcagaatttccaacaaattatctgtaggctgcccctcttgtattgtccaaagcacatcacatgactaaactccaaatcgatggatgcagaaattatgctctgactattctactgccttgtgcgtcccatggcagaaagaggggaagaagtgagacaaataacacaatttataatgcatttcagaatgtatcttcgttctaatataattgtttaatgtattgttatccccaaagccttcaagtaaagttgatatcccaggatcattccatggttttgaatattccacactctaccaagagtccctcaggagtacatgtggtccagtttgaaaagcagggattcataaaactgtgcctcgagcatattagagggacagggacctttcaggtcccttctagtaagaattctctgactctatgaccatgaattggagacactgaacgcaaacttcatccaatttgcaattttgtgttagactggcctgaatcaaattacagttgtccctcagtttcagtggggaatttgttccaggatcctccagtgaataccaaaatccacagatgctcaagtctctgatataaaatggtgtagtatttgcatataacctatgcatgtcatctggtatactttaaattatctctagattacttacaatatctaatgcaatataaatgctatgtaaatagttattacactgtattggtttagttgtattatttttatgactgtactgctattttttgttgtttttttatgaatttttttgatccacagttggttgagtccacatacgtggaacctgtgaatacagaaggccaactctatgtcatgtcgcaaatgtggcttcctgtgctaatccctttctttctgcaacaaaattatgaggactgagaatgaatgtgagagaaagtcttcctttgaaaatatctacagactgttgcctacacacgttgtgcagtgtacaatacaagaatgtaatgtccttttactccttaattcattcaacaaatatcttctgtgaatctgtcatgcgtcagagtcaatgctagtggctaggtatgtatgaatacaacggttagcaaagtgtagtcttgggaccctgagtgccctgagaaattgtcagggggccttcacagaccaagctatttccacaagaatacttaaaagttctttgcgttgcccattctttcatgatcacagagtgaacccatcatctgttatgccagatgttaaaaaggtttccaaaaacgtaaaaaagggccaggcgtggtggctcacacctgtaatcccagcattttgggaggcagaggcaggtgtatcacgaggtcaggagatcgagaccatccgggctaacatggtgaaaccctgtctctactaaaaatacaaaaaattagccgggtgtggtggtggacgcctgtagtcccagctactccggaggctgaggcaggagaatggcgtgaacccgggaggcggagcttgcagtgagctgagattgcaacaccgcactccagcctgggcgacacagcgagactccatctcaaaaaaaaaaaaaaaagccacccttcttacttttgtttttttaaaaaaaaacccatcatttttatttaaaaatatggtacttatgttcatgtgtaataatttcattatttattcactttaattgacaaaacttatacatatttatcatgtacaacttgttttgaaaaaagtatgcatcacaaaatggctaaatcaaattaatgtattcattacctcacattcttatttgtgtgtgtgtgtgtgtgtgtatgtgtacgtgtgtgtgtgtggtaagaatccttaaaatctactctcttagcaatttttaagaattcaatatatttttataactacagtcactacgttgtgcaatagatctcttgaacgtattcctatctagctgcaagtctgtatcctttgaccaacatcttcccagctcctctcatcttattgttttttaagtgaattaattagtaaataaacacttttaactgttcacaaaacctctcattgttatcttgaaaatattttaaaggtggtttgcaaacttttaagtcgtaggatactttacactcttaaaatgtttgaggataccaaggagagcttttgtttatgtgggttctctctatcaatatttaccataatggaaatttaaactgtgaatatttaaaagtgtttttttatttttatttttttttaaaaagcagcgtggatccttctcattcagaactttcaacaaattatctgtaggctgtccagcactcccttgccatctgtcgcaggggctagaagcctgagaactccgttttctagaatcctctgccaggagggctccagattagtttctgccaatgagaagcattctcacaaagtttggaagacaggcagaagccagattgttgctccgcgagcaggcgtctgggctttagcagatgtggaatttttttagcactttaaggcgttcctataatgactggtttcagagattcataaaactataattataaccaatagtttcctggggtctctgaaatttcctgaccctcttaaagctagtagcaaatttacattttttctcctcccaccctttcaacatttctttaatcattgaattctatgatttatatctctttctgcttagaataactggagagtttatatatttctgaaccatcttactttgtggttggagcatcagagaaagaccaaacaaacaaataaatatgcaaaatgcatacaaaccatgtgaagtacaagagaaataaaattagcatcataatataggcctcattgttaggttttaagatgtattaaaacacaccctaagtatatgagaactatacagtgtcagcctatttacttacattaataattatgtatctgtttttgattttctaagaaaacatgtagtttgtttttcaagtttcaaggcaccataaaataaaatcagaaaatgatattgggaaaatgacattgacttttaagaaattaacaccagtgttccttgtcacaatgatttgtgaatgtgctataaaattttacagactcttaccatatggaaatgttttacacagaaattcttggcaacatgatttagaatctcattacgtaataccttgatataaaacaccgatttgctgatgtgattaattaaaagcacaattttcattaatttttattttaatttctgaacatttttctatttcattgactcttctggaaaactcagcataatctaagttatatgaagcataacttccaacagttggaacagaaacttcagattgcaacaacaaaacatattgtacctcagctttgcagaaataagcaacatttaccattgaggaggaggagaaatgtcttttcctcactcatcctaggtacatggaggaggcttctataacagaagacagatgaataaaagaaaaaagcacacaaatgtatttaatgtaagttttatgtgacgcaggatacttcataaagaaatggagaccccaacatgtgtaaaactatgtatttttttatgttagctttgataaagaagtggatagtcatggagaagtatgagggacaaaggggtatgatctaatgttgataaacttggggaacttagcaaggcctgtgtgttcagattctccttggcctctctgtaacattccttccctctgaatatagagcaggtcacctgtcacatgagagtctttaagatggaggatcagagagactttttgcttctgtggttttcttaagtccttcggattaaaatactcgatattccaaggtgccatattttggggtatcagttcctgtacccccattacttttaattagggatttttatttaggaagactatgtggtatcatagaaagacatttgatgtcagaactaccttcaaataactgtaagttacttaacagagtagtttacatccccttagttctacagacctgagaagataagagtttaggtttatgggaggctaattctactgcacacactagtgactgcacattgcttcatctttttgagcctcttttctagtcagaaaaaaagaggtgaccattcttacctgctaagactttagcaaggattaaaccaagaaatgaatggcaagtgccttggtcagatctagcacaaagtacacaccaaagaacagtactattctcacatgtcccacttaaaggacatggctacaagctttgggagagagttgatcctgtgtccccttttttatggtatcatatttgatgaagcttatgaatgctaaggagttgggtgtgttgcaaaagtatcttcattgggattaattcattgattataagcaaggcagagagaggaggagaactatttgattaaatgtattctcttctaacctcaaaggtaaatcatgcaacatatatcccaaccaagcaagggctagaaaaagctgcacacacgttaagggattggactttcaagtttcatctttctatttgtcagttctgcttaaatctttcccttttctacttcttttcatgaaggcctcaaaaatcatttttgtctcttttcagcaaaatagtatccttcaccattaaattattgatgttaataatctttttttaatgaggtggatttttattcatgctcaatcaaaagaatccacacccttctcctaattcagtttctgtgggtgctcctccactcttctaatgattagtcatatctttgggtgctgggagagaaaaagattttctaaaatatattttaggaaagcatgcactttgtttttttctgatttttttcaaagtaggcatatctgtttaaagtaccactagctttgcaaaaacattaaattactataggaagagcaaagagtcatgagcaaataaaaatgtaaggaactgtgctttaatatttttaaattgctgcactatgacatctctacaaagggtcctagttaaaaaataacttgacttactgtcttaggggttggcagccagagagggaggaaagggctatagattaagaaagtgggttataagagtatagaattttagaggtagaaagaacgttggagaacaacctaatatcccaaatccttcattttatgagcgagggaattgcaggcaagtgagataaagtgacaatagaacttggaacctaccctttgaaaataaagagttacaagtgactttgtctacacatgcaaagccaagtgtgaaatggtgcctttctgcttaaatgacatttagagccaggattgtcaaattctgcatccatgttgattgggtcatcaaactagtcgggtattttcctaatctctgctaaaagccatgctttgcaaacccagtctgtgggtctacagcaaaatgcagctcaggccctgctcccatgcagccacttgaacagcttttagcattgtacactcgattgttcagttttgtgctgagacaccattttcttgccatcctgtttccattgacttctcagttcttttttcacgtagcccatcatgtactggctaagcactcagatatgcatagccctgagttaagtggttagtgggaacacgaaagtacaagccaaggtcctgaaggagcttattctctaattaagaaataaatggatgcatgaagaagtgagatcatagatcctgtatctgcaagtgtaatatattcagtgctgtggttcagaaaagggagtaatctctatacaccgccctggatttgaactggactgtaaaatggggtaggttctagatatatgttcatatgttcagatatctacatagattctatatctagatattcatatatctagaacgtatctatccgcatttcacgtatatgatatatcagtatatcacaaccatgacgtacgatataattacatgaagcagacagggaatggcattctagggaaggcgataacatgcacacatactttaagttggtaataaacaccccatatcccagtgtcagataggaaaataatctgttgggggcagggggattcatgataggaagtagctggttgggtgtgttttaggagaacttgactactaggctgagtacattatcccattaaatatagcaaggctgctcattacaagcctatgagtaagtcaacttttcatggtggagagtagagaacataaattgtcttgcaatccattaatattatgacatgattacctggttgccccccaaaacgcatcattttatgggctctcttctggtaaaattacttttctgactctgtaacaccataaaagaatactccccaaaccacaaaactgagacaactagagtgctttggattttgctacccatgtagatttataagttttctttttattgataattcattgtggaaattactttggcaaatatgtattcagaagtccattcaaaaaggaaaaactcactaagtgaagaatctaaaaagttaatacagctcacagagcagccaagaaatagaaatagaaatggtgaggcttgaacttctagcaaagatatcagtgtttcacgtgatggatccagaaggagatgcaatccttgcctaccccattgccatcttttcaaagtcaagaatgagacccaagagtaacaggagagggatggaggctgacaaaggcaaagcagcagaaaggaatcatttagaatatgctcatgtcctgatttgaggttgaagaccccccaggataagaagtgttctgcatgagatatgtttatttggcaaacaagaaaggccagaacagggccatcatttcttttttttttttttttttggaagccctcgtgatgggataagaaggaacgcatcccagccaaaggtctagaaggaagcttcaaggtcaggccctgatttgacacagggcccctaacactgtcaaagtggcatgcctgttggcccctacaaatgcacgaggagagtttctgtgttgtgacagagtcacactatttatcctccttcactgagcttgcaactctaggagggacacaaatggagtgtgagggtggcaggaggaagaaaggccacccttaaccagccagataaactgaaccaacactgcgggacaatggaataagtgataccaccgccagttttactttctttttctttgcttatatgtcatttaagagccacttgcagtcacttgtccccatgaacaaaggtactctgatagcttccttttttttttttttttttttgagatggagtcttactctgttgcccaggcttgaatgcagtggtgagatctcggctcactgcaacttctgcctcccggattcaagcaattctcctgcctcagcctcccaagtagctgggattacaggcaccagccaccacacccggctaatttttgtatttttagtagagatggggtttcaccatgttggccaggatggtcttgaactcctgacctcaagtgatccacctgcctcgccctcccaaagtgctaggactacaggcgtgagccactgcgcccagcctgatagcttcctttttatccccactggtgtaagttgactaaacagcaagtcttgaggactttcatggtcttctctcctctcttgttctaggctattgcttagtcccctcatcctaatcaggaatagtcaataccttcagaagctccatggaagatatccaggagattatccaactctttcagatttcccagagtccaagagtttggctctccatagcccagcttttttttttttttttttttgagacagagtctcattctgttgcctagactggagtgcagtggcatgatctcagctcactgcaaccttcgcctcctgggttcaagtgattctcctaccttagcctcccaagtagctgaaattacaagtgcatgctaccacacccagctaatttttgtgttttcatcaaaaatacatttggatttttagcagaaaacggggtttcaccattttggccaggctggtcttgaactccagacctcaagttatccacccacctcagcctcccaaagtgctgggattacaggcatgagcaaccgcacccagtctgtagtccaccttttgtaagagatgtgaattgggatgagtcttcccggtgtgcctaagtctcagctcaggctcctaaacattcaagagaacagagaaactgtcctgaggttacaggccttcgcatttctcctgatgcagtggatgggatagcaagtaccaaggcttagcgactactctagcttgtgagcagatctggggatccctagagggaaagaggagaatgtgaatgatttagagtcgtctttggtctaacctggtcatgactgtgctgtgttcctgacctggcttagaaaaaccctcccattgacaagcctttcttggtttctacaccataagttgatgactattgaagctgaacatgacctcaatggtcttttagttggcatattacacttgggttggggtgtggatatgtgggagtttgagggatggggattaggtagctgaggaccagggacatctgatgtagtggaaatctcctttgtgctgattttaggtctcaggacagtcccacagcccaacaccaccttatccatgggactatcgtgatcgttgggttctccggatggagtcctaacatcgcccttttaagcagttgccctttctttctactacccaggtcaagctttggagaaatgggacagaaagtcaaggagagttttaactttaaactcagcagccttttttgaaggtgtcgctgtggaagccaagatcatgtctgggattgaccctaaggttgatggaaggtttctgagcatagttcagcatcatcccaccagggggcagtaggaagctgtgtgcacaaaccatttcatcttgaccaaagtcaaatccgaaccatacaacttttctgtccttgaaccggagcttcattaaaacccttgggcaacatttcaaactttaaaactgtagaaacttttagtgaatatggaagcattgttaagcgtaggttggattttctcttcataaccaatacaggattcaattttgctgggagcatgtcatcatttattttcttgtctgaaatggctgtttttcactggtttcaagatctgaaatatgaatgcattatttacaattatgtaatacccttaccctgagctgtaaaataaaaattaaaaaaacttgcttttccgtgtcttttaaagtgttgcctccaatccatgttattaaaatttaaaagagcccaagagcagcattggtaatagcagagaacagattcacactcagattcatttttgtttagcacttgccgtgtgccaagcattgccctgggaactaggagtacaggggtggctctgttcctcggggagatcatggtctcctggaagatcctacaaaataacagaagaccaagtcccctgtgctctggagtaattagaatgctgctcttagcttttaggcaaaaagctaatcaaattggtaaatgggaaaaagaaacacaatagaatcctttctggaaaaaccactgcttaggaaacctgacatgttcataattgcaggatttggggtaaaaacccctcaaagcaaatttcctactttatcaattccattacagccaattatggcctgtgtgtgtgtgtgtgtgtgtgtgtgtgtgtgagtgtgtgtgttgtgtctatatataacgaaattagggcaaatggcttcctcattattaagagagcatttttccttcctacttgagttttcattatttcctaagtaatattttctcagtgcaattttgcaaatgtaagatacccgggaatagatacaggttgaagcggcaatccagggactgtctcataaaagcattgagaagtttggaagcacattaagtttttagattgaaacagcaataaaataatgtcactgtgttatgaaccaggtgctgcctgcctgcctgatgtgtcttgattctaattagttaaacagtaaaaatggagcccttatttttttggcaaggttaagcgtatggctgaacatgctcagcacaggacagtgatttgcaaactctgaatcctggtccccagtctattcttgactttgggaaagtcacttcgcctcttgtttcttatttctcttgagtaaaatggaagccatgaaacagtccatctcactggggtaccgtgatgaatgtcacagatgatggaaatatgctttgcaaattcaaactggggttgaaatgttggtgctagcccatagcaaagaggtatgtgtctggtttcatagagaagcaactcccctgcctcccttttttgcccacttctagcctctgcatatgcctagaagcaccaagatcattattcagccatttttgcccttaaacaaaccaaatgcagtcatttcaaagatattcagaaagcatcttgcctttatgctcttcaggaagcaggaaccatgaaaatcaagttattgtagttgtgcttatgcgccttcttgcctcggattgacagggaaggtattgcatttggggaccataaccgcaaaatggatttatgatataggaaggagacaatttctccatgtggaaaggggagcactgggccggtaattccttgtggtgagtttttcttccctagacagcaaacacaacggcagaaactgttattttcttttttactgtgtatccaacacctgtcacagtgcctggtacaccgtagccctacagtaaatgttcgctgaaagaatgttgagaaaaaaaatccactgtttcacttgaaactgctaattgtcataccaaagtacttgaaaactgcattttccatgaagatcctaagtcataaaacaaccatgaaataattggaactaatactaatccattcatgtctaaatttatgtacaaaattataaaattttaatatattttaaaaggcttttttaaaaatgaactttaactttgatctttattgtttttagtagatttttctataagcctgaattcccacagttcaaaagaatgaagagagatgctagtttacccttgtattgcggaaactccaacaatacttaactagctcacaggggaaaatgggatttcagtcacatggtttttattcttatttactcctgagcatcccagtattttaaaatgtaaaggcataaagaggagatacaaatgccttcaaaactcactgttacttcttagaagcccaggatgacttgagaattgaaaaacagcacagcttcatggtctaacctgtttcgaaggtgattcccaagtctcttctatgaatgctttgtactgggatttcaactgtttgtgcttttagtgtttcttaaggaagaagcagccacatttcatgattcctaccaacttgcaggaagttctactgtgaaagaaggataaaagaacttagtattattttcaggagaagggttacattttcccacattatcacatgtccccccaaaaagtatcattgaagggaaaattgaggacttcttaaaagaaaatagagtttaaggccactatgaaaagaaatgctttaattttttaattgcttgggtccatgttcaataaagagcttcgctaatcatttttcctaattactttggctaactcacatttgatgggaaaaatatatattgtggaaactgcagtgaaatgtaagttgttctcccatgtaattagtttgttctgggagcttatttttattacaaaaataatttgtggtaggtagctataggaagacgctcaggctggaaggtttcaggataatattttctatgtgaaaccttctctaccatgagaagtcattttattccttggaattcaaacatatactttacatctaattctagatagagagatgtaacagacctgggcctttcactgtctggcagcattttggtggccttctatccatggagggaattaaaggcttcaggcatcagggccctgtatattctttcagagaacctatctctggggccctgtttccctttcttacttgtgtctccctctcagtgccagttcagttatatgggaggtgtagggaatggtggaggttggaagaagggcacagccatgcctatacctggagtgatttctccagggaacattgactggttttgttcatggctccctgaagccaggaggtatggagaagggggctttctttttttttttccccccaaaactaatctaactgcctgttctctgaatcccatttataccaactccccaggaatgtcctctcaactattttcaattttaccctccgtttggctctttctcctttgctttcaaacattagtaaattcacttatatttttaaaaagaagaaaaagaaaaaaaaagacttaaccttagcaaagtcttcaaacaaatatcctttacctggtgcctttatttctttgtgttctccttcctgacttttatgtactttgcagtctggccccatcctaaaatatctttattgttaagattttaactcaataaaaatcaaacctcaatgcagaaaaggaccccaagaggttgtctggtctgcatccaaatcttcaggcatcagtggccatgcacttgccccaagagaacaaatttccaggaccctgtttctcgttcctgcctctctcttgctctcaatgctaattcaaatacatgggaggccaatggagagcaagcattgcccgacctggggtgattccccaatctgcagacaaggcacaggggccaacagccagaggacactgtgtacttcgataaatcttttggtgttttctcatgctcaccaatctttctaccatgtttgatacagttaaaaaggccagttcaatttccatgacactatattctgaatttcattctgaacaacaggggagaattagttggggaaactgggcacttacaaaaggtcttactgattctctggctcaacagagaattctcataagcagagggcctttgcattgcattgaaaatactttgattctgtgagcaaaaacacaagcatggttcgtattgagcatggttactgatttaaaagcaattcaaagctgagtgtacactccagatttaatgtttggctatggtttttatttagaaatatttcaagacagaaagaaggcattgtaaaagttacagcacaacagatggtatatttggatatatattcaaatatgcagactagatctctatcattgggatcgctttatattaatatttctgaaaataactatcactaaaaatagccatatacagtttttttctgcttttcttctgggcactgttacacaatttataagaaaacaactgcattgccttttaaaatcagaatacaaataaagcggtttgcatggttgtatgtatatttggtgttgctgttggttgctttgtttagtctgttggttgatttgaattaggaagattcaaaagaacagggtgaaacctgtgtgtttgccccagggagggtgcctcattgcaagaatcaggacctgggataggagacagagaactcactgactcttgagtagctggaggcagtgttggaccctggcagcaccaagtaggcactgacaattaaggagcaggagcaatgtggccagggaaccaccactgccatctcttgccacaagccactctcacactgctgccactgctacttctacccttcgcgtcatcttgagtccttccctcagggtttagagtagagcccacatcacctacctggacactggtggccagggatggtgcagagatggggaaggcggagggaaacgtctgagaagggtcttaccctttccacttagattaagggatgagggggtagattcgctgacatggcagagaatttcccaataatgcgaaggagttttgaatggtggactctcccgcaatattcagtatagaaggggaaatgtattagaacactctgactaataaaaatatcatgtgccctctattgatttattaagattactatagtgatccctcccaagtgattccagcattttgggaggccaaggcgagaggatcgcttgagcccaggaatttgagaccagactagacaacatagcaaggccctgtctctactaaaaattaaaaaaaataataataactggggatgttggcacaagtctgtagtcccagctactcaggaggctgagtgggaggatcacttgagcccaggagtttgagcttacagtgagctgtgattgcaccactgcagtccagcctgggtgatagagtaagaccctatctaacaaacaagcaaatgattacagtaaacctcataaaagtgttggaagcatggttcatatattatcataatttctagcattgtatacttttaaaatccaactcagtaaaagtatacctttatataactagcgatatggtttggttgtgtccccacccaaatctcatcttgaattatagttctcataatccccacgtgtcgtaggaggaagcagtgggaggtaattgaatcatggggggcagttaccctcatgctgttctagtaatagtgagtgatttatcacaagatctgatgtttttataaggggtttttccccattttgctcggcacttctccttgctgccaccatgtgaagaaggacaggtttgcttcgccttctgccataattgtaagtttcctgaggcttctccagccctgcggaaacgtgagtcaattaaacctctttcctttataaattacccagtctctcgtatgtccttatagcagtatgagaacagactaatgcaattaacatcgggcattgagtaacacaatgtgtatcttgtaggtctgatgtcatttctgtgccatgcagtatcctggggcacaagtggtgatctgaacagtcatggaaatccaactggcttttcaactgtaccaaacacgctggaaagattgatgagcatgagaaaacactgtcagatttattcaagtacacagcttcctctggctgttggatgccgtgccttgtctacaaattggggcttcaccccaggtcgagcactgctcgccctccgtgggcctcctgtgtgttcaaatgggcactgagggcaagtgagaggcaggaaaaagaaacagcattctggaaattggttatgtgggggaaaatgtgtggactctgatggcctgaacttttgaatgaagaccagataatctcttggagttctttagtacattgaggtttgattttgttgaattaaaaccttaacaataaagatattgcagaatagggccagactgcaaagtaaacacacacacacacacacacacacacagctgctttaatcgccaatgtgagtatattttaattgaaatgttgctctacttataatttaactaatatggctcatcttacataatataatcactgtctttatgtaataattggagttacttatgtactattttcctgaccccattcattcatacatctgccatgcttcatatgcaaatgtctgtcacagagcagccattcggtgagttcttattacatgaatgatcaaactgaactatgcgacaaatattatttctggtgtgagaaacacaaaatgagtaaggcacaggtcctcctccaaagagttcagattctagtggataagatagaaagtaaacaagtatttaagtgacataagatatgctataataagagatacatgaaaatattcttagcatttattgagcctttactgtataccagggaggttactatatggttcacagatagttattttattaagacaactaaatggcatgtgtgtatttttattaccatcattatcatttccattttatagatgaggaaacagtctttgagaggttaactgatatagaaagtggtgatttgaataggaagattcaaaagaatagtatgaaggcggtgtttgcaccagagaaagttcttgattgtaagaaacagaagtttgcctgagcgaggggaatgtctaaactcaaaccctgagcatctcatctggagggcacactcttagccactacttcatgccatacttaaacaaggaggagtttgctatggttttcacagaagaaagagtgctgctctggtatcttgcaggctgtgtaggtgatttttttttcaggcagatactggatattccagacagagggtgtcacacacagcaaagctggggtcatgagagaacatagttgaataagcaactgccagtagttcagccgtgagttgggcattggatccctatggggtctgtgatagtagatgaggctgggaaaagaaaccaagaggcaggcagctgatgccgactgtggtaaacaatctcacggggctctcagggctgtggatattattctcaggaaggtgaagagccacggaaggaggggagatgagcagatttgtggcaattgccctcaatctcttaccgcctaattctccttacagctggtaactagcaacttctagtcagggccacagtcacttgtggttctttccaattcattcttagtctcctctctccacagagctcaggcataggttgtccagggctgggcctgggtcagctccaagtcttaggtcacacactttactcagattgcccccacctctaaccacggaggcacttttagaacattccagagaacttgcctctctccttctttacaaaaattgctcctgctgttccaggcctcctcagatgcccagtgggtccaccagaggctctggcggggacctctgctccatccgacttcagatgttaccttgcttcacattaaaccagcaatcactggcaattaaatgtattatttaataaggacaaaattaacccaaacccctctcttttatatccttcaaatgctattttttaaattttattttggtagttttgggggtacaggtggtttttggttccatggataagtttgttagtggtgatttctgagattttggtgcacctgtcactcaagcagtgaacactgtacccagtgtgtagtctttcatccctcacccccctcacacccttccccttgagtccccaaagttcattatatcattcttatgccttcgcattctcattgtttagctccgaagttataagtgagagcatatgctacttgattttccattcctgagttacttcacttggaataatggtgtccaactacatccagattgctgcaaatgccattattttgttcttatttatggctgattagtattccatggtgtatatattccacattttcttaatccattcactaggtgatgggcacttctggtggttccacatctctacaattgtgaattgtgctgctataaacatgtgcatgcaagtgtttttttgttttttgttttttgttttttcatttttggtagatacctagtagtaggattgctggattgattggtagatctacctttagttctttagggaacctacacaccgttttccatagtagttgtactagtttacattcccactagcagcataaaagtgtcccctttatacgacatccacgccaacatctattattttttgattttttaattatagcttagccattcttgcaggagtaaggtggtatctcattgtggttttaatttgcatttcactgataattagtgatgttgagcttttttttatgttttttggccatttgtctaccttcttttgagaattgtctgttcatgtccttcaaatagtatttctttaactctgaatatcatcaactgtttcacatttgatgaaaatgcaccttactttcttgcatttctatctattgtatgcagccaagttgaatttctcaaatgagaaaatctgactggttgccagggcaccagtggaagaaagtcttttgcaaaaaggggtgggtttcacaactgcttttctcacaaatactgcgctatcacaggataactctgatgatttaatgtgtcactttgaatcacagaatgtttctataattctactactgtagtaatttgcagtagtcaaacaggaaaattgtgttcattcagactcagtgggtttcatattcctattgtttccaaagtattttaatttttaaataatttggagtttaactgatttgaagttcatatttactaaataaaccctctcttccaaagtcttacgaactgggtagcaacatccaaaatatttcagagacctttttttattttattttattttatttatttgctttttgagtaggagtctcactctattgcccaggctggagtgcaatggcacgatctcagctcactgcaaactcggcttcccggttccaagcgattctcctgcctcagcctcctgagtagctgggattacaggcacacaccaccacgcctggctaatttttgtattttagtagagacggggtttcactatgttggtcaggctggtctcgaaatcctgaactcatgatccacccacctcagcctcccaaagtgctgggattacaggcatgaaccacagcacccggccgagggctttttattttattcaaagacaagatttttcaggttaagccaagtggtcttgatatactcatctttttttaaaaaaacccacagactgatcacaaatgttcttattcattcattataacaaaattcactaagaacttccacttggccatttttagtagtataactggaattactctatttgtgtaaaaataataaaactatatttggaactatattctaatatacttttcaattacctccccaattagtctgaattctccagattagattctagagaattttgcttactacgaagagatccaagcaatggattattattgctaattacttctcaacaagatccagtgaccagcaaataactcaaggtgtattttcatgtcctgttgcagtgcccacactgtgcatgcacaaattgtctgccttctcatatacaactttctcagggtgctcttttcttcttctctctcacatgcagaaagggaaaagaagagagcaaaactgtagccattgaggcaaagatttggaggaagaagagcagaaaagatgaatacaaatgtttggaacagggatagaattgggccaatctagtgggaaggaagggctgtaagctgtggaaccaggagtgaccagaagccttgtttggtgtcctggaggaccaaagtgggaaggttcgacaacaggactcaaggaaaagagatggatggtgggagcagcttagaactttctgtcccaaagagtaaacttattcacatagaattgtgaactattacacgcacagaaaaagagtagccatggagagaatgggctacggagttagactgactgggatttgggatcaggcttctgccacttacagcgtgattttggacaatgtaactaacctttaaaagtgttggcttattcatttgcaggattgggctaacaatgcctagctggcaggactgtcctgaggataacatgagataatgtatggggaacaatgcttggcactcaatgtaagctagttattgtctatattattttatatacatttttcaattacctcccctaattagttcaaattcaccagatttgaccctagaggacttcactacagggacagtcaggcaattgattactattaccattattctaataataatttgaagcaatcaaacagctatgtttatgtcattgggcaaaataatcactccttcacctggtcactggtttatgtaagtggaaggatcccagactttgaagtcacactgacctgggttcaaatcctgagtctgctactcaccaggaaaataattttaaatctggaaactcactttcctttatagtaatgtgtgagatcacttctacctttccagagaattgttattactaaaagtgataacaatggatttagtgtggtgtcttgttagagtgccaggtagttggcacattgtagtgatattcaattttcagtatttcacagttttgttgtcattcagtggccagtggaacttagtgtggtgaatggagaaaatgttgttctaagtattagacaaaacaagaactcagagtaggtaagaatgtgtgcaaagttttatgacgaagtggtcacagaatcaacactagaacctcgaatatagattagcagagctgggaccctatcctctactcatcaagaacttatagcttcatgttgttggtaaagaaacagcccagaaatcaaatggtttcgccaggaacctagacttcacctgacatcaaggctactcatctctcctgtgttatacggtttcagtggaccactttgatgcccaaaagagcttgaaaataaaactttaagtatgacaatattcataactattgaactcagcacaagaaataatttaaattgtatggtcatagccaatattttaaaagtataatagcatgagtatttcagggtgaaaactcaacaaaatgtttgtgatatgtgttaattgaggcatagttcacattttaatagcctggctactaaatgatggtcaaaactcaataatgtgtttctgacataagtgtgttcaattacctttttccatacttttatccatcattttccttctccttaaaatatgtttctcaggatcctaagaggagtttacagaaacaaatttctattgggaaaaatactgttttaaccagttgccttattctgtgagcccccagttttctggcatcaagtaaatcactatagtttcccacagcatagaaatctaccaagtgcagggggaggttgcaatgtcaagttcattcttctgggtctcctcaacaatcccaaaaccctcctccacagaagaggtgcctctcagcatcatccataattttgaaatctttaggcttcaaaattccatttagacagaaacctttatgttgggcaattcatgttcaccaatgttccaggctctcctacctgtccttactcccatgagcatgaccatgaccatgtcttgtttggcatggctgagggaaccaggcatctctgtgtagcaggctcttggagcggcatagccactgcagctgcacatcatccttaataaagggattagagatgcgagtctgcaatggttcagcttttcattcagcctctctgattctcaattggcctctcttcatttccttccgcccccaactacctaagccaactcttattttcatggttgacttagtcgaatgtgtttactttcctttatagcgtccaactaatgttttggggaaaatactggaaaactgaagttaacttgaactctaactttggataactataaagccctgtgtgtaattacaaagcatcctgagccaggctgtatatcatagaggtattttattcttcagttttttctgctttttttttttttgctatccacttgagttttaattactcagcagttctgcagtgggaacaattccattatgacttgtattttacagacggagatcctggggtcctaaatttgtggccgattgcactgtgtcctggagacggagtggaaccacagcccagagcccctgggaatcatccctgaaagactgcattacttctccatggagtcttcctcctcctgcttattttctttttgggtaaggtctatctttttattaaatcataaaatgagcatccatcatcttgacagtgagtgaattatgagctgtaggcctatctataaaacttggcttctgttcattccctctctgagctcagtggaacaaaatgtccaaattgaaccctgcaatcttcccacaggtatttgttctgatatgtagctgctttatttttcagtcattcttcctttggtgttgcggacagggttagcacatatgtgttatttttcagaccatgtattagatccatttatatgcctgtctttgtgttcagactctggctcaaagccatgataatgactaaagaatacgaaaatgctcagagaacatgaactttttggcaaaggatagagggaacggtgtagatacctgatgactgcctgtgtctatggagggaatagaatgaatcagaaataagagttgtttttgggtcagtccaattatatgatcttgatcaaagtcaggatcccataaaagagcaaaattaattttccagtttcattgagatccctttgctttccccaaatcagcctacatgagtggccttgagtgtctggaatggtgagatgaccaattaatccccaactttagcatattcattcagcctaaattctgttcataaatccaccagttcaatattttatgctaataaaaactattaacgtttttcattttctcccattacaaagttttcatacagccctcaacattctgcctgcaagatgtaaaattttggtatttaatccataggaaggtaggaaattagatagatagatagatagatagatagatagatagatagatagatagattatttatcttgtctcaataccgtcttcattcaacttggtgtttggtttagtgagctgtataaatcagcactcagccacatcacagagggatagaagggccttcgacatcatggtcagagaatcattgtcaggaagcattaaacttagcttcctcaatgtcagaatgtttgcaccagctctgacacaggaagttcgcttaatgatggcaaaagttccctgagtgacggtagaaagtttgcaaaatagcttctgaattcaagcaaccaaagaggctgtatcccctccttctgtaaagtgatattgttggtagaaaaccaccagatgaaggagggcatgcgggtgctggattttgtgcagctagaaagctggtaggtaggtcctgtttagtctgtgccagaagccaagcaagcttcagaaagggagttcaggagtcctctcagctcccggtgatttaccctgacttccctttgtaagcatatggattctattttctgctgtctctataaatactgttgtgactgtctctgccaaaccagctacctttctcaccccagggagaagccagggatcagacattcctacgctaccgccccattagatgctgccgtaacacgagggagcagacctggcagtcaatatgatgtgtgtatttgaatctttaaagagctaggctaaacttagagtcagcagactaccataaataacctgtgttcctctctctttgtgtggtttgccctggaatgccttgcgctttagcgttgtacaagcagcaagagatcaaagagtcaaccttttatggatgcatagttcattacaaagtcatccgtgggaggagaccctggcaaaagcactaatcattctctcttgtgactgttttgttgcctgaattgggattggagggcactaaaagaacttgcaaccactttaaataattttaaagaataaaataaagctggaaattcacttttaaaggagggttaaaacttaactggcatcttttttgggtatagaatgtggtaggaggaaagaggaagtaaaggaattggcccattatcacatggaatgtggttggagaagaataatagaaggcagaacagaatcctgtgtaatttacttacccttgggtaagcgttagagagagcctttgataagcagagcagaacatcgacagggatttttttttttaaagcccaaactagataatgtatttgaaaaacaggctttgaactagtttgctagaatataaagaataaatgtgtttcaaattatagcactaatgatgttgcaaacccaggattatggataatcacaatgctacaaaacaatagctactatttatttgatgtctgctgcatgtcacatgctgtgcagtgtatgtgatatcttttcatctcacaaccatgcatggggttgacctgttggttatccccacttacacacagggaaataggaccctgcaaagttgaaatgcttagctcaaggtcacacagtcactaagtggtaagcccaggatttgaaccgagctctggaaggaagtggaaatgactacctcttagcctgtagttaatatttctggctcttgacacttgttctagtctctgctgcaggagttgttggaactcttttgctttctgagcttgggagattcgctctcaaagacttactctgtgattaagacttactctgtctgagctgaatgtgtgtatctgtatgggggctctgtccttgtggttgtccataggcagtcagaattaattactcataaaacattgcatagataagacttttgatctggcattttggaagttaggggttggatatcttataaaagaatgtctgttgcatacttgatcaattacagtgatagctaaagaaacattttctcaaatgtattattttaacaggaatcatgttctagcttcccatcctttagcttactttaagtttcagaaaacctggactgtatgaacgctttttaaaaaaaatgacagggtaaaatgcaaaaaaaaaaagtcaatgattacagtcaataaagtctcaatggctctgtatccctgagatcttttgttcttgtcacagataaaaactgcatcacagaaatgccacaagatcaaatgattaagatgattggaaaactacaatgctctataaatattactttctttctgttcttctcagtgatactacctttgttcaacccatctcttcctgctgttttaaaataaaaagttttttgaaagtcagaaataaaagcaaataactgatcgatccttttttttttttaccaatttcatagcaattgaaaacatcatccaaaatactgtagatcttcccccccttcaagttttcttgaaagatttcacacgtgcagtgtaagaaattgtgagtcagccttctccaatcctgactttaagagttgcaaaaatcatctgccagggatcacatatgttctcggttccatgagaggaagaaaacacatttgctggaaaaaaaaaaaaaagggaactttaaaaccagtggagttagaataaatacacttgcattctgctaacttcttttcctttccagggcctgaaggcttttctggccctggacaggaagcaaggcatctgtcaccccaaatactgcctctccgggatgggggttccagctggtcatggaagggaagcaaaggaagtgcagaatgaccaaaagatgggattaggatgcagaaataataaatctacagcaactactttttgaagccaagacatccaacagctataagtccaatctctccttaagacctcacaacactccaatatgattggtaataaacttcagtctgcagttgagacatgacttttagcagactaaggcacttggctaaggtcacatagctagtgagccaggtagggaagaataccagagcctgtgagtgtagtatttcatgagtagcattacctatggaacctccagaacattggataggtatttccatctaagaaattgtcttcagcctggtgcagtggctcacacctatagtcccaacattttgggaggctgaggcaggaggatctcttgaggccaggagtttgagacttgcctggacaacatagcgagaccccatctttacaaaaaaatttaataatttaccagacgttgtgatgcctacctgtagtcccagctactcaggaggctgaggtgggaggatcacttgggcctaggagtttgaggttgcagtgagctgtgatcatgccactgcattccagcctgggtgacagagtgagatcttgtcttaaaattaaataaataaaattgtctttttaaaaaaaagcagagaaagagtctcctaacatcctaaagcaacagcttactggcaagtactagtgcctccatgttaacattgcagaaaccagattcaaacaagttgtgagtttctcttgaagcaaaagaaatcaattacagggaaaatggaactctcaacttaacactcaacttaagaaatttaaaagtcatttcatgatgctttgcccttcttcacctctcactgaaacagttctgttcttcagtaattggtgttgggttgttcccgtgggttgacagtcagcatgtttttatttattaaatggtgtaagtaaaaattgatgtggtggaacaatcatggcagtctctgccacagaacaaaggctttttccaaaccagcatttcccccataacatctgtgaagatgtttcatgtggattttccttccccaatatccaatggcattatttcatgttcagatggaaatgacagtgacatttcatttgaccaaggaaaaataaaaggaaagaaagaaacatttctacatttaacagaacccaaaggcaatttgaaaaacactttggaagcttatttccattttacgatctaaagcagacctaaggtgtatctgtagacaggtggtgctggttgcagttctgctgtgagcctttatgaaaaggattatgttgactttctgagaatatttcaggactcagcatctcaaaggactccaaaatggtggttttaaactcccattgaaatgggtcacaatataaatcctaaagagaaaaccaagccaggtaaacctagggtcttggctccacatcaaacctcacaatttgaagcccaggttattcttacaactctcttaagacctctaagcccatcctcactagccacagcctggggcttccttgatcctgctaaaactgagccaagaagcaaaagctcagtgagtgtcattttgcatagaactactaagcaggataaagagaagcagtaggaaaggaattccccagtcacagaaaactagggtgtctgattataagatagtagtctcttccttcaaggctggtgggtaaaattctcccttgtgcctttgaatgagggatttcccctaaacacaatactgaagtttgtatttagttgctggaaccctggagactggggacttttttaaaaggcagaactttcagaggaagctggaatataatgcctattatagtgaactgtaacttagaagtaccctgtagagacaagagaagtcaaggttgtttcttaacacagctttaacaaaaaatgtaaactttggttggattaagctattactgatctcatgcttctgttggtagaaaatacacctttttataaacagaactattttggggaggatgataaatcacatcctaacgcataacatttttatgatttaaagacagttggtcctcattacatgtggattctgtatctgcaaattctaatactcgctaaaatgtatttataatcttcaaatcagtactcatggtacttttgcagataagcacagagtgacaataaatttgagtcactcaaagtacattgtaaacaagtgtccctttcacgatctatttggtgccatatttttttgcatttttatgccttttgcatgttcagtggtgatttcactgtttaaaaatggcgcccctaagcaatgtactgaagtaccgtccagtgtatctaagcacaagaaggccaagatgtgccttacagagaaaaaatacacttgttagacaagcttcgtttgggcatgagttatagtgtttttggccatgattcaatgttaataaatcaaaatatatatattgaatatttatgttatttcaatatacatctatatattaattatatattaaataaggtgtctttaagcagaaacacacataaaaaaggttatgcattaatcagtggacaaaagccaaaggcttataggaaccaagccccgtatttcctctaggagcaatgattcagtatttgctaattcaacatccatgtctgtgttatagatcataattagtgtgaataacagaatcaactgcatttgattgaaagctctgtgccatctggttacttgagtggctctattatgtgcagacatagtctccaactatctttaatgtgactcagaaatgtcctgctatattcaggatcaggtttcaggtaagttaggagttacatagactggatgagaatccaaataaaatcttacacctgagtcaaagaatgggacgctgattctggagtgtggtgagagaagggaaacttggccatgcgctatggggagtgccgccatgaggggagggaaggagagatatggaagaagctgaagagaggaaaccaaaagtagagggaaagatgtgtgtgctcacagtgacgccaagagccagcaccttagacagtgctcttaattgtgggatgtgtcactgtctgagaatattcaacattactccttccaccaaagtatggaacaggaaaattaatgtgtgtacaatgtcatttgttatactttcttgacaggcagtaggtgagataccaacacattctgcagagcttaatgacatcattttaatgtaaattgagcctgtttatttgcttttcctgtttcatataaggttatgactctgtctcctggctacccagaaaaggccattttgattttggataaatagtatctgtagaaatgtgtttttaaataaagggtacttcatgcacttaagttaatggactttaataatctatttaatacgctctggcaagaaagatgtttttactagctaccattggagaaactatgtgttctcatattcaggcataaggtaatttgttttacacgcagaaaatagagtttacaatttgaaataaacaaatcactgctttaaacagtgtaggagagagtacactacttcaaaaataattgcttgtttacatgcatttgcttgttggaaacaaaagactgaaatgagagctcctctatcgttagtctgttatgtgaaaaaatgagaaagtgcatacaaggacccaaagcagtagagagaatttcccataatgccatgtggacatgataaattgtaccattttgccagttaatgatatattagatcaatacagcatctaactcgtgagcttcagctagaaatctcaagtctgatggaaaactattttttagtatcttaagaaagtctcaaaactttggaaaaaattagtgtttttgaaatatggccaagttatatcttcacacatgaaaaatgtactatatttttctaggagtttgaaaatcattttgagggctgagagtttttctaagcagtgttaaaaccacattgaattgctgttaaagggtaatagtcataccctttcatattgttttgagaattaaacagaatacagcacatggaacaaaaattaatataatatcttcgatcaaaaatataattctaaaataatattattcaaaaatataataatattcttggtagagtaaatgttggccctaaaaaagcatgtagttatcaaaattgtcctaaacaaaatatcattttctgttggctgtcattgctacaaccatgccactcttggaaactgatagaaccaacaaagtaaatggcaaaaagaaatgttgaggacaacaataatgctttcctgattcctccaaatcatttcctataaagggctgtacaatgagattgcttagtctacatgcctatctgttccactcattggtaattaaaatgaactgctataacaaggaacctcaaaatatcagtagcttaaaacaatgaagatttactgttgatgtgatccttccataagaatcaggtagctcttcttggggtccctcttaaatagtttcttccatgttgcagcctcctcagtcttagtagaagagaaagactttataatgattgttagggaggtttatgaccaggtctagaaatagcaacataaggccaggcatggtggcttatacccataatcccagcactttgggaggccaaggcaggtggatcacctgaggtcaagagttcaagaccagcctggccaacgtggtaaaaccgcatctctactataaatgcagaacttagcaaggcatggtggtgggtgcctgtagtcccagctactcaggaggctgagccaggagaatgtttgaacctaggaggcagaggttgcagtgagccaagattgtgccactacacttcagcctgggcctcagagtgagactctgactcaaaaaaaaaaaaagaaaaagaaaaaaggaaagaaagaaagaaagaaatagaaacgtaaaatccacttccattttaagaccagaacctagtcctaaggccacaaagtaacttcaaagtgtactgggatgtgccctcttcctgtttgcgtagggtaaaaaaaaaaaccaggatatgctttcttgattcttcaaagcaagtaaaggtttaaacttcccagtatgttcagtttatttcttaacatgccattaaatgagctgaacaatttactggaagaggaaaataaggtaccatttgacaccttaatttatgtatctcagcatgcatagttgaggttggtgttaagcacagctaaagttccaagtctcctctgaagctcccctggtgatctaactgggctttctggtgatggtctcctctaggctgctatagtaacatttatcaaatatgtctctgtattctttctttctgtgtattatgtctgttatcttcctgtttaaagaattcagttcttctctgctttgtgtagctacttatttctttgctcagttcttgtattcttatatttatattttcagcctggcttcctaggggtcatccctgtgttttctcagctcagtgatcaaccagcgattgggcagagattatattcaaacaccttttatacaaagtatacaaagaaacaggaaaatctaccctgcagcctgtactcagaaaaaatagtgttcaatgaaactaacttacagagtcagccaggttgttagatttaacaaagatgtcaacacaactattaaaattatgtttaaagaattcaagctaagcttcttatgtttaataatattatatagtgtagtatattgtagtatagtataatattgtaactatagtaattaaggatgtgtgttctggagtcagactgcaagggtttggatcttgtgttcattacttacttgctttttaccttacctagttatttaacctctttctgcctcagtttcctcatgtaaaaataagcatagtaactaaagtaccaacctcatacatttattttaaggattgaacatgataaaatatataaagcactaaaactggcaagcatttaaaaaaaacgtgcagtgagccttcaagagatgctaaatataatgagtaatacaatatagaactatgattttatttgcttgaatcttctattgctggtagcattatagacttacccatagtaggtcacaataaatgtttactgaatgaaatcatgaatattttgtttcgttggttagttagtttttttgttttttttttttttttttgattttttgttttgaaacaaggtctcactctatcacccaggctggagtgcagtggcacagcataggtcactacagccttgaactcaggggctcaagtgaacctcccaccttagcctctcaagtagctgggactataggcatgtgtcaccacacctggctaactttaacattttacattttttgtagagacaggatcttgctatgttgcccaggctggtctggaactcctgacctctaggacttctcctgccttggcttcccaaagtgctgggattgcaggcatgagccaccgtgcccagccagaaatcatatttttgatgcatgaagtagagagcctttcacttcaatgtaaggggactataaaaaattccttccccaatgtatttcctctagttccacacagatgccaaccttaattaagatgtaatatttttattcagaatgaagaatcaatgttaaatgcaaataaacctgaaaaagtaacatactggcttaaattcacactataattttccatttaaacacagtatactcaactttaagtgaaacacctcctgatacaacatacctaaaaagctggataaaatttaaaaatttaattttatatgtataactgcactgttgcaaaagtagaactcctgcaaaggccagaaattatatgaaaatgcagttccacagaagcacagccacttaccctggggagtttaccttttgcttgtgacccagacctgggttccaaaggtctcacccaggggattaaaaacaaagcttaaagacatagcaatgtggaacaacatacattgaaagcaagaaagattagtgtaaggacaagtgcacatctcattcagagttcatggagataattgcttgcctcactgtttagggagagcacaaaaaagaaaatgtattccttcaatatctccaaccacaactctaccaggttacctttgtagccccccaaaaagtaagatccgagtttaaagtggcctcaagtttgtagtatcccagcttctttctgctttacagaagaaatacaaattctttctggaagaatgcaccttaaacccaagcttcatattaaaaaaaaaattataaggagtatgtgctcccaaacaaaaagtcaccaaacacaaaaaagtgagaacccattagcaaaagccaagagaaaccacaaagtggagaatttcagacattggagttatcagacctagaatatgtaagtttgatctctaacatgctcaaggagttaaaagcatatagcaagtatagtagagttacataacattaaacagtgaaataataactgaaagtaggaactacattaatcatcggattagacttagctgaagagaggatttgtgaactgaaagagcttttattaggagatatacctaatgctaaatgatgagttaatgggtgcagcacaccaacatggcacatgtatacatatgtaacaaacctgcacattgtgcacatgtaccctaaaacttaaagcataataataataaaaaataataataataaataaataaataaaattaaaaacaagtagcatatagtaagtatagccattctagaaaaccgtagagatattcctcaaaaaactaaacttagaactgctatatgacccagcaatcccactactgggtatatatccaaagataatggaatcaatatgtcaaagagataactgcactatcatgtttattgcagcactattcaccatagccatagccatgacatgaaatcaagctaagtgtccatcaatggatgaatggctaaagaatatatggtatatatacactattctgccttcaaagagaagaaaatcttgtcatttgctacaacatgaataaaggagggcattatggcaagtgaaataaacctggcacagaaagacaaatactgtatgctctcaattatgtgaaatctaaaaaaattgaactcatagaagcagagagtagaatggtggctaccaggggcaggggttgaaggagcagggagatgtcacttaaaaggtacaaagtttcagttagacaggagaaataaattttggagatttgttgtacagcatgatgactataattaatgataatgtgtgtagtatacttgaaaatcactgaaaaagtagattttaaaatgttctcatcagaaaaatgataagtaggtgagctgatggatatgttaatttgcttgatttaataattctgctatgtatacatatatcaaaacattgttatataccataaatatatacaatttggcatttgtcaatttaaacaaataaatgatgagacctaactctcaataaataaatacatacatacttaaggaatgcaaaaaaaatttaaaaaataaaataaaaataatttaaaatgccacttaaaaagacagagtggaggtaattgtgaaagaagcatttgaagaaaaagaaaatatagtggggaagatagaacacatttcagattgaagatttggggcaggggagggcagacttctgtgaaagatcagatggtaaatgttttaggcttaggggccatagagtcttggaaatacttaactctgaggttgcagtgcaaaatcatccataagtagtaatgtaaataaatgagcccggctacattctaagaagattttatttctacaatggcagcacactacatttggcccttggatgatagtttgttaaatcctagactaggaaatcatagaaaatcagagcagaataaaatttgagaagagaatggattatacctcaatcaagataatctaaaaaataaaacaactctaaaaagaaaaaaagaaaaagtacaataatggctgagaatttttcaggaataagtaaaataaatgattctcagattcaaggacccccaaaattcaaagtgagttaaaataaaaataaatccacatcaagatacattactgtgaaactgcataacaagaatgataaagagaagatcttaaaagtagccacaaaagtcagtaaattctttcccccaaaattatgtagacaccagacaaaattgtcaaaaataaccacatatggttccagaaatcaaccaaaggcaaacaaaaattatgaagcatttatttatgaaaaacttctagagcgttgggtgagaatagtagtccgtgactttcattcctggggctacccccatcacctagccatcagcagatgcatggttgatgctgtagttttacaagagggaagttggctgtgaaaatcagcaacttaattgtcagaggggactgatttgatttggaatgaaaggtaaaaaccacactaagtagcattgtcagtaaaagtagcaaacttgataagaaatgaatgagtaaaatctgctgctcataagcttgaggttgtggtctcatttgggtgggcagtggacaagcaagaaacttaacgaagagatcttggaagaaagggctatataagcttcacacagccatggctgattgggaagcacgggtgcctttcagagagaccacagaaaagtgcaagtcaaagaagaggtgaaaatgctcaaagttttaacatgttccccaatacacatatatacacacactgaaagtagaagccttatcgcttgaggtgtttgagtacaatctgtgcacaatcattggttgaccactgagctgagaagacacagggatgatccctaggaagccaggctgaaaaatataaatataagaacacaaggactgagcaaaaaataagtagctacacaaagcagaggagacagactctacagattaattcctagcaagttcctaaaacaaaacaaaacaaaacaaaacaacaaccttgggggaaaaagtaaagatgctgtattttatgatctaacatgttagttttcaacaaaatggaacaaagtatgaaaagaaacaggaaagtctacctgcaacctatactcagaaaaaatagtcgtcaatgaagctaatttacagagtcagccaggatgttaaatttagcaatgatgtcaacacaactactgaaattatgtttaaagaattcagggaaagaaatgtataaagaattaaaggaacatatgactagtaacagcacaagagatacaaaatctcaatagataagtagaaattatttttaaataatcaattatgtatgtagaaaatcccaaagaagcaacagtaacaaaaaatactggaattaataagcaactatagcaagattgtaggatatgaggttaatatacaaaagccaattgtttttctgtataccagcaatcaacgattgaaactttaagtaaaaacacaacaccatttacattagcaccaaaaaaatcaatactttaggtataaatctaactaaatatacacatgatctttatctgaaaaattataaactcaaaaagaaatcaaagaagatataaataaatgaagagagatacatattcatggacaggaagactccatattgtcagaatgtctgttattcccaattttatctacagattcagtgtaataccaatgcaaatccctgcaaattattttgtggatattgacaaactgatctaaagtttacatgaaaggcaaaagatacaaatagccaacacagtatggaaggggaagaataaagctggaggagtgatactatccaacttcaggacttactatacttactataaagctatagtaatcaagacagggtggtatttgtaaaagaatagataaatagacagtggaacagaatgaacagcccagaaattggccgatacaaatatagtcaactgatctctgacaaaggaacaagacaattcaatgaagaaagattagccttttcaacatctggacatcaatatacaaaaaaaaaatatgaatctagacacagttctgacacctttcacaaaattaactcaacagatcctacacctaaatgtaaaacccaaaactataaaatttctaaaagataatataggagaaaatcttttaatcatttaagatttaatcttaaaagattaaaattataaaatatacaacacaaaagcaaggactctgaaagaaaaaaactgacaaactggactttattaagatgaaaactcctgctctgtgaaagacactgtcactagaatgaaaagacaagccacacactggaagaaatatttgcaaaacacatatctgatttaaaaaaaacttgcatgcaaaatatacaacgaacacttaaaactcagcaattaaaaaaaccacacaactcaatttaaaagtaaacaaaagacctaaacagtcacttctctaaagaagatatacagatgggaaatatgcatatgaaatgattcacaatactatgtgtcattaggaaattacacattaaaacaacaagatacaattacccacctattagaatacctaaaataaaaaaattttaaaaagctgacaaaccaaatgctaacaaagatgtggggaaagagaaactcattcattgctggagagaacacaaaatggtccagccacttttgaagacagtttggcaattccttaccaagttaaacatcgacttactatatgatccagcaatcccattcccaggtatttatccaaattagttgaaaacttatgtctacacaaacacccacaaataaatatttatggcaggtttttttcatggttgtcaaaatgtggaaggagccaagatgtccttcaataaatgaatgaataaactgtagtgccttcctaaacgggaatattatgtagtgataaaaatcaagctatcaagccatggaaagacatgtaggaaattatgactatcccaaaagattcaaaaataaaagtatatgataaaagtcaacaattattcctagtcaaaacttttaacagtcaggaacttaaggatatatacttgatctgaaaaaaaaaaaaggatatctataaaaaacctacagcaaatactatagccaatggtgaaatattgaaggaattctctttatagtcaagaacaagacccaactgctatcaccatttcctttcagcattctactagtgagcctagccatcacagtaagacaagaataagaagcataaggattagaaagaaacaaaactgccattatttactacttttctctgaaaaattcaaatgagtccatatattattagaattggcaatttagtaaaattctttcacgtaaaatcaagctgaaagttaactttcaataccaagtatagtcaaacatgtgaagaaactggaattctcacactttgacgagggaagagtaaaattttataaccattctggcaaactgtttgccagtatctattaagctaaatatataatatatataacctataaccagcagttttccatctatgtatacacagttgacccttgaacagtacaggtttgaattgcacaggtcctcttgtaagtgggcttttttcaaccaaacatggatagaaaatacagtattcactgggtacaaaagctgtgtactggaaataccaattggaggacctactttcgatatatatgcaatttctgtagggccaacagtgggacttaaggatatgtgaattttggtatatgtgggagttctggaaccaatttcctgcatacactgagagacaactgtaatcaatgaaaataagtgcttatgtccttcaaaagatataaaataatgttcatagtaactttagtcataatacaaaataatgaaaacagaataatcaaattgtaatattgttatataaataaataccacatagcaatgaaaaaacacaaatacgtatgacaacatggatgaatcctgcagactcaatattgtaaacaaagaaggcagagattaaaaagttcattccatgcgatcctatttatatgaagtagaaaaaaaggaaaaattaatctctgttgatggagatcagattagaggttccaaggtgaggggacgcagtattgactcagaaggtaaatgctagagccttctgagaggctggacataatctatattttggtctgggtggtggttacacaggtgtatacatgtgtaaaaatcaacctcaatttattgttttttaaattttaaatgttaaaatctcctaagttttattttaatcagctttattgagctataatttataaatattaataataaattcacaaatgttaaatatacaattttataggttttgataaatacatgcagttttgtaaccaccagcataatgatgatataaagcatccccaacacaccaaaaatttccattgtcctcttttgcagtcactgtccttcatccatcctggtcctaaataaatggaatcataaagttgggtagtcttttgtgtttgatttctttccctcataacaatactttatccaagttgttttgttgatcagaattttatttttttatttctgaatagtattatatgggcattatttttatccacgcagtagttgatagatatttgagttgcttttgatttaaggctttgtaaatatacctatgatgagtatttgagtaattctacatgtggatataaattttaatttttcttgaataaaaacctagttgtagaattgctgggtcataaataaatacatatcaaattttataagaaactgctaacctgtttaaaaggtggttgtatcgttttgcatttctaccagcaatgtatgagaatttcatttgttccacattctcaccataatttggtatttttaatttcagccattctaataatgttttaatttgcatatccttcatgagcaatgatgttgagcatcttttcatgtgcttatttacaatctgtaaatcttctttggtgaattgacttttcaaatattttactcatttctaatcaatttatcttcttatgattgatttttaagaattctttatatattgcagatgcaagtctgttatcagaatatattttggaaaatatgtctcaatctatttcttacctatgcatttccttacctttaacttttgaagagctaatgtttttaattgtgtaacaatactttcttattttatggttcccactttttgtgttctaagaaatctcagtgtaacctaaagtcacaaaatattctcctgtgtttttctctaaaagtttgaatctttttaggtcttacatttaggtctgtaatcaacttgaattagatgcttgtgtttggtctgagataagcattgaggctcatgttttgcctataaaaaatatgcaactattctagtgtgatttattttaaaggttattttcctcataaaatttccttggtaccttcttcaaaaatcaattgaccacatatgtgtgggtctatatctggaatttctactgtggcccattgatctatatatctcatcttattccaaacatactttcttgccaattgtagctgtataagatttgaaattatgaagagttagctcttccactttcgttctttcttttcaaaattcttttggctatttgaggtctttacatttttatataaattttagaatcagtttgctattttctacataaaatctagctaaaatcttaattgagattacaatgaatctacagatgaattgggggacaattaaaagcaaaacaataaatagttttccaattcatgaacatggtatgtctctccatttatttgtgtctttcttaatttccctcagcaaagttttgaagtttctagtgtacaactcttgcacatatcttgttaaacttatctctaagtatttcacttttttggtactattctaaatggtaattttgaattttagttcccaattattctttactaaaatacagaaatacaattagtcttatatatttacctcatcttccgtgaccttactaaacttacttactgctcctagtagctttatggtagattattttggatttttctacatagacaataacgttatttataaatgacaatagttgtaactttctctttctaattggaatgcattttatttcattttcttgctttatcgtaccagctaaagccatcagtaaaatgctgaatagaaatggtaaggggaaatgtagtaccttttttcaaatgttagagcaactttacatttctgggatatattctacttggtctacttgtattatcctttttatatagtgccagtttcaagttgctaatattttcttagagacttttacatgtatgttcatgataacttttaatctgtagttttattttcttataatgtcattttctggtcttgatatcatgataattctggcctcagactgagttagaaagtattccctctgcttctattttctgagagagtataaataaaatttgtgttatactattcttaaatgtttggtaaaatttaccaataaagccatctcagcctggagctttcatcttggttagatttttaatcaactattcaatttcttttgtagatataggactattacctatatcttcttgaatgaattcctgtagcttctatcttcaaaacaagttgtaaattttatatatgttttcaaatttattggtataaagctattcataattgtttatttatatgattatatcctctctttcattcctgatattcataatctgtgtgattctcctttttttctcagttaggctggcttgagtcttatacattgtattgattcttgcctggaactagattttggttacattgatttttttttccattgctttctattatctatttcattgatttttttttttttttttttttgctctttattacttttctccttctgcttattttagatttattttttccaaggtggatgcttagatcattgacttgagacttttcttattttctagcataaatagttatggtataagctatataatatcatataatgctataaccttacctttaagcatgctttagtaacatcactcagatttttatgtcattctaattttcattcacttcaaagtattttacaatttttcttttttcatctttaacccataggttattgagatgtttgttgtttaacttccaaatatttggggctttaaaaaatatctttctgttacttatttttaatttaattctgttgttatcagagaaaatattccatatatcttcatagttctgtgcagcacctcctctgactgaaaattatgcctttgcctctctgaactaggaactctgtttccttaactcagggagactgctgagctctgtttgggtgtcccctccctgcactatgacctggaaactcttcagatggtgacctggggcattcactgggcttaccacatttgtttgtattctcttagcaatcactgtcctgtgctatatattgcgcaatatctgaaaactattgtttcatatattttgtctgttttcctggctgtttaaacaagaggggtagttctggttctttttgctctaccattgccagaaacaagtcaaaaactatttaaagtcatattatgtttcatcatataccaacaaacagaaaatgcaactttaaaatgatgccatttacagttgctgaaacaatatatctaggaacatatttaacaaaggatatacaatttgtggaatattataaaacatgctaaaaacacattatttaatacctaaacaaatggaagaaaaataccatgttaatagataggaaaactcaatagtgtaaaattatttacagacaataaaatatcaatgaaaattttaataggttttatttcacatggaacttaataagatgtttataacatttgtgtataagaacaaaggactaagaattcccgggaaactcctaaataagacctatcgcccaatcagaaatcatgatttataatgagtcagatttgcacagtgtctaatagcacaatctgggtgaatagattgcctgagtttcaagtcttgcttaggtacctacaatccatttctttgagctcaatttcttcatctatataataacagtgcccactttgcaaggtaatgatgaggaatacatgagttaacatgtgaaaagtgcttgggacaatggctggcatatcataaacatatatttgctatttttattatctagctctaaatcattaagacagcaaacatagagatggacaagtagacaaacaaaacatattaagaaacccagaaaagagtcccacgaaaatggaattttggcaaagctgagatttcagatctatgggaaagggtgggttatggtgtgggatgattgatcaattgattatccatgaggaaaaaatgaacactaaaaacaaaatgttcatcagctgtagaatgtaatatattcattcattataatatattcatgccatgcacaaccataaaaagtgaaaatgaattacagcatatcagatacatacatacataaatctcaaaaaacataatgccaagcctaaaaaaagtcacagaagaataaatacaacttacttgataacatttatgtcgactttttcaaaagcataactaacaatatattgattagagatatatgcacatttgtaaaactatgaaagaacataaaagaatcattcaaattaaatccaggaaagctgtcacatcagggtccaaggagcatgtgaccaattggaagcacttagaagatttcaaagacttcaaagggaaatgtattattgcttaagcttggcaatgggtacatgtgtattctttgcattgtttttatctttacattttagcacatatcctctttatgtctgctgtattttaaattttttatttcaaaatcatctgaggagtaccaaaaaaatctgaatgactattattggtgctataccaatagttttatgcttctgtaaataagtgttatgttgaatattttaaaatgtatcattgtgaaattaacttcttgctttaacctaaaaaaattctgagttataaatatccctggacaattctttccagaaagcaggctttcaatgggttagaattaggggtctcctgaggacataaaagagatgtccagtaagtgggaagaaatacagggagccaagggctgtgcaataacattagaacataatgaaaaataaatttatacttcacagttttcctagctgcccataagtggataaatttttttgtctatgatttttttagggagaaaaataatgtaatcatccaaataatcctaccttagattagatgcatgatatctcaaaaacagaccttaaggacctcatctggttttgtaaattaaaactgtctgaaaggaggaggaacatcaaacctttctttacaatggacactgctctatttttctacataaatatcttcattgccttgttttgtgaacatgagcctgcagacatatgagaggtatagactattctcacacatcatgccgtaaattcttcctttcatctactctaaggagtattcagggactggtgtgagctgctttttgctcataaaaacaagtgcagggtcctcagtggatctttatttactcatttaaaaaatatggaacattctagttcaggaccctctgtaatataattctgggcaaattttggaaaggccagaggatttactagcaaggattctgaagccaactgggggaaatttctcccccattttaagaaggatttactacacctctcaagaaagaagtaatctccaagaaaagtacaaagccagggccagagagccaaggagccagaagacaagttctgaaaagatcttctcagagtctttatgagaccatttgatctctagccttgcccatgatgcgtagagtggttgtttgcatttgtctttgttaaagtggggagagagagaagttttaagttccctcacacgggcatgtagtatcatctctgtattgcaatgtggctgtgtgacaatgcaagggaacatggtggatctgctgggcagccatggttaggcctcagagagaaaacctggtccctcctctgatcgcagagtgactctggccatcttaaacctaccttgtgaaaacacagcttgcatctaggcattgcccaggctacagaaagctagacagagagagagtgggccattatctaaccctcatttcataggaagttcaagcatcaattacatgaaaatatgaattcaaataatttatcattgtgataaaataggcataacataaaattcaccattttaagcatttttaattgtgcagttctatggcattatgtgtattcacattgtcattgatatagtttcgctctgtgtcctcgcccaaatctcatctcaaattttaatccccaagtgtcgagggagggtcttgatggtaggtgactggatcatgggggtggtttcccacttgctgttctcatgataatgagggagttctcatgagatctaatgatttaaaagtgacgcttccccctttgctgcctctctcctgccaacacgtaagaagtgcctggcttcctcttcgccttccaccatgactgtaagtttcctgaggcctcttcagccatgtgcaactgtgagtcacttaaacctctttcctttataaattactcagttttgggcagttctttgtagcggtgtgaaaaaggactaatacagatgtgcaactataatcaccatctgtctctggaactttttggtcttcctcaacctgaactctgtactcattaaacacgaactcctcatttccccttccccagtgcctgatagccaccatcctactttctatctgcatgaatttggcaactctaggaacctcacataagtaggatcataaaatatttgtctgttggtgactgccttttttcacatagtataatgtcctcaaggttcatctatattgcagcacatgtcagaagttcctgcctttttaaggctaaagaatattccattttatgtatataccacactttatccatctatcattgtttcttcatttatccatagacattaaggttgtttctaccttttggatcttgttaataatactattatgagcatggctgtacaaatatctgttcgaatctttgctttcattttttggggggtatatcccgacaaatggaattgctgcattttatggtaattctaagtttaattctttgaggaactaccattgcattttccacagcgactatcctgttttatattcccacccacagtgcacaagggcttcaactttttcacattcccaccaacacttactttctattgtttctgttttttgtttttttcatagcatccactctcatgaatgtagagcctcattgtgcttttgagttgcatttctctaatgattagtgacgctgagcattcattcattcatttatttagagtcgggtcttgctctgtctcccagactggagtgcagtggcacaattactgctcactgcagccttgacctcccaggctaaagtgatctttccacctcagcctcccgagtagccggaaccgcagcatatgccaccacatccagctaatttttatatttttcatagagacagggtttcaccatgttgcccaggctgatctcaaactgctggactcaaatgatccgcccaccttggcctcccaaactgctggaattacaggctcacaccactatgcccagccgctgagcatctttttatgagcttattggccttaaataatttttaaagctgtgcaatttcacattcaaaaagccatttcttaatttcactgtttgtgtgtgtgtgtgggtgtgtcaattctttatcacttatgtgtaaaatttatgtggtttgagtaaagagggaaaatggaaaaggaatctttaaacacattaaacttgatgatcacatgattttcaaaatctttaatggactcactttctccttactcaagctccatcaaaagttaattaaatatgtagaattttcctagaagctaagcacattcttaggtttattcagttttgctcatgattttgcatacttcccactgccattaaatcagagcattggaaactacaaaggatttctataggtagctcagaaaaaacagcaaatgtgcattgaattacatgtcatcccacattttcacaagtacctacaatttatgaataacctcttcttttttaatatttggctttcagtaaccagaaaaattcaatatgttgaatgctttataataactaagaagttgaagaagaaaacttgaaattataccaatgaaatcccattacccttgtaagttacagtcaaagaattaataagcccatctgattgcctaagtattcatagttttgttttgtcattttgttttgtttttgagatggagtctcgttctgtcatccagactggagtgcagtggtgcaatcatggcccactgcaacctcggcctcctaggtgcaagcattcttcccacctcagcctcccaaatagctgggactactgctcaggagtaagtcttgtatttcttgtagagatgggatctcactatgttgcccaggctgttctccaactccgaggcccaagtgatccacctcttaaagtgctggcattacaggcatgagccaccatgcctggcctcttcatgagttttgtctgtttgttttcctcctcagaactatgtaagtctcattagaatcctttaaagagagacaggagcctcgcttgcatttcaaagtaagtaagaggtcatgcccactagagtcacaagtatgtaaagcctcagggataaatctgaatatatattactgttattactaattagtcataagaataacttttaagtcacccagcgctttggggttgttgtgctttaatgctttagattatacgttcaataatatctctggagaccaccctaataagaaatagcttatttttacctcaggattctactctcaaatataaaattttaacttgcactgagagccaagataattcttaaaatggcacatggaaaaactgtgactacaaaactccagcctccatcacaacctggctgtctaacacatttttgtacaacttttcaaactgcttctaaatccactgttggttcagataagtcgttcagccttctatgtaagggagtattttgcaataaaaacccaaaaaagttcctcttggcactgacaattttataacataatgaagcatgtcctaaataattttaagattcttttacaatatagaagcacagatgggtgacatcatggtataaagcaacttttactgaaataaaaaaatgctttttaaagggttcttagaaattagagctgttaaatcaagaaatctttctgtagcatttgactataaaattgaggaatctaaacttacaagcctttgtcttgaatctaggaagcatgaaaaatcttacaggataaatgcagaccacaaattcagttatccaagcactcaaaccatgcctctctacatatggccacctatataaagtcactatcagtgtaaagtggcaaagcgtggcataatccaaatagctaaaggggtggaccttgctcctgttcccactgtgttttataattaagttagaatcaatattggctgttcttggagaccatcatgacacttacctcaagtccctcaatgtgatataatgtccaaatagtagagtgagataaatttaagaaattattcacatctaggtttggaaccagaacagagttcacccatctagacacaaagggaggcaaaatatccatatagcaggtattggtcaaggaaacaggaatcagaatactatgcatacatggttttaactggctgctactgaacaggtgtcaacaaagtactaccaaatctgtccagccacctgtttttacaaacaaagttttattggaacacagccttgcccattcactggcattttgtctatggctatttttacactccagtggtgacactgaatatttgaacagaggccatacagttcaaaaagctgaaaatatttactgtttggctccttacagaaaaagtttgctatagaacattctgctaggatatcaaggcaatcttaaggaaggaccaagtaaaaaaactggattaagccaggatgaagtaggacattggtattttatagccattaaaattattacctttaattcatatgcattcttacaattgtcaaagtgctttcgtattcattatcccacttgattgttggaagaaccctgtaatataaacagcgtagttgccacaacacctttttcaaagtgatttggccctgagaggtgaagtgttttctcctggattacataacaagtgggggtcttctggcaccgtgagcttagaagccaaacaaagctagccaggtgctgtggcttacacctgtaatcccagcactttgggagcccaaggtggggtggattgcttgagcccaggagttccagaccagcctgggcaacatggcaaaatcccaactctacaaaaaatacaaaaaaaattagccaggcatggtggcacatgcctgtggtcccagctactcaagaagctgaggtgggaggatcacctgagcacaggaggttgaggctgcagtgagccatgagcacaccactgcattccagcctgggcaataagatgagaccctgtctcaaaaaaaaaaaaaaaaaagtagaagtcagacaaagcttaccaagctaccaggttgtttgtcttgacatctggccagaaagcaagatcaggaggcggggcaaaggtgaaaagttcaagaagcccagcagacactgtgctctggcaccttacacctcaggagaagacgcagacatcctggagcgtgtttccccactgacctttgcagaggcttgctggctgcacacaggaagctgttctgctcacatcctccaggctgctgccttcccatctgctcttcaacacaggatgttgttctcccagatcagagctgctggattcccatgacacgacgctcatgcacacatcctatctggggatgctttgcagccacccaagtgcagtgcattttggggtctggcacacagcatccaagatgacagaggcactcttcccaggtcaccgctgtgactgaacagccagtctgtgttcacactcagtgtttgtgtggattgcggccagactttttgctttgtcgagaagagggcagattctagggccagactgactgagttcaattcccgctcctgtacttagtatccgtgagatcttgggtgagtttctgggcctctgagagtttcagtttgctcatctgttaaatggagataataatggtgtctaccttgtcaggtcaccatgaaggataaatgacttaggacagtgttgggcatatagtaagtgtacaataaatgctagcaattgttcttaatgatcattactatctcaaggagagctagggccctgccacagcctgtagcattttcttcttgggaggcaattttttgtcttggggtacctgatgcctttataccctcagttggatgtacactgtcaccaagatatttgttcacatcttgaagattggaaagcagatagaactttggaaaaaacactccatatctgcaacaccaatgtgctgatacactgggaagagactaatctctccagcttctgaggcagagtgtagcttcagggccgattagtatcaccagctcatgatggaaaccccagttagacgctgcacagtgaggtggtcacgtgaggttcttcttagggactgtgaagaaatgaggcagggtattcccttatacatgatctctatttccatgttcaaaactgcaagaaagtttgtttgaagcccataggaagaatttaggttagctacaagaaagaactagtaaacatggagatttcatgtgctgccaaaaaagcgaagttggctatgcctttgggatttggaaaacagaacagagtcagagaggtgtgaggcagctcaaagctaggcattgctgaaccaggagagcacaagagatcctcagagccagcccccagctatggatggaaggagcagtcatgcatgagcaaccactggtgtcaaatcctgccagaaaacagaagtgcgcattaccaggtagagctgctcattagagcccaggtgaaggccagcggagcacagggttactgcaggctgtggcctcgaaccagccccagggaggagatccccaacagctgcctccttcactggggtagccaaagatcatccctaagccagggcagctcaggcagttacaaaagcagaatccgggagctttagcaaaggttcagaaaccaggaagagagttcatgggaagggctagccccatatttggaatacggtagtgttctctctctttggtgaggatttacgtcaacagaaaggatttccagacaggtgtggaggcatccagtcacgaaactaaatagagatatatgtggggagggggtcagggaggcccagaagtacaatgaataattcaatagtgatatcactgaagatggttcaggaagatgttctcatgctgaaaaagtcatggcagctgcatttggaacagggtatttgtccatttgcattgctataaaggaatacttgaaactgggtaatttataaagaaaagacgtttatttggctcacagttctgcaggctgtacatgaagcatagtgccagcatctgctcctggtgaggcctccagaagcttgcaatcgtggcagaaggtgaaggggagccagcaagtgacagggcaagagagagagcaagagagagacgggagggccccgaccctttttaaacaaccagatctcacgtggactaataaagtgaactaatagagtgagaacgcactcattaccacgaggaccgcaacaagccatttatgaaggatccacccccatgacccaaacacctccactaggcccaccatcaacattggaggttgagacttggaagggacacacatccaaactaaatcaacagggtaagcacttagaatttttaagcagggagaaaacttccagtcctatcctttctgaataggccaaaggatgatcaggccagttccagaggtgctgacagtgaaatcgtgagactcagggaggagatccgtagggccctggagagcagaggctgtcaccagcacatgcaggaggcttgttacaaagtcttaagtaaaaggcaaatgtcaaggttcagtgtgttgaatcctgctaggattaggtcattgtggggagatactagcctagaagggaccacacataggaataaaacccagtcccagcccagtggctcacgcctataatcccagcactttgggaggccaaggcaggaggatcacctgaggtcaggagttcaagactggcctggccaacttggtgaaaccctgtctctactaaaaaaataaaaaataaaaagaataaaaaataaaaaactagccaggcatggtggcaggtgcctgtaatcccagctactcaggaggatgaggcatgagaatcacttgaacccagggagcagaggttgcagtgagccaagatcgcaccactgcactctggcctgggcaatagagcaagactctgtctcaaaaaaacaaaaaagcaaaaaaatggaacatagcccacgaattcaaagtaaacctcagagcaaacctgatcagctggtgaatgatctcagtatggaagtcttaggctctggagtagatgggcaagttgcctgttgatcacaggagacagattgtctattccagattaaagcagcattcttggaataagctttataggtgtgtaccattcccagagtgagacagggtttgttctctagaaactggtcttttaccctgagattactcacaattcaaacaatatcattgtgatctaatggctacttccttatttttggactcaaactaatgataaaaataacatagactcttcaaactcttctctttccttttttgctttggtgctaggaagctcacagccaaatttcttttcctccagactctatgattattcatttcttattttaatgtcacacaaattttatcttagtagtgtatgtattttgcaagccaactcacatcctttgttaggaatgaggtaaggatagaaacaaattaataaaacctctcttctttatttctgccttttatttttgtaagggttttttgttgggcaggcttgaaactgcatgaccaagcaaatgtttctctgtcaactttctattctttctttggtttaaaatgaaaatataccatgcactgttgaccatggccctgtgttcagcctttatgatggcctgagggtttgatatacactaaaatgacaaagcatttcaggaaacctccactgagtggagaggaaaaataataaaccacatggtgctcttcaatgcgctttaaaatattgactttgtggatgaaccagctttacttaaacagatgcatgagttttggtacagacatgtgaagtctgtttcttgagtgacaggggatacatttaccctaagtattacagctcaaaccaagcatggtcactgaaacactgattaggtgacaagtgaaatgagcttggtgttctcgggcaggttccccagtgtctccataaagggacataacctgtttatggcaggtagtccctacaaaatggaaggagcaaaaatgagcaagcagccctgcaagtgacctatccccctaaggtgcagtagcacctgggagggcagccgaggaaaattggatccagtagttgctagcaccggcacagggaagggagacggcttccagtggctcagacaagcagctgattccaaagcccactgggcatgacaatcacctgagaattgcttttttttttttttttttttttgagacacagtctcactctgtcacccaggctggagtgcagtagcacgatctcagctcactgcaacctctgcctccagggctcaggtgatcctcctgcctcagcctcttgggactctaggcatgtgccaccatgcccggctaagttttgtatttttcgtagaaacaaggtttcaccatgttggccaggctggtctcgaactcctaacctcaggtgatccacccaccttggccttccaaagtgctgggatgacagacatgagccaccgcacccagctgaaaattgttgttgtaaatttctgggaccctctcttgggcattttccagaaattctaattcactgggcctgagatggagcccagatatgccaattttttttagaggttctccagctgattctatagtctctcaggtttggaaaaaccaccctggcctaaagacagctgccctagccacactccactccacccccaccccagcagtgcagacatctatgtcatacatatgtgtatattctgttgatatacacacagtccccaacatatgatagttccacttaggattttttcactttacaatgggggaaacaatatgcattcagtagaaaccatactttgaattttgaaatgtggtcgattcccaggctagtgatatacaacgcaatactccctcgatatgctgggcagcagcagtgagccacacccccttgtcagccacacaattgagagggtaaatgacagatactctatagtgttttgtgtggccagacggtttgcccaactgtaggctgctgtaagtgttctgggcaggtttaaggcaggcttggctaagctatgatgtttggtaagctgggtacatccagtgcatttttgacttaccctattttcaactttcagtggatttatcaggacctacccccattgtacgtcaagggacatttgtatatacatatgtatgcatacagaggaatatatatacatatttatatatggacatatccatatgtatcttattggcatgatatagatatagatagatatagatatagatatagatatagatatagatatagatatagatataatctcccactggctctgtttttctggagaaccctgactagtacaattcccaactctacaagtggcctatagcataatccccttgatttttcccctttcccttgtaaaattagtctaattacactggctctcccagagaaggaaagtgtgctataataagacgtcattctattcctctgaaatgcttctatccacactgcatgggataaaaccacctgttttaaatggtgtcaagatgcagtcacacttctttcctggcactgatccttccagtcagcttcccaggccaaagtcctttgccaggtgccacagccctcgaagtcatgtgatttgtatccgccagggtccaagctatgtcactgtcagtcattattctgaggcatgaatctaaaatgtgagcctggtctctggagtagccacttggctagtgggtggagaatcctgactggttcctctctcctccatccctgcacaattggaatgctcttcatttgacagcctataaagtagccaaggttagtttctttgtgaaatctattcctgaaaagaaaggcgactgctaatatgatgaaggaactgaagacacctgaagaagcatgagaaagcaattgttcttgggcagacataaaagataatttggagaaatgaaagcatggactttcttatttggacagaattatgaagagtaaaagggctagcttaaattttgtagttatgctttactaaatttaatggagtggattttatgatacagcagtatttgcaaacgtggtggttcattacatttgcaggacacttctcataatattaagggtttactcccacattttttcctcccagtttatagggctgagattatgagtgtgatcctactatggactctgtggtctgagtgaagaattgattttgtaactgacatttttcataaggctgtgctagacctgttaggaatcattaaaactgaagttttgaaaaagacgggctaaggaaagtatttattgagtgctaccatgtgcccgacaaggtgcagagttgtcatttcagttgatctatgtaggaactctacatggcaaaaattactataccgactttaataacgaaaagccagggagggtaacttgcccaggactgggcccacatttagaatttagaggtaactcctgttcccgttgattccaaaatttatgctctttccagcacataactgtgtctgataaagtgctaagtagcttcacatttatcaactgtaaatggggaatagcacagtatttacacttggagtggagttatatgaccacatcttcccagaacctttttatagttcatagagagtttgtatagactctccccaagggaacacagaataatcgaggttggaaacagcttaacctcaagtcataaaaatcactgacgtgggaaactaagagggaaaatggttatccttagtggaggagaggttgtatgcttctggtatgtgctacatgttcaattggtggaaggaatgttttcagccttgaaaaatgtgaccccttgaacacatttgatttttacatcatgactattgttttttgtaaagcacgctaagtacaagtatttgttagaataaactccgaactctttaaaaggtaaaataatttatatctctttccctgactctctctctctgatgcacacacatatgcacatacacacatacatacacatcccataacacatcacacagacacacaattgcccattttatcagttagtcggtaccctatggcagcccaaagaggttggaaattacattcttctgttttcttactttgtcatggtgctgtgcctgttctgtaaacagcaggagaagtaattatgtaaggtgggcattcgtttcacggtcacctcttggaatatactataggaatgtgctaaagcaaggaaatatttgcttgaactaatgcctggaaactgaacgtggtatgcacttcataataatatcaaccacacatctggctcatttttatgtattgtacctgagtgggtgggataatatttacattatttttccccttctaggctgtctggtgtgtagtctgtgcatgcaagggagtatcgtgtgtgtgtgtgtgtgtgcgtttcatattccctattgcagcatctgccgtttgctctgaattggagcatttaccattgcagaactgtcaccggcatcttagaaacacagatttacattccacaggtcccgtaaatgggctacggggctgcatgatgccttgtgtttaaaagagatccaaggggcagcccagcactttccgtccagctgcacttcatactgtaactgtgtccgttgaaaagtgaagctcaaaggattttttagaatctgctgccccagcaggtaacattctggagttttgttgtttttttttttttcttgttgttttttctgccatttaaaatgtccaaaccctctcgcttggctagacctttcttctctaatgcagcttctaagctgccatcagctaggcgggatgatttgaacagcaaacagaaaaaaaacagcttaggtgagaagattttgagaactgggagtgaaggaaatttggtcaaacagcagcaggtgcaaacggcggcaactcctgcacagcggaaagctacaccacacaaaggtaatgtttgaaatccactgcttttgtgaacgtttgcttagaaacttcctgcttaacaatactgaccggtaacttcaatgaatgagactttcatggcttcaaaacttatccatttgattgaatgtgaaattttctaaaatcctggagtgtgttgctaaaaataaccaataattattaggaagatggaggtgatagaactttctgtcattaattaatgaatgagataagaaatgctgattgttttcacttgtcttccagaataacagattttattcttggtcgtgttttgtagcctttcataatccaatcatattcaaagtttcttaccctttacctatatgaatagaaacaaaaaaaagaaggaaattgctctaaaacctcatcattaaccagcaatggaagtgttgcatgcttaattgtttagtctcttttaaaaatgaattgtatctgaaaatactaacgtatggttcattgaaaagcgtgataaaaattcctgctagtgttgttacctggagcatttaaattagccttctcaggtgaatgttggaatgtttcacctagcaagagtgttggtggatatttgcccaggaattgagaaatgtagtaacttaagctatctgttattttagcgtatgtaatcacagagggcaatgaaatcatagctgctaaaaatataatagtaatttcccccattgtaccaagaactacatattaaaacaataagcagcatttataatacttactttaatagagtttgagttttctactacaaatgtaatatttggccctgtgattttatagtaagataaaaaattgttttaatattctcattcttataactgggagtttttattttctaaaaagtctattttataattttaaacctgacctcttctccattaaaaactatgacaaacaaatacgcaatgatatacttttgtgccctgtactatttcgaagatgtaagtatctgtctggaaaattttaagttttcccttagttttattattattgtttcatccactgtgatcaatgacatgcttgtataaaaaacagagaccaaaatgcttcataaaaggcacatgcaatgaacactagaagaccttagaagtattgacagaagtggctgaatagaatgaattttggctgcatgaaagaaaaactttcttttctgttagactatgtataaagacatgaaaaattcttagaaaaggaatgtcaactacctcaacctaaagagcatccaaacatttatacagagtatatccttttttaaacaaacaatccgaggctcggtgcttattccaaagatttattcaaaatgctgaccttttcatggcgacctgtgagatcatttttaaatagacttagtgggtgaaaataattttctttgataaaaggtctgggttgggattagttcaaagtcatttaaaaccaagagtgagtattaaagtccaagatcaatataaataagacatatttttgtaaataaataaataaactggagataaattataaaataatgagttgggggattttttgagtttctctgagaggaaaaggaagtattctatgacaagacattttgatactggcagcaggactggattatttttgaaagacatcatcatcactcatgtttgtttttattctttaatcagtattttttaaatccaacacattgtatcatatagcaccaatagaaacctttaatagttggcaaatcggactatgagtctctttctaagatagctctgttgcattaggctttcacggaacgtggttgtcgtaagatcaagaaatccaataatagccacaccatctgagatttatgttgaattgatatggtgtttttgtcctcctcactaagatttttgtgttagttctttagaatgtttatttcatttggtccacaaggtttagcttaatcttgacgtagcttatcacgtgtcagattttatttctttcttgtgtaatttgttaaatgagggcaccctgatacatttctgactttttttttaagtgtgtctcccatttagtgtatttcttagactagtgtagtgacccttcctttcacctcttttccatgctcccctctctgcttcttaaattttctcttccgtacttttatttgggtattaaaatattgataatagttatgcttggttatcataattagttttccatcatccatctataggctaattctaaaagttgaaaatcagtacagtgtgtaactaatatgacctcataaatcctttcattactaagctgaaaagtgtgctaaatcattttctcttacagttttaaagtctttagtcttctgtcctcagcatctctatcctccaaaggactgtatggtcatggttatagtcatagaacgcccctttttttctagatgcttttctctgcattcctcagttcttctgccctgctctttcttgcctgatttctagaactcctgaacaggtatctcttactttcttttattattttgtgaaagcacattcccaataagcttaaggaaaactaaatgacaggtaaactttctaaatgtttgcatgtccaaaaaacatctttattttattttcacatttcaatgatactttggacaggcatagatttttagaccaaaaataattttttcctcataatgttaaaggcctttctccattgtcttttgagatctagaagtgttgatgagaagtcctgtgttgttcaaagattcagtttcctttgtaggtgatttttttctctctctctctcgaagctttaaggatctccttctttatccttgatgttctgaaatttcactgaagtatttaaaagtataggtgttttattcattcattttggcttgatgggctctttcaatttgaggaataatggccttcggttctgagtattctttcctatcaattctttgataatttctttctccgtatttgctctagttctctctttatggacctcctaggagttggctcttgaatctaccccaccaatttttctgatactcatctttcccttatatttttaagcttttatctcttgagtttttctaggagattttcttaatcttatattccaactcttctgctatctagttttgatcatcgtcatatttttaatttccaagaagcttttaaaattctgattatttggggaccaaaacacatggcattattttctgtatataagcaatatattcgtgtgcttcatttacctaatgtacttatctttgcctgttccaatctgatggcaccatatacccatgtttcatgatgagggtaaccatatcagtgtgatactggtgtgtttttattctgaaccaatggtctcaattgagccctagaacagaagagcctggcaatcaataatccttaggacaacagccttgaaactcatgttcacctatggagaattttttcatgatacaaacccaccaaatggaaagtgaatgttgaagtgtatgtgttgatatatgtcaataattttattcaggatgaggatatgagccaatatcttagaatgtggcatttcttcctgggctttctggttcctctgaccctaaattgttttgtcctgatttcatttatttatttatttatttatttattttagttatgtttaacttttaactgttctaaagaacaactttctttagaagaggatatactgacttcaaccttggtttgaaaaatagcttccatctcttatatatttgtgatgatgatgatgatgacgatgacgatgatacctaacctctattgggctcttcctatgtggccagcacacttctaagcacattataaatacactgactcatatagtcctcacaacaatcctgtgtcatagtcctattgctattcctattttgctgataaggaaacagacagagagtgtattagtccattctcacactgctgtaaagaactacctgagatttataaagaaaagagatttaattgactcagttctgcatggctgaggaggcctcaggaaacttacagtcatggcggaagacgaaggagaaacaagcacatcttaccatggtgaagcaggagaaaaagagagagcgaaggaggaagtgccacacttttaaaccatcaaatctcatgagaattcactcactatcacaagaaaaacaagggagaaatccacccccatgattcagtcacctcccaccatgcacttcccctgacacatgggaattacaatctgacaaaagatttggatggcaacatagagccaaaccatatcacagagttttgagttattttcccaagatgatgcagacaataagaagtagagccggaattctaattccagtggttttgagccttgtacttgcacatttcaccgtgatgctagaccacctttctacacaaaaaagcaattcactcatcagataagttaataaaatgagttaacactttgtgattggttagctagttcctgaaaaatctttctggtggcactctgcaattcagaataagctcttctgctttcagcatttgtatttgttgcccaggattattgtatcttaaacaaaacaaagaagtgggaaaggatgagaacaaatttcagagttaataaatgcatcacaaaactgtaaatgctcttctaatattgaaataaattaaaggatacattgtctatagggccttgctgtcctaatatgtatacttatccctgcagacatgagtatacacacacacaaacacacacatgcatgcacacacagcatacaattcaagaaaggctcttccatcacacatgacctggtggtcctagtacaagcctgcaggccaaaaatcactcaagtctaattctcttctgacacaggctccctctgtggccttgagcaaggcaattatccttctggattgaatttcgtcaaccattaaagaataataatatgtggtttatggggagaagtagtggtgaggattaatgacttagttaatgtgtgtccagtgttctcaagagctcatatcctgcatgaatactctaagtcaagcacaatggggtctctatttacatacctacaattgctatagagaataaaatcttactctgttgcaaatactatgcatgtacccataccaggaaaactctattatcagcccctggttgattgctaccttgccttattctttatgtttaaggagtaaacttacatgcatctccttttctatagcacatgtagattgagatcacctttagatacctggagctcaacattgtccacctctatattaatacttggagaacaaaaagtgtgtcctcttgctagtggcactcaaatttattctggaccctgctgatgactgtagttatcttagaccagtgcacagtgaagtagcctgaaggcagtcatggctgtggataggcaatgtcttgaaaaggtgcactcagtgtatggctttttcctaataataaggagcaagctgataataccagtcaatgggtatcatccattgataggacttatactttttctagtattttccagaagcagcaatggatttatattgattatgtgcctttctttatctgactgcctttaggaccaattccactcatttgctgagaagatcagaggtcaagggtacagtatgtaatcaacagagcactggcaacttatgctcacagttattaaattcatagttttggctcattactgagaccagttcgtccagatccatgtattacatatctatatgggtcattacatttctcctcatacttttgctacaatttgcatagcttactctgagtagccactgtacaaatgaaaagtaaacatacttaatttgcttaagaatatttaatggcaacttttctccaattaaatatagtatgagctatgactgtgtgaatatgaaaaattacacttacttctagagttttccatttcttgactaatcttatttaaaattttcgcccaggttgggcacggtggctcacgcctttaatcccagcaccttgggaggccaaggcgggtggattacttgaagtcaggagtttgagatcagcctggccaaaatggtaaaccctgcctctactaaaaataaaaaaattagccaggcgtggtggcagccgcctgtaatcccagctacctgggagggtgtggcaggaaaattgtttgaatctgggaggcagaggttgcagtgagccaagatcatacccctgcacccgagcctgggtgacagagcaagactctgtctcaaaaaaaaaaaaaaatatattggccgggcgcagtggctcacgcctgtcatcccagcactttgggcggccgaggcgggtggatcacgaggtcaggggttcgagaccagcctgaccaacatggtgaaaccccatctctactaaaaatacaaaaattagctgtgtgtggtggcgggcacctgtaattccagctactcaggtggctgaggcaggagaattgcttgaacctgggaggcggaggttgcagtgagccaagattgtgccactgcactccagcctgggcgacagagtgatactctgtctcaaaaaaaaaaaaaaaaaaaaaaaattatcccacctactaatgaatgagaagtaataaatataagtaattcttcttaccgtactttattttcttcctagattctgttgaaattcagtatatcaggaaaggagtatagagtcacctcttaaagttaatctggggttttctctgagctgatctgtagttttggttaccctggcatagcctgcttagggtagagagatcaataactcaaaaatgtgatgaaaaactaaatgcacttgcattagagaagcatgaatcactgtggaaaagagaattaacagtctccgagttttacagtggcatagaaacctaaagatcgtataaattatctctttttttaactctatttatttatttatttttattgttatactttaagttctggggtacatgtgcagaacatacagttttgttacataggtatagacatgccatggtgatttgctgcacccatcaacctgtcacttacattaggtatttctacattaggagaacatgtggtgtttggttttcggttcttgtgatagtttgctgagaatgatggtttccagcttcatccatgtccctgcaaaggacatgaactcatccttttttatggctgcatagtatctcatggtatatatgtgccacattttctttatccagtctatcattgatggacatttgggttggttccaagtctttgctattctaaatagtgctgcagtaaacatacgtgtgcatgtgtctttatagtagaatgatttataatcgtttgggtttatacccggtaatgggattgctgggtcaaatggtatttctggttctagatccttgaggaatcgccacactgtcttccaaagtggttgaactaatttacactcccaccaacagtataaaagcattcctatttctccacttcctctccagcatctgttgtttcctgactttttaataatcaccattctaactggcatgagatggtatctcattgtggttttgatttgcatttctctaatgaccagtgatgatgagcatttttacacgtttgttggctgcataaatgtcttcttttgagaaatgtctgttcatatccttcgcccactttttgatggggttgtttgttttttcttgcaaatttgtttaagttctttgtagattctggatattagccctttgtcagatggatacattgcaaaaattttctcctgttctgtaggttgcctgttcactctgatgatagtttcttttgctgtgcagaagctctttaatttaattagatctcatttgtcaattttggcttttgttgccattgcttctggtgttttagtcatgaagtctttgcccatgcctatgtcctgaatggtattgcctaggttttcttctaggatttttatggttttaggtcttacatttaagcctttaatccatcttgagttgattttttataaggtgtagggaaggggtccagtttcagttttctgcatatggctagccagttttcccaacaccatttattaaataggaaatctttttcccattgcttgtttgtgtcaggtttgtcaaagatcagatggttgtagatgtgtggtgttatttctgaggctctgttctattccattggcttatgtatctgttttggtaccagtaccatgctgttttggttactgtagccttgtagtatagtttgaagtaaattatctctcttaaaatatctaaggaaaaagccagagttagttgttttggtcaagactagaggtacactagtttgaatcaatgtcttctaactcaatgctttttttccttctgtgtatccttagcagaaaaagcaaaaactgctagaacacctccaggtttcccttcaaatgtccacttcttaacatggtttcttttttttatttatttcacttattttgggggaacagttagtgtttggttgcatggaaaagttctttagtggtgatttctgagattttggtacactgatcacctaagcaatgtacactctacccaatatgtagtgttttatccttcacccaactcatacccttctccctgagttcccaaagtccattatatcattcttacgcctttgcatcctcatagcttagctcctgcttataagtgagaacatatgatgtttgattttccattcctgagttacttcacttaaaataatggtctccaactccatccaggttgctgcaaatgacattatttcatgccttttatggctgagtagtattccacattttctttatccactcattggttgatgggcatttaggctggttccacatttttgcaattgtgaattgtgctgctataaacatccatgtgcaagtgtctttttcatataattacttcttttcctctgggtagatacctagtaataggattgctagatcaaacgatagttcttcttttagttacctaaggaatttctatgttttctgtagagattccactataaacatatttccttatttaaggaatctctatgttttccatagtggttgtgctagtttacattctcaccagcagtgtcaaagttttcccttttaaccccatcaacgccaacatctgttatttctttatttttaaattgtggccattcttacaggagtaaggtggtttctcattgtggttttgatttgcatttccctgatagtgatgttgaacatttttcatgcgtttgttggttatttgtatatcttcttttgagaattgtctattcatgtcctttgcccactttttggtgggattatttgttttgttcttgctgatttgtttgagttccttgtagattctggatatcagtcctttttcaaatgcatactttgcaaaaattttctcctactctgtgtgttgtctgttcactctgctgattatttcttttgctgtgcagaagctttttagtttaattaggtcccatttatttatctttgtttttgttgcatttactttttgattcttggtcatgaactctacctaagccaattggcatggcttcttattaacctctgatatattgtgtctctcgtgctctgctacctgcactcctattttctgttgctacttgcgtactccaagttcaagaagagtgtgtattgagcaggcaatggttgtgccgattctttattggattttatctatgtaactaagttataatcagggatcctttaatgctgataacatgtgagcagtatctcttattatgtttataagacacaggtttgtttttggtggcttatctctaatggatctgataaagaaactttccttatctcaataacgttaaaaaatcacaaaatgattttctgtttctgctttaactagagtggaaactaacaagctctatttttataaatattttcctaaaatctgtactagtcagtaccttccaaactttagatcaatgtcccagggaaatattttctttgtaaagaacttaagagattatatagaatcacaaattatagttttagccaactccagtagaatattttgctatctaaactactttttcatttaatttccttgtattcagttcttggtgcttccaacttttagttttcaagtctaatgagccactttacatttaaaatacttctattatattacattcatttaagcaatcggaacttggccatttgaaaaataaccagaattagtatagatgaaagagtatgtgattacctttttatttggggctatgtctcccaagcaaataaatcattttcttatattgttatatgctatatatgttcttaagggtagttttatcaatcttggctatttaggagcaaattatcacgagcctctctagctatcaatctgcctattagattacccatctcttctataatcacataataccaaccttcctagctcatggccacatatgggtaggagaggcatctgagaatttggaaatctagacaaaagaagaaccttcttcctggtgacagtgctatagcaagttaactattatggtttctcaagttaataatctttagagttttaaggcagaccacaaagtctgcctgcatggttttctccctttgttttgtaacaggagaaaattcagttgaattcagtgcaattttgttccccgtgtttccaaaatatacaattccattactaaaataacctagaggaaactataagtaagtaaataatcccttcttatataccataaacattggttaaatatatctctcaggaacacagataacttttgttatattttgtatttctgggtaattcatatttataaatatgatacacaagttagactttaacagacattcatggtttaaacacaattatttagactgtagaatattatgcttgtgtctgacagcttatcatatgcgttatgaatatatatatatagcattatgctggtatattacatttttaacatactcattagtttggagctaataaacttaagtagttccattttcaatatatgtaggatatacattagttagacttttcttgagccaatgttttaatattttaccctgttgattaggttgttttctgaaactatgattcctacaatgcctttgcccactcaaaaaataaaaagaaagaaagaaagaaagaaacctatttaaccatctcctatgtgtctggcattgtgctaaatactggaaagttaaaaataagtaaaacattgttcttgccctgaggagtattatacagtgatagaaataaccaggttatctggatatctaaatggaattttctgaatatatttatatacaaaatggcatgaatgcacagaagaacaggccatttcccccaggtaatatgagttcaccaggtagaatgagaaaggaagcatcataatagaccatgttggttgcatttaggaaacagcaaagtagacctgtgtggctggtgagggaaacatggagagaggaagagactgaaataatttcaagggaaaaaaaaagtttgttcatgtttctcttccatcagtgaacatttattaggctaagtgtcaggcattattctaggatctaaccaagatgaaggccatgagagatgaaggctgtggttccacggggtttaactgtgggctctgtgacaaaaattaaggcaaagtgatggagagtaatgagaaacagggaaggagcaggttttggtaattgagaaaatcaagttttctttgtgatgttaatgtggcacagctataagcattcaagaggagatgccagataggaagttgaatacgtggatctagagatcagggcaggacagaagctatagacataaataatgtgaatcaccagtatatgagtgctatttaaagccatgggattggatgaacacctagggagatggagggggatagaaaagagaatgtggcccatctctgaggagagaaagtagcccaggaccctgggatattccaagatttgagcttcaaagcaggagcaaagatagaatgaaagtattaagccttgtgtgcactaacttgtcttttaaaactccaggccagggtattctacgcatttcctcccaacagaaacaaattcatgcctgccccttctgcagttgcaaacaaatacagtcatacattactcaattacgaggatatgttatgagaaatatgtcattaggcaatttcatcattgtgcaaacatcatagagtatacttaaataaacctagttggcatagcctactacacacctaggctatatggtatagcctactgctcataggctataaacctgtacagcagattactgtactgaatactatggacaattgtaacacaacggtaagtatctgtacatctaaacatagaaaaggtacaggaaaacatacagtattataatctaatgggactcctgttgtatatgtgatttgtccttaaccaaaattttgttatgcagcacatgactatactccaaataagaattttcttagacgctgggcatggtggctcatacctataatcctagcattttgggaagccgaggcaagcagattgcttaagctcaggagttggagaccatcccacagaacatggcaaaaccctgtctctacaaaaaagaaaaaaaattgccaggcatggtggcatgcacctgtactttcagctactcgggaagctgaggtgggaggattgcttgatcccaggaagttgaggctgcagtcagctgagagggtgccactgcacttcatcctgggcaacagagtgagaccctgtctcaaaaaataaaaagaaaaagaattttcttggaaatttatatttaaaatgatggaagtcttataatctagtctataatgtcttgtttaatattagactatgtttaactaaattaccatcagaattaaaatgtttcctaccatgtttaatttatagcttcaagtatccacaaatatttctcacacattgctaaggggacccctactcctcctgaagaagaaagactcagccatggggagccatttagaggctttcagcatccttccattcttacttgtaatttcagatttgcatgacataattattttatatggtttgttagtatttgtgtggctgtccttcctctctccttgagaatggagttttctggttttgatgatgaagttctttctaagaaggtgagggcttatttgctacttcaatttctggcacaatgtaaagtcattttttttttccgataaaacttctatttacatttttagagatttgtgaagaagcatcttcaatatttaaatacaacacactaggaaaatctcaaatctattctatttgtgccctacttattaaagttatttcacaaaattttttgatagctataaatagaagaatcatcaacaaataataacaggagctgtacataatagatgttcagagaatgcccttgcagaaggctaaagctaaaaacactaaatttaaaaaaaaaaaaataccccaaatgtcttttataatgcctggttgttctggcagaaagtaaagaaattcctctgaggcaaaagcaaaaaaaaagctccaatgcaaaggactaagtgaaagttggagccatcatttgctttagtggcctctctcaatcccctgttgcctagaggagtttaaaagacacattcactgacaataaggaaatcttgagtccaaagaatagtggtaacacaattaaattgggtgtagttccagatgcttgggggtctgagatgggaggatcgcttgagcctgggagatggaggtcacggtgagccaagatcgcgccactccacttcagcctgggtgacagagggaggccccatctcaaaaaaacaaacaaaaagaaacaaagccagtgttgacaccatcagggatgaagaaaaagcatacccgctttgcagtgggagaccttggagaaaactcttggctcaccctcgagtctgggtggagaagaataaaagaaaggactgtactaagaacgtctaacctcaggtctaaagttatattatcatacgacaggaaaaaaaaaatccaaaagccaaaaatgctatttaatttttccagtttgaccatgtacccagctacctggaggcagaaaatgaaaatcctattggaaagaaagcactttgtatgcagccatctaagaattccaacagatgaaggtccgaaaacatgagttcccaataaaaatttcactgaatacataaggaaacaaatgaccatgagtaagaggcaggaagggaaaagaaccccgctgaatctgatctacataaactcccaatattagaactatcagatacagaatataaaataaatgtattatattttgaaagaacagattctagaaatattgaactgtggtattttaaaaatagatcttctagaaatgaaaaatgtaataattaaaggttgtatttaattacataattataattaaaattcagagtaaatacaatgaagagaaaactgacaaaatagaaggtatactttaaaaaacaattttggctgggcttggtggctcacacctgtaatcctaacagaataccagcctgggtaacataggaagaccccatctctacaaaaaaaaaaatttaaattagctaagcatcatggcacacacctgtagtcccagctactcaggaggctgaggtgagaggattgcttgagtccaagaggtggaggctgcagtgaaccatgatcttgccactgcactccagcctgggtgacagagcaagatcctgtgtcaaaaaaataaaaaataaataaaatgtattatggcaacataacacgtgatctagcctcttaacacatttttaagtatacaatacaatattattaactatagacacaacatgtacagcagatctagaaaattcgttcatcttgcataactgaaatgttacactcgttacatagtaactcgccatttgtctctcccctcaatcccaagcaaccagaattctactctctgttttatgagcttgaccattttagatatctcatataagtggaatcatatggtattcttccttctgtgactaccttatttcacttagcataatgtcctcaagtttcatccatgtcgtggcacattacaggtgatatctcattgtggttttgattggaatgtccctgatgattagtgatgctgaccatcttttaatattttaatatacctactggatatttgtatgtctccttcggagtcgtgtctattcaaattcttagcccatttttaatcagattattaggtttttttgctattaaaccgtaggtgttccttacctactttggaaaatcccttcccagctatatgggattcacacatattttctcccattccacaggttgccttttcactccattaatagcctcctttgctgtgcagaagccttttagtttgatgtagtcccacttgtctatttttgttttcgttacctgtgcttttgttgtcatttccattaaatcattgctgaggccaatgtcatgaatctttccctgttttcttctaggaaatttatagtttcaggtcttatgtttaaattattgattcattttgagttgacatttttgtacagtgtatgttaagggtccaatttcattttgcatgtggctatctaattttgccaacaccatttgttgaagagatggtcccttccccattgtgtaccttagtacctttgttgaagatcagctaattgtgtatgcatgggttcatttctgggctttcagttctgtaccatttgtctatatgtctgtctttatgccagcaccattctgttttaattactgtagatttttaatatattttgaaatcaggaagtatgatgcctccagctttgttctttcttctgaaaatattttggctatttaggatccttcatgattccatgtgaattatagagttgtatcttctacttctgtaaaaaatttcattggaattttgatgaggattgcattgaatctgtagattactgggcagtatgaacactttaacaatattaagtcttcctatttgttaacatggaataaattttccatttatttgtgtcttctttaatttctttcattaatgtctttaattttcagtgtgcaaatccttcacctcttaagtttattcttaagtattttattcttttggatgctattgtaaatgggataaattttctaatttccttttgcagtagtttgttagtgtatagaaacacaacttattttcatatgttgattttataccctgcagctttactaaattcacttattagtttaccttttttttcttaaagtttttaggattttctaagggtgtgttaggtaacgtcatctgcagaggaggataactttactttttcctttatgatgtagatgccttttttttcttgcctaattgctctggctagaacttccattactttattgaatagaagtagtaagagtgatcattcttgtcttcctcctgatcttagaagaaaagttttcaagttttcaccattgagtatgatgttagccatgagcttgtcatatatggcctttattatgttgaggtaattttcctctatttctagtttgctgagagtttttatcatgaaggtttcaattttataattacattttctgcatctattgagatgagcatgtgatttttagccttcattctgctgatgtggtgtatcacattaatttatttttgtatgctccaccatccttgcaccctagggataaatttcacttggtcatggtgtgtgatccttttagtgtggtgttgaattcagttcgctagtattttgtcgggggttgttttatctatgttcatcaataatatgggcccgcaattttctttccttgtagtgttcttatgtggctttggtatgaagataatgctggtctcataaaatgagtttggaaatgttctcacttcctcagttttttggaagtgtttgagggggttagaattaattcttttttaaatttttggttgaatttaccagtgaaccatctggtcctgagcttttgttaagaggtttttgattactaattcaatttccttactagttatgtctatgccagttttttgtttgtttgtttgtttgtttttgagacggagctcgctctgtcacccaggctgaagtgcagtggcgtgatcttggctcactgcaagctctgcctttcgggttcacgccattgtcttgcctcagcctcccaagtaactgggactacaggcacccgccactgcacccaggttattttttgtatttttagtagagatggggtttcaccatggtctcgatctcctgacctcacgatccgcccacctcggcctcccaaagtgttgggattacaggcgtgagccactgcgcctggcctctatgcgagttttctatttcttcatcacccagtcttggtaagctgtatgtttctaggaatgtatccatttcatctaggttatccaatttgttggcatacagtagtctcttacaatctattcatagtagtcccttatgatccttttttcctgtggcagcaggtgtaagtaatgactccttttttatttctgattgtctttgagtcttctcttttttttcttagtctagctaaaggtgtgtcaattttgtcttttgcttcgaaaactaattcttaatctcattgattttttttcctattgttttgctattctctattctatttatttctgttctaatctttatttccttctttctgccaacttttagacttagtttcttcttaatgtaggcatttatccctataaatttctctcttagcactgtttttgctgcattccatagttttggtgtattgtattttcatttttgttggttgcaagatattttctgatttcccttctggttttttcttttactcactggttgttcaaaagcatgtagtttaatttctacatatttgtgaattttcaaatttttcttctgctatggatttctagtttcatttcattatggttggaaaagacagtcttcctaaatttactaagacttggccaaacacagtggatcatacctgcagtcctactgctttaggaggccaaggtggaaggattacatgaggccagtagttcaatactagcctaggcaacatagcaagactctgtttctacaaaaaaatttttttatgagatgtgcgtggtgacacaagcctgtagtcctagatacttgggaggctgaggcaggaggattatttgagccccagagttccagtttatagtgagctatgatggcactccacatctttggtgtcacaaggatgtcacagccttgtcacagcttcggtgagagagtgaaaccctgtttaaaaaaaacaaatatactgacctttgttttgtgacctaacatgtggtctctcctgaagaatattttatttgtactagagaagaatgtgtattctgctgctattgttctgtataagtatttggttcatttgttgtaaaaggttgctcaaattcactgtatctttgtagattttctgtctggttgttctattactattgccattttgacaatcattttctgtatgtcttatggttcatttgtccctcttttcctctcttactgtctttcttgtgttttgttgatttttaaaaaattaatatgttttgattccattctatttttcttgtgtgtatttttcttctgtaggtattttctttgtggttaccatgaggtttacataaaatatttaacattgtaacagtctgttttaagctgatagcaaccttacttcaatcacacataagacctctacacttttacttcttctcccctcacaatttatgttatggatgtcacaatttttatctatttatattgtatatccattaacatattttcagttatagtaaatttaatagtgttgtattttaacttttatgcttcaaatacaatgatttaaccactaatgttacagtaataacagtattctctatttgactatatatttacctttaccagtgatttttctactttcttatgataatgtgttactgtttagtgtcctttgttataagttggagaactctttagtatttcttgtaaggcaggtaagcggtgataaactctcagctctgtatgtcctgaaaagtctttatctcttctacatttttgaagaacagttttgaccagcataatcttcttagttggcagcattttttcttttagcactttgaatatatcatcccactcccttctgaattgcaagtattctgctgaaaaacccattgaaaatcttctcaaagctcccttgtatgtgacaagtttcttttctcttcctgctttcaaaattctttttctctgacttttgaccatttgattataacgtgcctttgtgtatatttatttgggtttatcttattgagagtcctctggatttcctggatctggatgtcatttacttcctcacatttgagaatctttcaaccattattcatttgaataagctttccgattctttctccttcatctttatctggaacctccatgatgctcatagtgtgtacttgactggataatttcagatgacttggctttgactttactgattcttctgcttgctcttatctgctgtcaaacaccaacctaatgaattttttagtttagttaatgtattctttttttattattattatactttaagctttagggtacatgtgcacaaggtgcaggtttgttacatatgtatacatgtgccatgttggtgtgctgcacccattaactcgtcatttagcattaggtatatctcctaatgctatccctcccccctccccccaccccacaaccatccccagtgtgtgatgttccccttcctgtgtccatgtgttctcattgttcaactcccacctatgagtgagaacatgcagtgtttggtttttggtccttgagatagtttgctcagaatgatggtttccagcttcatccatgtccctacaaaggacatgaattcatcattttttatggctgcatagtattccatggtgtatatgtgccacattttcttaatccagtctatcattgttggacatttgggttggttccaagtctttgctattgtgaatagtgccgtaataaacatacgtgtgcatgtgtctttatagcagcatgatttataagcctttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctccagcacctgttgtttcctgactttttaatgatcaccattctaattggtgtgagatggtatctcattgtggttttgattggcatttctgtgatggccagtgatgatgagcattttttcatgtgtttttttggctgcataaatatcttcttttgagaagtgtctgttcatatccttcgcccacttttcgatggggttgttttttttttcttgtaagtttgtttgagttcactgtagattctggatattagccctttgtcagatgagtaggttgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttccccatgcctatgtcctgaatggtattgcctaggttttcttctagggtttttatggttttaggtctaacatgtaagtttttaatccatgttgaattaatttttgtataaggtgtaaggaagggatccagtttcagttttctgcatatggctagccagttttcccaacaccatttattaaatagggaatcctttccccatttcttctttttgtcaggtttgtcaaagatcagatagttgtagatgtgtggtattatttctgagggctctgttctgttccatcggtctatatccctgttttggtaccagtaccatgctgttttggttactgtagccttgtagtatagtttgaagttaggtagcgtgatgcctccagctttgttcttttggcttaggattgacttggcaatgtgggctcttttttggttccatatgaactttaaagtagtttttttccaattctgtgaagaaagtcattggtagcttgatggggatggcactgaatctataaattaccttgggtagtatggccattttcatgatattgattcttcctacctatgaacatggaatgttcttccattggtttgtatcctcttttatttcattgagcagtggtttgtagttctccttgaagaagtccttcacatcccttgtaagttggattcctaggtattctattccctttgaagcaattgtgaatgggagttcactcatgatttggctctctgtttgtctgttattggtgtataagaatgcttgtgatttttgcacattgattttgtatcctgagacttttctgaagttgcttatcagcttaaggagatttagggctgagacgatggggttttctagatacacaatcatgtcatctgcaaacagggagaatttgacttcctcttttcctaattgaatgccctttattcccttctcctgcctgattgccctggccagaacttccaacactatgttgaataggagtggtgagagagggcatccctgtcttgtgccagttttcaaagggagtgcttctagtttttctccattcagtatgatattggctgtgggtttgtcatagatagctcttattattttgagatacatcccatcaatacctaatttattgagagttttgggcatgagggttgttgaattttttcaaaggcctcttctgcatctgttgagataatcatgtggattttgtctttggttctgtttatatgctggattacgtttattgatttgcatatgttgaaccagccttgcatcccaggaatgaagcccacttgatcatggtggataagctttttgatgtgttgctggattcggtttgccagtattttattgaggatttttgcatcaatgttcatcaaggatattggtctaaaactctctttttttgttgtgtctctgcctggctttggtatcaggatgatgctggcctcataaaatgagttagggaagattccctctttttctattgattggaatagtttcagaaggaatggtaccagctcctccttgtacctctggtagaatttggctgtgaatccatctggtcctggactgtttttggttagtaagctcttaattattgccccaatttcagagcctgttattggtctattcagagattcaacttcttcctgatttagtcttgggagactgtatgtgtcgaggaatttatccatttcttctagattttctagtttatttgcatagaggtgtttatagtattctctgatggtagtttgtatttctgtgggatcggtggtgatatcacctttgtcattttttattgcgtctatttgattcttctctcttttcttctttattagtctggctagcggtctatcaattttgttgatcctttcaaaaaaccagctcctggattcattgatttttttgaagggttttttgtgtctctatttccttcagttccgctctgatcttagttatttcttgccttctgctagcttttgaatgtgtttgctcttgcttctctagttcttttaattgtgacgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatttacccagtagtcattcaggagcaggttgttcagtttccatgtagttgagcggttttgagtgagtttcttactcctgagttctagtttgattgcactgtggtctgagagacagtttgttataatttctgtcttttacatttactgaggagtgctttacttccaactatgtggtcaattttggaataggtgtggtgtggtgctgacaagaatgtatattctgttgatgtggggtggagagttctgtagatgtctattaggtctgactggtgcagagctgagttcaattcctggatacccttgttaactttctgtctcattgatctgtctcatgttgacagtagggtgttaaagtctcccattattattgtgtgggagtctaagtctctttgtaggtcactaaggacttgctttatgaatctgagtgctcctgtattgggtgcatatatatttaggatagttagctcttcttgttgaattgatccctttaacattatgtaatggccttctttgtctcttttgatctttgttagtttaaagtctgttttatcagagactaggattgtaacccctgcctttttttgttttccatttgcttggtagatcttcctccctccctttattttgagcctatgtgtgtctctgcacatgagatggttttcctgaatacagcacactgatgagtcttgactctttatccaatttgccagtctgtgccttttaattggagcatttagcccatttacatttaaggttagtattgttatgtgtgaatttgatcctgtcattatgatgttagctggttattttgctcattagttgatgcagtttcttcctagccttgacggtctttacaatttggcctgtttttgcagtggctggtaccagttgttcctttccatgtttagtgcttccttcaggagctcttttagggcaggcctggtggtgacaaaatctctcagcatttgcttgtctgtaaagtattttatatctcctgcacttatgaagcttagtttggctggatatgaaattctgggttgaaaattcttttctttaataatgttgaatattggcccccactcccttctggcttgtagagtttctgccgagagattatctgttagtctgatgggtttccctttgtgggtgacctgaccttcctctctggctgcccttaacattttttccttcatttcagttttggtgaatctgacaattatgtgtcttggagttgctcttctcgaggagtatctttgtggcattctgtgtatttcttgaatttgaatgttggtctgccttgctagattggggaagttctcctggataatatcctgcagagtgttttccaacttggttccattctccccgtcaatttcaggtacaccaattagacgtagatttcgtctttccacatagtcccatatttcttggaggctttgttcatttctttttattcttttttctctaaacttctcttcacacttcatttcattcattttgtcttccatcactgataccctttcttccagttgattgcatcagttactgaggcttgtgcattcgtcacgtagttctcatgccatggttttcagctccatcaggtcctttaaggacttctctgcattgactattctagttatccattgatctaattttttttcaaagtttttaacttctttgccattggtttgaacttccttctttagcttggagtagtttgatcttctgaagccttcctctctcaactcgtcaaagtcattccccgtccagctttgttccgttgctggtgaggagctgcgttcctttggaggaggagaggcactctgatttttagtgtttcccgtttttctgctctgttttttccccatctttgtgattttatctaccttttgtctttgatgatggtgacgtactgatgggtttttggtatggatgtcctttctgtttgttagttttctttctaacagacaggaccctcagctgcaggtctgttggagtttactggaggtccactccagaccctgtttgcctgggtatcagcagcggtggctgcagaacagcggatattggtgaaccgcaaatgctgctgcctgatcgctcctctggaagttttgtctcagaggagtacccggccatgggaggtgtcagtccgcccctactgggggatgcctcccagttaggctactcgggggtcagggacccacttgaggaggcagtctgtccgttctcagatctcaagctgcatgctgggagaaccactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttcgagcttcctggccactttgtttacctactcaagcctgagcaatggcgggtgcccctcccccagcctcactgctgccttacagtttgatctcagactgctgtgctagcaatgagcgaggctccatgggtgtaggaccctcagagccttgtgcaggatataatctcctggtgtgccgtttgtgaagcctgttggaaaagtgcagtattagggtgggagtaacccaattttccagtttccgtctgtcacccctttctttgactaggaaagggaattccctgaccccttgtgcttcccgggtgaggcgatgcctcgccttgcttccgctcatgcatggtgcactgcacccactgtcctgcacccactgtccggcactcccctgtgagatgaacccagtacctctgttggaaatgcagaaatcacccgtcttctgcgtcgctcacactgggagctgtagactggagctgtttctattcagccatcttagctccacaccctcagttattgtattcttcagctccaagatttctgtttggttttttccttaattttttatatctttacttaaattctcactttgtttatgtactgttctactgagctcactgagcattttggtgacagttattttgaattatctgtcagataattcatatatctctgtttcattaggattggtttctcgaattttatcttgtttcttagtttgaatcatgtttctgtttcttcattttccttgactctgttgatatctataaagtagaaaaaactaccactttgcccagtcttcatggacaagactgctacagaagaagatcctagcatgacatcaacccagctaaaacctctgttggcctctcaaatctttgtgctactccaaactgccatctttgtttttagtggcccacaggtgtccagagtatatcagatctcattagtgttttaagacaggtgacagataagacagtccctcagcacccagagaggtcagaagttgactatgcacccaactctttccttcctcagggagctgggagctggaattttttctgcagattctgtgctgtgctaggagaaggagctatgggaagtttgtgcatactagtttcaaccatctcctttgttctcagtagccctcaggcatgtagaattatctaggtcccatcagcattctgagacaaatgagacagaagccagttccttaggcaaccctcagaaaagttggaacatttgacacacaatccaactgcttccctccacagggaaaaactaggagctgactttttacccacctgctctgcattgagccagggggcagagctacggcaagtgttcatgggctagttcaaaccactgccttttttctctggagtcatcaaaggctgagcatttgctggaccccaacagtactgcagtacaggtgagacaaaagccagtcctttaggtagcaccgtagaggttgtaatgttcgacatgtggttcaactcttttctctccagggaaaagctgagaagtgggttttcgtttttgttttatctgcttactctatgctggaccaggcagaggagttgtaatgagtgcctgcttgctgattcaaactgccacctttgttctctgtagccccaggtgtctggcataaggcaggtcccatcagcactctgagacaagtggaatagaagcttttcctttgggcagcacccagaaaagttgaaatattggatgtgtggttcaaatctgcccctcctcctgaagaaactgggagctaggagacatctctcaatcagatagtgctgtgctgggggtaggggttatagaagaggtttgcctccaattttcccaccagttttaatttggctggttttacacttccaaagggtgcaggagcctctaaactagttcctggaattttacaaagggaattaattcatttattgctgttgaatcaatgtatccatgaagctaagaaaagtccattgcttcctatactgtcatcttactgatattactccaagataaacttttaaatttttctttctttccatttttttcttttctctttttgcaagacagagtctcattctgtttcccaggctggagtgcagtggtgcaatcatagctcactacagctttgaactcctgggctcaagaaatcctcctgcttcagcctcctgagtagctaggactacaggtacacaccaccacaaatggctaagttttaatttttttgtagagatagtgtctcactgtgttgcccagacttgtctcaaactcctggcctctagcgatccttccaccttggcctcccagtgaaatttcttataatgtagcatttagagacaaagtgatcagaagtataaaagaggggttaaaggaaataagcaatagagtgagaggtccaacagaggtctaactagatggccagaaggagaccatacagaaaccaagaaagaggcattatttgaaagataatggctgagactatatcagaattgataaaaaaaaaagagatattaatatccaaagccaagaactccatcaattcccaaacaaaatacattgaaaaaaatgaataaaacaataaaaccctacacttagacataaaatagtaagaactaatgatttaattttatgtctatacgtaggtttatcatcaaacagcaggtaatagattggtatacaatagtaatacaaataatacaagtaatacaaataatcaattttaatctttggataattcattaatatataatcagtttccaactctattataattaagccaaatacatttgagagaagtgtgttttataaccatatcttgcttcttgaagaaacccaaaagttaaaagtctcagggtcaaatctgatagttgtaacctattttcccactgtgagggggagaaggaagaaatattagtggtaatttgttcagtttttgctaaaagtgttttcaactcactttcatttgcacattatcagtcaaaggaaaggttgcgaaaaggggaaaaactatttagagaacactatgcaaatggacagtagaaaatagaattctagatgatcattgttttatattcagaacatgtatatggatcactaaaagcttgtctctgtgggatgcaatgagtattcaagttggttgggtgactttgtacccttgttaatatttttaagggtatttctacaattatcattttttgaatattcacaaaagtagatagtatatctactaaacaaatcactctatctgtgagcatacctaatgagaccaattgaagggaacattgtggcatcatcaagagaataagaacttcccttaattgataattcccaattactgaagataatatgaagcttgcttctttttgaattatccagctaaacagctagaaattctaaaaactgtgcagataattatgtaatcctcttctctatcagtactttagaagtgaacaaaacattgcgagttttgtttgtttgtgaaaacttcattgggaaaaaatatggtttgaaaagtacaattatacttagtgggtcatttatatatttacgactttatccagctgaagttaatgcacttcacattggatatcctaatgttagctttcctctttccatttgttcttaagtaatctcagcatttctccaggtatcagccttaattgcttattgaaatcagaaaaagaagagaatagggttaatttaaaaaaaaaagaactctttctttacaacttaatatctgattaaatggatactatgtttaatgatttctcattttgaagtacatgatttgggaagtcacatttctgcttcagtgatctatgttgccaaatggtgagtgaacggttaagtccagcctagtatggattcactcagatgaagattatatttgcactgtgttgaatgcttaactaaatgccatcagttaccagatgagagaaacatgaactgtgactgcagcaatgaccctgaagaggcattattgcccatcattagaaagtagaagaaaaataaagtgagtgttgaagataaaatggggaactataacacagagggacagatagtagagaggtgaaaaatatttatttagaaaataacaaaaataatagaatattatttttcttattatttcaccatcttttaacttagtgtacagaatcctggttaggaagtacttccccagctttattttttatgactgttacagaaaaacaaaataggaaaatattactctatttcacttatttttttagagatgaggttctactccattgcccaggctggagtacagtggtgtgaccatagcttattgcagccttgtactcctgggctcaagcaattctcctgcctcagccacccaaggagttaggactaaaggcacataccaccacacccagctaattatttttattttttgtagagatgggggtctcactatgttgcccaggctagccccaaactcctagcctcaagcaatgctcccacctcagcctcctaaaagtgctagagttataagcatgaaccaccacacccatctattctattttaataataaaagccaagttccagaggacagataactagagaagcagtaacttaatgtggatatgctacatttaagattggtcaaaaaattagagaagaagaaataaataagtttgtcctgcatgtattaggtaaacataaataataataagcatgattattttcaggctattgtttagatgtttatacccaggttctcaataatctgttacatttgtgggatccatggaggggcagtgtgtgttgcctaacaaatgcggtcaagtaggttcaaggatcactaagtccttcaaagctcaaatgataagggccattcttgggcagccaccaccacagatgcctaggctatgcttagaacactgatactctagcaaacctttgaagaatgttgagaaaagggaatgacatgattaaatttacactatcaaggtaactctggaagcagtttgaaagattgggggtggagatgaagaatacaggcagagaggaggtgtccctaataaagcctgtcagaaagaaggactgcagcctgggcaacctggtgaaaccccatctctacagaaatacaaaatttaactgggcatcatggtgcatgcctgtaatcccagctactcaggaggctgcagtgggagcatcacttgagcctgggatgtcaaggctgtagtgagcccaagatcacgccactgcactccagcctgggaaacagaatgagactctgtcttgaaaaaaaaaaaaaagaaagaaagaaagaaagaagcactagcttttcaaacatattagcagccattgacaaagcagaaccaagcatactcaatttatatactcagctcaggcctgaattcgggagcgagcgctggggcagaagaagagaaacaagaaggaagcagagctgacgtctttagaaaacagtgggttgtgggaggtgaacaaggagaaggggtctagatttcctgggcggctggggcaggcatgtgagtagcgagccgttcacagagctgtggaagaggaggtgcctatttggaggaaggcactagaaatagtcaagggcatattgagcttgaggaatctgaagaacactcacatagatgtcccggaaccagctggatatagatggagctgaagtgcaagggttcttggctgcatatgtaaatttggaagttatcagcttatttgagctttgcataaggataaaatcatccagaaaacatgtcgagggcttaggtctagcacttggcatttgagatggtcttactctagctgctacatgttggaagagacagcgatgcactggagcaacttatgatacaggaattggctagaaggatggaatggagagatgaagtctattccaataggaatgtgctgtgtggaggctttgactcctctgaacttccagagcagagctgagaccaactgggggaacttcatggagggaacttcaagcttagtatacaggagaccaaatgaatgactagagtgccacagcacacagacactgccctaggaagtaggtaggttcccagtgggaggacacagggaagtggaggttaaaacagggtttctgtagtaggtggggagcataattgggtggatttcactgcttctttcaactctccgatctggggatacattgtgtactgcagtagaacaaaatgcagcaaaattccaggataacagaaaataattggactgtctctataaagaaggtgcttaaaaaaaaaattaggccaggcatggtggctcatgcctgtaaccccagcactttgggaggcccaggcaggtggatcacctgaagtcaggagtttgagaccagcttgacttgaccaacatggtgaaacaccatctctactaaaaatacaaatattagccaggtgttgtggcacatgcctgtaatcccagttactcaggaggctgaggcaggagaattgcttgaacccgggaggtgaatgttgcagtgagctgagatcgtgtcactgcactccagcctgggaaacagagtgagtaagactctgtctcaaacaacaacaacaacaaaaaccaacaacaaaaaaaaacacctaactttaaaacgtgcttttggtgttgcagacattttcattttctgtccatattaacctctattacccccttcctctctgattctttcccttctcttcatatggttctccttaagaatgtgtcagtaacaaactgttttttgttacataaaaaatgtcaaagaaaccaaacataaaagggcagagaaaggagaggcaggtcatatgatatttccttgaggttcaatgtcttgtttctttttttgctttctgttcttatattctggaattcttcttcttcttcttcttcctcttcctcttcttcttcttcttttttttttttttttttgagatagagtcttgctttgtcacccagatttgagtgcagtggcctgcacactcagtgcagcctttacctcccgggatcaagtgatcccccacctcagccccctaagtagctgacactacaggttgcatcaacatgcttggctaatttttgtatttcttgtaaagatggggttttgccatgttgtccagattggccttgaactcctgagctcaggcaatccgcctgccttggtctccaaaagtgctgagattacagacatgagtcaccatgcccagcctgggattcttatttcatctcatgtaatacctagcaccctccataccttcctctatgctctacatgataaaacctcttgcaggatcaagaaagctgagaaagtccttctgttccccctaaatacacacacacacacacacacacacacacacacacacacacacacaccccttcctcacatgctcactacagcctcaaattccaaaatgggcacttcattccctaaatgaaggcagtcctccctgcaaaaacagaaaccatcctgaaagacgtatcattccaaattataattggttttctatgccttgtatgaatgaattttacaactctttaagagctatttctgggttttctgtctctcaggctggagtgcagtggcaccatcataactgtttttactacatattttgagtttattctttccagttttctttttcctttccttaattgctgtagcagtgattcatttcagtgactgatatgttatctatgtttactgagcaatttaggtcctcaatctgatcattttatgtttatatcgtcccttccatggcttcccaagtaacctgaaaatgctagttctgtctccaaatctaaaagcattttatctttttttttttttttgagatggagtcttgctctgttgcccaggctggagtgcaatggcgggatctcagctcactgctacctctgcctcctggcttcaagcgattctcctgcctcaacctcccaagtagctgggattacaggcgcctgccaccatgcctggctaatttttgtatttttagtagagattgggtttcaccatgttggtcaggctggtcttgaactcctgacctcaagtaatccacctgcctcggcctcccaaagtgctaggattacaggcatgagccacgactcccagccttaatctatttttattgtgcttatcaatgaaccttaattttttttttcaaattctgagaggtcattactgaagatagcctaaactgtaacagaagcctgagaatttttctgtgattccaggcatctggagccattttgcaagaggaatcacttggggggagtagggcctctgagggcctgatgaacaacctgtgggacctaatctgtgtattggtttcattgagacccaaggcagatattgggctgccttcggtcactcccaagctggcatggccaactcatgagtcacaccaggccatggggttattttcctgctggctattctaaagattgatacacagcgtttatgccatgtttaatactgaacgctcagtatctagtgcttggagaacttactgatattatacagagtggagagaggcgcagggccccatagcctggcagtgtggcttttttgggatataagcagacatctttgcattgtggccatgaagaaaagacatttatccttggcattcgtggtctgtgccactctctggagcatagctatctaatccttttgtttctggcatgtagagtctgagagcaggaagatgccctgctcctgcctctctatgattccagaaatcacatccacttccatgtgcacagattctctctttcaattgcacagcaactccatttatgatgaggaaaccacagcttggaaaagatgagtgccttacctcagggtctcaaaaatgccagagttgcaacccacagtcaggattctctgtctccaaagtccatgctctgctctgtcctaaccaataaaataaaaataaaaggctgttctcttttttatgctaagagaattctagaaaaacaggtacagatgcatacattcttatgagttcagagattgttttaaaagaaaaagatgctgttatactttcagatctaagaagttaaactgctaattttttatttccatctttttttttttttttttgagatggagcctcattctattgcccaggctagtgtgcgacagtgcaatcttggctcactgcaactgccagctcccaggttcaagcagttctcctgcctcagcctcccaagtagcagggattacaggcatgcaccaccatgcctggctaatttttgtatttttagtagagacagggttttaccgtgttggtcaggctggtcttgaacccctgacctcaggtgatccactgacctcagcctcccaaagtgctgagattacaggtgtgagccactgtgcctggcctatttccaatttttattttaagttcagggttacatgtgcaggatgtgcaggtttgttaccaggtaaaggtgtgccatggtgattagctgcacagatcatcccatcacccagttactaagccctgcatacattagctattcttcctgatgctctccctcctcccactctccaccctcaaacaggccccagtgtgtgttgttacctaccgtgtgttctcatcattcagctcccacttgtaagtgaaaacatatggtattttactttttgttcctgtgttagtttgctgaggataatgacttccagctccatctatgtccctgcaaaggacatgatctcattcctttttatggtgccatagtattctatggtgtatacataccacattttctttatccagtctaccattggtgggcatttgggttgacttcatgtctttgctattatgaatagtgctgcagtgaacacacccgtgtgtgtatctttgtgatacaatgattcatattcctctggatgtataactggtaacaggattgctggatcaaatagtatttctgcctcttagggctttggagaattgccataccatcttccaaaatggttcagctaattgataattgatattcccatcaacagcaggaaatgtgttcctttttctccacaatgtggccagcatctcttgttttttgacttctttataatagccattctgactggtgtgagatggtatcgcactgtgcttttgatttgcatttctctaatgatcagtggtgttgagcttttttttcatatcgttgttggctgcataaatgtcttcttttgagaaatgtctgtccatgtcctttgcctactttttaatggggttgtttctttcttgtaaatttattaaagttccttaaagatgctggatattagacctctgtcagatgggtagattgcaaacattttctctcattctgtaggttgtctgtaaaactaccatttaaaactagtaataaaaacactttttaaaggagattcaggtgtaaagtaccatagaggttaagagaagactcattattcagggaaggatttcacccagtgatttgaactgggccttggggtttggaggactggccgcaagtgcagagggtaaagccgtgatggagcagtgccctggtgaccttgggaagtcaggtacctggagaaagaacgtgcagctgagaggggaggacatgtttccacttcatgtccctaacatagatgggcagctttccaggatttctccccagcaaagataaaatccattagctttacacggcacacttttctcttgagtgagaattattatcccattgtgcgttcaccagcaatgctgatgtgtgggcaaatacttgggccctaatcttggcattctctccaagcagctgtgtgaccattcatctttctgaacttgtgtcttctcttatacaatgaaggggcgctgatgtctaaatttcttttggcagcattcttgttccatgagacagtgatctggtgctgaggcatttcaggttcttcttgcatatggagatatgcaagagtaaaataataaaatagagacacacagagagagacagatgagagagagagagacaaatgaaaaggctgaatccaggccttctgtggcccgtctgttcttcctgcctgtgtcctatgggcaatgcccccacatccttcaaatcctccttctgtttaaaccagcgcaagtggttcttacaaccaaaggatccctcgttaaaacaccctgatttccaagaccttcttttcctgtctgatttccgtttaaggtttctcatgggtgtgttggatctggtaacgtcttagcatggcgagggatgaaatcaggtcccttctgtgggagacggctgctggcagagcaggacctttcaaacctgacgatacaggagacttgtgttaacgcacttcaccctccattactggattgattcacaaaaggattcatcaagtagccacaatgtgcagggattatgggaaaagacaactatgaaagatgaatgagcaaagaaaacaaacactgaaatagagagaagcagagatattctgtgatgtgtaactgaggtttacagtagaggctcagcatcagggaaatgggagaacagtgatcacctatgcccccatggagggccatttgaagctattatagggccatgaggcagttctgagcaccagagttagggttaggtaatttctgtccacgctctcctggtacactgtctctgtataagcagaatgaaagtctccatttcccttagaaaataaatgggataatgccatccacccattaatggtattgtattgccataaaaaggaaatatgatcagccaatttaaatacaagtaaggtatctgattagtctcattccttcgaagttctgaaacatgcttcctgtgaaagctctatggtcgatcttgcataagacattatccattccataatgcaacattttctgtacccagaaaatggtttgtttgcaaaagggagggccacccctgatgatggttgtgataacttttgggatgatggcaaagcacacgtctgcatccccatcactcacagtcatggcactgtagcaaaatttgcatccccaaggccacgcacaactgaattgaaacactggtgtaacagtttcttctgaaaatttagaactggatctgagaggcactgggagttgttgttggtccttaaaccacaacatcctggcacatccaagactggcccagtgcataatcagagaaggatggcttacagggagaaataaagagacacacagagagagacagatgagacagacagagacaaatgaaaaggctgaatccaggccttctgtggcccttctgttcttccggcctgtgtcctgtgggcagtgcccccacatccttcaaatccttcttctatttaaaccagtgttgagtggcttccaagaccttcttttcctttctcatttctgtttaaggtttcttgtacgtgtattggatctggtgatatcttagcatggtgagggatgaaatcaggtcccttctgttggagatggctgctggctgagcaggaccttccagagcttgatgatactggctgtaagctgtttggttgtttatacggcattcctgggtcagtgtttgtccttggttttatttaagaagacggaacaagaagaagggaccctctgtccttggcgtgactagtattgttcaatggcacatctgttttcctaagccattaatggatccttccggaaacagccaatctttcctcaagcattaggtcagcaatcctgattagaatcagcatcaaccacccatgaaactagaagctccccttgtgatttattattacaataaaacctcactaattaaccataattaggaaaaaaagcctgtctccattttaagattcaaaaagaagcaacattttaattccttccaactttgcatagtcatttaaattacactaataagtatatttgacttgatgtgtaaataaaaattatttctaaatagcacatcaacttaatatatgcattttggtatgtaaagtgtctttaagaaacagcttgttctttcaagcattctacttatactcttacaatattaatagtttagtaagtgttttttcagattgaaaacacaatgattaacttaatcttaacgtttgtcaaaattatttttaaacaagtagggccagaattactgagattattgtacttttgaatcaatatgacaatatttagggaaatgaatgataggagttaacgtgtcacacaaacctattctgaagctttctacatcttactgagggttttacattgcactgaaaatgaagctgatttatttaagagtctgatggaatgattgtgttgtagatgagctgaaaatcttttctcctgcatgtttgataatgctgtgatttttacaccatggttccagtttacaaagagacaagggtaaaaacaaataagcctgcagtaggatgtttggtgccccaaatcatttcttctgatgtttacttgctgtttataaagcctgaagaaaacgtgccaggaagccaagactggttttatgaatagagatgtcttaaatggctacgctaatgtcaagcctgcaggaatgtctcatcaggacacccgatgtgagctgcattgggctaccaaggcagagtttctgtctgtgttctgtgggggatacggatgaatgctgggatgagacaggtgggcacagcagttgacctgaccctgggatggcacctgctgaggatcccaagacagcctgactcatgccggacatttatctgctgatggagcctcttcctcctcgttccttccttttcctgttaagttggctgttttcagcttcttgccttgcttttcacctggccccctaaaatggtctgcacagtctaaaacagaggtgtccaatcttttggcttccctgggccacattggaaaaagaagaattgtcttgggccacatataaaatacattaacactagtgatagctgatggggaagaaaaaaagaatctcataatgtgtgaagaaaatttataaatttgtgttgggctgcattcgaagctgtcctgggccacatgtggcctggggactgagggttagacaagcttggtctaaaaggacagagcaagaaaactaaggcaggtttttagaatgagttggaagctacttacattctagtgtcccttgttgtagaagctgcacccttacccacctggccccagaagtgcttctttgacctcacaggatcaagtctactagaggcacaatattgacaaatctgctaaccagttaagatgggactcaatctggcattcatgtcgctggaggttgtaagggaagatgaaaagatgctttctgctgctgaaggtgatagtgctttgtccccttttgtaattcagcctctggttaggaatgactgatggctgtggataacttcaccccagaggaattcactgtgcctcttccccaggatgccagctgggcctttgttctcattgtttttggacatcatttttttttctttatttttattttttatattccagggtacatgtgcaggatgtacaggtttgctacatagataaaaatgtgccatggtggtttgctgcacctatcaacccatcacctaggtattaagcccagcatgccttagctattttccctaatgttctcccccaaacccccacccctaacaggccccagtgtgtgttgttccgctccctgtattcatgtgttctcgtgttcagctcccacttataagtgagaacatgcggtgtttggttttctgtttctgtgttagtttgctgaggatgatggcttccagcttcatctgtgtccatgcagaggacatgctctttttcctttttatagctgcgtagtattctatggtgtatatgtaccacagtttctttatccagtctatcattgatgggcatttgggttgattccacatctttgctattgtgaatagtgctgcaatgaacatatgtgtgcatgtatctttataataagatgatttatatttctttgggtatatacccagtaatgggatttctgggtcaaatgatatttctggttctaaatctttggggaattgccatattgtcttccacaatggttgaactaatttacattcccaccaacagtgtaaaagtgttcctatttctctgcaacctcaccagcaactgttgtttcttgactttttaataatggcttttctgactggtgtgagatggtatctcattgtggttttgatttgcatttctctgatgatcagtgatgttgagcattgtttcatatgtttgttagtgcttgtatgtctttttttgataagtggcttttcatatcctttgggcatcaacatttttaatgtgtttgctatttggcatcttggctgccgttttgtaatttttcatcttatatgaaattgaggcacatgtgagatactgaaatcaaccttttgtagaggagcaggatgggaaacaaggaggagctaaggggccttctcagggacactctgttgctgctgtcttttgtgccacagatgactattatcatgcctcattccaatcttgggctcttggccaatgtgggcaccatggcacagaggacattgctggtgcatgggtgtcaccaagttcaaatccaggccctaatgttcactatttgaatagcctccagaaatttatttcatctcttggtgaaggtattggttttatgaaaaagtgcaattacataaaataagaggaagtgctcaataattgcttgctagccttgtggcttaaggtttagggtaatctgtggttcttcatatatacacatacatatatgctggcaaagaattaatttccacattcttatctagcacttctttgcaatggagaaatagcactttaaattttggagtactttgacacacatttctaaatatgttttccatccaatgttaatgagattatggtggcctaataggtgaaggcattgagtgaaatttaaagtaaaataaaattataaaattactacattaagaacatgcaattaactagatagtggggagagggagagggaggaattgaggctgcctcctagatttctgccttgtgtaatgagtgcatgatgatgcaattgaccaagccaaggaccaccagggaatagcaggtcaagcaagtaaatgatcagttcctttgagggcctgtcgcatttcaggcatccttggaacacctgaagatgtctaatgaggagctaggcttcaggagagaaacctaagagctaagaaaatattacagagagttgttgaggtcttttcacttgctctccctctggtctggaacactgtttctccaggtatctgcatatttcactccccatatccttcaaggtctttgctcaaaacatcatctttgcagtaagactctcctggccacccaattataaatgcagaatgcttgctaccccagctcttcctctctaccttctttgtgctatattttgacatagtagacataacattatctaacctactatatattttacttactttcacttatttggttcacgatgtttcacctattagaatgtaagccccacgtgggcaaggatttttgtgtttttgtgtatttcgtttacatctctatcctcagtagccagaaaggtacatataatcactcaagaaatacttgttgaattagagaatgtgcccttcctatgtgcctgacacgaagtgctttttgtgtattatctcatttaatccaagtaagcaatgggtttatagatagtaatgagagccatgaaaatgaatgagatttgcaaggagagtatttaacaaaaaagagaagactgagagcagagacctaaagaatactattattttagagactggcaagggaaatggaccctgcagaggaagtcacaaaaagccacacagagaggaggaggaaaaccaggctactgtggtgctatggcaatgaactgagggaacatttccaaagggaggaagtgatccaaggtgtcagactaggtaaggagcaaaaagtaattgagagagaagtacaagcaaagcccctctgccttcctttgccgcatctgactcagattcactgccgacaagcctctcaccaaaataggtagaactatttttattactatctcctctgacagagtatattgcaaagctataaatggcagagtttactttttttttttttttttttttgagacggagtctcgctctgtcgcccaggctggagtgcagtggtgccatctcggctcactgcaagctctgcctcccgggttcacgccattctcctgcctcagcctccagagtagctgggactacaggcgcccgccaccacgctcggctaatttttttgtatttttagtagagacggcgtttcaccgtgttagccaggatggtctcgatctcctgaccgcgtgatccgcctgcctcagcctcccaaagtgctgggattaccgcgtgagccaccgcgcccggcccagagtttacttttaagcaagacatagatgatgatagatagttcagtggttcgcagactttggaatttcataaactgataacatttgaggggtttaagggagtcactgaaataatagaccaacttaccagtcctctgaatcattctactcaattcattaaggatgacctgaccagaggaaacgaataaactgagaattgttcaggagatgtgaaacccagtcaagaccatttgtcttgccttctggtcttcagtgcaagtcaaaagtcttattggaaagggtaagatttctagcccacggccaccaataatgggccccattgtgggtactgtgtctgccctgctactctgttcatcatggtgcccaggaatagcctggaaagtctctagcacccttgaccatgaatatctatcagcctcttcaccccataccacagataaatacacacaatttcagttaaaaaaaaaaaagtgctggctgggaggcatggtagctcacgcctatggtcccagcactttgggaggctgaggcaggcagatcgcttgagcccaggagtttgagagcagcctaggtaacatggcaaaatcacgtctctacaaaaaatacaaaaattagctgggcataactgcatgtgcctgttgtctcagctacttgggaggctgaggtgagaggatcacttaagcagaggaggttgaggctgcggtgggccaagattatgccactgcactccagcctgggcaacaaagcgagaccctgtctcaaaaaaaaaaagtgtttgttgagtcactttaagacaaatcccctgactgctcctccctgccccactacacacccccaccacacagaaacacccctgattgatgcccctcagcctcctacttagaaattggagcaccacacctgagcaggtgagattctatgtgacatggtgcctggtcttgattgttaatagaggaaggctttaaaaggagattactaaaaacagggtggaagtgactctgaaaaggagcctcaacaaagggaggcttttatctagggtcagctctgccttcagcagttgagcaaatgaaacattccttttgcttttgacaatatttcaaactggagtagccaccctcatgttttgagagtacagacactcgttcattatcagactgacattagccagaatattttaatgtcaacaaagacatgtgaatgattgttggcctgattatttcttatgtcccctttggaagtctccatgtgtatcagattttaaataaggaatacttccaggttgattttgttgttgttgttactgtaagaattctgaatcttatcaaggatgcagtctaagtgaacttggaagaaagctttagtttcatattttctggctaatgttccataaatgtcataacttggctgtttaatggagagtatgtttttttaaatgtaataaatttgccaaacattaatgaagggaagaagagagaataatggagaaatgccatctcaagcttgaaaacatcaaaattagcaataaaaatagaagtttcttatcaggagtgggagggagatcattataggcattaaaatagacacagtctgatctttgctcctggtttcctatgagggactcatggggtaaccttgacccagcagttccactgcttcatgcctgtttcctccatttgtcccgtgggaactgtaatattcatttgattaagtaacatttagatttccagctggtacagggaagttgtaacagtcctgcagatgacatggccttaggtcatcctcatgcccccattgtccagtatggctctgagcagaagactcgtgtgatattcatagtatccaaattcagtaagtctactcatccttaaatgaaagctgctttgtaggaaaatctctaacaccaatgatgacttagaatgggagaaaaaattagtgagatttagttggactcagaaaaaaatttaagacagtagttttattacttagaaagattcatgttaactaggatcaagttaaatcctggcctaatggcaattttttcacagaaactactttgacacatctttaagaatggtctgtttttaatatattgtctttgcattcttctgaaggtgcttctaaagtgagggttcatgaaaactgccttacataatttaagctttcttctgcaaccatatgtacggtgtcattggtttactaagaaattattttaatgttaaattttatgtactttttaaaattcttaactagaggggcccaaatacatgaggttttattattgtggttcttttatgttttgttacaggttttctctgctcacagagtgcttggcaaacataataaatgcttgagttaactgataaataaatgaattagcgaaaggctgtagatctaaccctcatagttagccttactttattctatgtgtggagacagaatccctgatcctgaacacccattcaataccatttgcaaaggccatttgtacagtctagcccatgaagaaaagcatatgactgcaatgagatgtggggtttattccatcgtggtagtcttcttgctcacagtgacagacttcagcactctttccacacttatgcattctaatcaaagagttagggaatgcgtacacttcctgcctgcagcggtgttagaaagagtgtgtcgtggattttctctttatgccagatcagagctgtggtggcctcccaagccttcccatgatgaaaagtaaatagagcagggcatctaccagattcccaaaccaagttagtggaccatccattgcagatggtagcccaaatgaagtagtcctttctctgggcttactgggccattcccattccacatctcacagtggtcctacaactatattgcatacagtaaactctaagggttatgtagataatgagttcttttttcatgcagaagaagctaatgactttgagaagtcagagatgcctggaggcacatggatctcctctgcccaggctcaaggaacatcccaaacttgtgtcctcccaggctctgtttttttaatatacatatatatatatatatatacacacatatatgtgtatatatatatatatatttattatactttaagttctagggtacatgtgcacaacgtgcaggtttgttacatatgtatacatgtgccatgttggtgtgctgcacccattaactcgtcatttacattaggtatatctcctaatgctatccctcccccctccccctactcaacaacaggccccagtgtgtgatgttccccttcctgtgtccaagtgttctcattgttcaattcccacctatgactgagaacatgcggtgtttggttttttgtccttgcgatagtttgctgagaatgatggtttccagcttcatccatgtccctacaaaggacatgaacttatcattttttatggctgcatagtattccatggtgtatatgtgccacattttcttaatccagtctatcattgttggacatttgggttggttccaagtctttgctattgtgaatagtccgcattaaacatacgtatgcatgtgtctttatagcagcatgatttataagcctttgggtatatatccagtaatgggatggctgggtgaaatggtatttccagttctagatccctgaggaatcgccacactgacttccacaatggttgaactagtttacagtcccaccaacagtgtaaaagtgttcctatttctccacatcctctctagcacctgttgtttcctgactttttaatgattgctgttctaactagtgtgagatgatatctcactgtggttttgatttgcatttctctgatggccagtggtgatgagcattttttcatgtgtctgttgcctgcataaatgtcttcttttgagaagtgtctgttcatatccttcgcccagttgctgatggggttgtttgtttttttcttgtaaatttgtttgtgttctttgtagattctggatattagccctttgtcagatgagtagactgcaaaaattttctcccattctgtaagttgcctattcactctgatggtagtttcttttgctgtgcagaagctctttagtttaattagatcccatttgtcaattttggcttttgttgccattgcttttggtgttttagtcatgaagtctttgcccatgcctatgtcccgaatggtatttcctaggttttcttctaaggtttttatggttttaggtctaacatttaagtctttaatccatcttgaattaatttttgtataaggtgtaaggaagggatccagtttcagctttctacatgtggctagccagttttcctggcaccatttattaaatagggaatcctttccccattgcttgtttttgtcaggtttgtcaaagatcagatagttgtagatgtgtggcattatttctgagggctctgttcttttccattggtctgtatctctgtttgggtaccagtaccatgctgttttggttactgtagccttgtagtatagtttgaagtcaggtagcgtgacaaaggatgtaaaggaccctttcaaggagaactacaaaccactgctcaatgaaataaaagaggatacaaacaaatggaagaacattccatgctcatggataggaagaatcaatgtcatgaaaatggccatactgcccaaggtaatttatagattcattgccatccctgtcaagctaccaatgactttcttcacagagttagaaaaaactactttaaagttcatatggaaccaaaaaaggtcctgcattgccaagtcaatcctaagccaaaagaacaaagctggaggcatcaggctctctattttaacacatcttgaccactctgattgtctttcttgctctcctctgccgtctaaagtggggagatcctgctcagttgctggaatttagtagtcatggaagctttcttttttctttctttctttttctttttcttttttttttttttttttttgagacagggtctcgctctcttgctcaggctggagtgcagtggcatgatcgtggctcactgcagccttgaactcctggtttcacacaatccttcctccttagcctcctaagtagcttgaactacaggcatgcaccctcacatcctgctcttttttttttttttttttttttttttttgaagagacagggtcttgctatattacccaggctggtctcaaactcccggcctcaagcagtcctcccacctcaggctcccaaagtcctaggattacaggcatgagccactgcacccagccaaaactttcttaaacacatctccaaacagagctaatctttcctttctgtgctcccaaggactcaaatcacagtggacacaaagtctctgctttccagtttttctcaaagagcatttttgaggagggactgtgagcatttcgaagaggagaagtgatctttaatccacagtggatccccattccccagcatagaccaacttctctgtaaaagtctgcaaatgagtcaaaatcaagcaacaacttcacaatcgcagagctgcttcctagcattcttaactctggtatcaatggtgctaagtattctagaataaatttctcaaaaggatagcaatcttatttctaatatggcagccttccaataaataacatggcagctgagaaaaggaaaacaatagtcaaatgtcattgaaacactagttacctatgtagattatgtctggattcacagcccaactcaccatcggcaaaactcttccctgattatattacacttatgatggtctcaaagccttttccaaaaataagaaagtacattttctgacttaaaacttgtagcattttcagatctattaagatgagattaccacagtaagtacttctgtatagaaccattccacaaaacatttattggttcctatgagtttttaaggcgttaaatctgatatccaacaactgactgtgttattatcagtcctgcctcacaaattgctctgctacataacaaaacgaggttttacagatcagagtgatcagctggagtcatttcaggtatttccctgaaggtcttaaaatggcaacttcttaaacaatgcacccagcgactggcatcctcatcatattggctaaaacaactgctatttttcttattctgtctttatggtagataccattttctttttaacagatggaatatagggagaaaaattctagcctgttttactcattaatgagtcagaggaaaagtccccactgcttctaattatcaggagtcattgtcaagatctctagcaaggaaatgtgtttacgttatcaagaaagttaacaaattgccaaactgtacacagtaagggaactttcatgagcatgctgcttgtccccaactcctgtacctacccaggtcctggtgatctgggtggtaactgtgatactgggatccaattgtgaacatcataagagtgtttttgtagaaactagggtaaaacatacctctgaggataaatagtaacaatctgctgaacttgcagctttgcttcttttccatagcaaatgcttcaccgctgctaggcaagcaaaggtgctctactgacacccccaaaaccccaaacatccactggctcttaaataacagggtgaacatgatgtcatcatgagacagtctggttggggccaagagtttttgcaggcatgtagtttgaaagggctgaacttgtcttctgccatcccctaaaagatcacgtgaaggtcagactagggcttggaaaggctcactgcatttatgccctctcattaacatggaagagctacctttttatcaaaagccagtccctcccatcctaccagaaacctcactatctccttcctccccaacgtccttctctttcccttatctccatcctctctgtctgcttcctccttcccatcatcattaaacatgctcaagtatcttttaactctgacaacccttccctccctaaacctcatgccacctccaaccacatccctgcttccctgtgtcagctgaaattatccatgtcagctgaaattaaagcattgctttcactcactatatccaactcctcacttccctctttcttcttaaccctctccactcctgttttgatcctaccacctcaccaaactactatcattatcaagatactaaggactataaagctaaacatagccatgccatataacccagcaatcccactcccaacaaaaataacctaatgttcaaacaaagcctgtatgcaaatgtttctaatagctctatttgtaatcaacaaaaactgaaaataactaacctgtccctcaacctatgaatgggtacacaaattgcagtctgtgtacaccatggaacactactcaacaatggaaaggactgaactgttcactcatgcaatagcttgaatgattcttaaatatatttcattaaatgaaagaaacctggctcaaaaaactatgtaccatatgatttcactgataacgttatgaaaaaaaaacaaaaacctaggaatgggaaacaaatagtaggtttccaggagtggagacagaagagtgaactactatgggatagcatggtaaaatgtcagggtgatggaactgttttgtatcatggctgtgatggtagatagccaactctttgtatttgtcagaatccatataactctacaggacaaagtgaattttactgtgtgtatgtatagtgtgtgtgtgtgtgtgtgtgtgttgtgtgtgtgtgtgtgtgtgtgtgtgaaagaaaatcaggatgtagaggcaccccaaaatgaaatatgaactgagacttttttttagacaaggtctcactccgttgcccaggctggaatgcagtagcatgatctcgactcactgcagcttcgacttcccaggctcaagtagtcttcccacctcagcctcacaagtatctgggactacaggcacgtgtcaccatgcccagttatttttatttatttatttatttattttttgagacggagttttactcttgttgcctaagctggagtgcaatggcaccatctcggctcactgcagcctccacctgctgggttccagttattctcctgcctcagcctccctagtagctgggattacaggcacctgccaccatgcccagctaattttttgtatttttagtagagatggggtttcactatgtttgccaggctggtcttgaactcctgatctccgatgatccacccacctcagcctctcaaagtgctgggattacaggtgtgagccaccactctcggctctattctttttcagtagagacaaggtctcactatgttgcccaagctggtctcaaactcctagactgctgccatcctctcacctcggcctcccaaagtgctgggattacaggtgtgagccacggcacttggcactcaactaagaattttttttttttcagttataatggttacttttttaaattttattattattatactttaagttttagggtacatgggcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacttatgactgagaatatgcggtgtttggttttttgttcttgcaatagtttactgagaatgatgatttccaatttcatccgtgtccctacaaaggacatgaactcatcattttttatggctgcatagtattccatggtgtatatgtgccacattttcttaatccagtctatcattgttggacatttgggttggttccaagtttttgctattgtgaatagtgccgcaataaacatacgtgtgcatgtgtctttatagcagcatgatttatagtcctttcggtatatacctagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgacagtatttctgctctgttttttccccatctttgtggttttatctacttttggtctttgatgatggtgatgtacagatgggtttttggtgtggatgtcctttctgtttgttagttttccctctaacagacaggaccctcagctgcaggtctgttggagtttgctagaggtccactccagaccctgtttgcctgggtatcagcagcagtggctgcagaacagcggattttcgtgaaccgcaaatgctgctgtctgattgttcctctggaagttttgtctcagaggagtacccagccgtgtgaggtgtcagtctgcccctactgggggatgcctcccagttaggctgctcgggggtcaggggtcagggacccacttgaggaggcagtctgccggttctcagatctccagctgcgtgctgggagaaccactgctctcttcaaagctgtcagacagggacacttaagtctgcagaggttactgctgtctttttgtttgtctgtgccctgcccccagaggtggagcctacagtggcaggcaggctttcttgagctgtggtgggctccacccagttcgagcttcccggctgctttgtttacctaagcaagcctaggcaatggtgggcgcccctcccccagcctggctgccgccttgcagtttgatctcagactgctgtgctagcaatcagtgagactccgtgggcataggaccctccgagccaggtgtgggatatattcttctgatgcgccgtttcctaagcccgtcggaaaagcgcagtattcacgtgggagtggcccgattttccaggtgccatctgtcacccctttccttgaccaggaaagggaactccctgaccccttgcgcttcccgagtaaggcaatgcctcgccctgcttctgctcgtgcacgggtgcgctgcacccactgtcctgcgcccactgtctggcactccctagtgagatgaacctggtacctcagttggaaatgcagaaatcacccatcttctgcgtcgctcatgctgggagccgtagaccggagctgttcctattcggccatcatggctccagccctctaatggtattaatggcctctatagcttcatgaggacttgatagtccatagcttactgcatccaatactgtgacaccccaccccactgaacacaccttcttctcttaatttccagaaaccaccctctccagccttcctcccactgcattggcttcattttctcagacccaagttctttcttctctactcaacctttccatgatgctgttctttgattctcagacccaggccactctctcttctctctctacaagttctccctagacaaactctatcactcttatggtctcaactaccaaatatgccagtactcacaaatttacctctcacactggctcctcttctgaactccagactgacctatgtttctattataccttttagatacctcttagaggtatccaatgtgtactagattgtccaaaactaaacttgcacctggcgtggtggttcaagccaataatcccggcactttgggaggccaagatggtaggatcgcttgaggtcaggaatttgaggccaggctgaaaaacataatgagacctgtctccgaaaaacaaaaagttttcattagctaggcatggtggtatgcacctgtagtcccagctacttgagaggctgagacagaaagatcgcttgagaccaggaattcaagcctgcagtgagctgtgattgcaccactgtattccatcctgggtgacagagtgagatcctgtcttgaaaacaaaatgaaactaaactattctaaactcagcatcaacctccacacccatgcctgcttctttttctgggttcccaactccttaaaggtgaccatggttgtctgttgtttgtgctaaaagcttagacattatccttaatctccctctttgtcatttccctccaatccagatcccccatggctgatcattctcattctctcttgaatccatgtattttctccttttctactaacttcagtggcactaccctggtccagggtgccaccacctcttatctgcactcctcctcctatttagtcacccagtaggctcttatgcaaacctccttcacgttgcagctgggataatctttttgaaacacaataaattgttgcattcctctgctttaggcctgctgtgatttcccattgcttttataataaagtcaaattcctgagcacatcctaccaggctctgcagggtctggcccctggtgacctccccacctttatcctctgtgtacttccccatctccctctgtctccttccagacctgcagcaaattttttttacctcaggccctttgcatgtgctgtgttcctcacctgcccttcagtaattcatcattattcaccctcaggcctcagctgaaatgccacttctgcctcccgtgactccagagactagatttgcttcccttattacatgctttcatagtttctctttctgagcatttattttttcctatcaacccctcttctctaaaaggcaagaaagaagtgggtcaggcttattcattgctttctagagccaaggatgatgtatatactcaataaatatctgcaggtgctccataaatatctattggacagaaaaacaagttaaggtaatcagctgagtaacacacagtacaatacattgtatataggtaacggtgggccattgaaggcattcgtgcatggaaagacactggggattgtgttaaaagcattaacatggcaatcatgtgcaagaaagattggggaaaccaacaacactattataatgtaataggccaggcatggaggaatatagcctggattagaatggtgacaataggaagaggaaaaatttataggatctgatgactagttgtacttcaaaggaataagggaaaaagtagattcagagattagcatctggctggactcagtggttcatgcctataatcccagttacttagcaggctgaggcaggaagatcccttgagcctgggagtttaagactagcctgaacaacatagcaagatcctatctctgaaaacacaaaaaaacattagccaagtgtggtggcttatgcctgtagtcccagctactcaggaggctgaggagggaggatcacttgagcctaggaggtggaggctgtagtcacatcactgcactccagcctgggcaacaggatgagaccccatctctagaaagaaaaagagagagagagaggaaggcgaaaagaaaagaaaagaagagtctggaaattttttaaatagtaagaaattaagaagaaaagaactgggtttcagaggcagctaatgattccaggccaataaattgtcacggtgatggagagacttgtgaagaattccaagtggcctaaaaaacagaagtcatatttcaaagactgtctgcatacctcttccaaatcaggaccatctgcaaggaaagctgaagtgaaatcattatttatgcagataattttctcggcaggtggtctccttttcttcaggcagaattgtgccaaggccaggccacatttcataggcaggaacagccacggcaccaatggggaggtacctgcattcctctagggaaactgcctggaactacaggccacggatctctgtgttccaggggcaacacgcctccttttctgcttgcatgccctggagctgccgctgatctttggcagaggagacccagaaaaaaggccagttaacccacagaacgtaaagccgtgcttgtgagcatgtgggttatggacctgatgacctttggttttctgaggcaaaggaggaagagcagctctcagtaaagcatatgggatcttatggaaacagaaaagctgcaagggccctaggaggtgtgggacacgaggagaaattccagagacctgctgctactttcacagttaggtgtgagctgagattcgcacctaactgtggaggagatacaactgttttgcccatcctacacttagaggaaaaataaagagtggctttagactacaaagtatagagaaagcagagtgtctgaaatatggaactgaagtttgcaaaaccccaaacagaaaagaaaccaggactttggggacactaaaagctcactgaggctctagatggattgctctgttctgtgagtggagaagggtctactcagctatatctagagaccaaaggccaaaagctacagccttgataccctctgtggggcagggtccatgcaagccactttctggcagctcagggactagacaaatttctctgagctctgtgggaagttggggaatggatttaaggtaaatttcataggctgttagtctgctcagactatctgactatctcaaagagagcagcctgtaaccctcccctctgaaggggagcgtgtgtgtgtgtgtgtgtgtgtgtgtgtgtgtgtgttagagagagacagacagacacacagggaaagaatgcctattggaagaccctgtctctgaaaaaaaaagttttcattagctaggcatggtggtatgcacctgtagtcccagctacttgagaggctgagacagaaagatcgcttgagaccaggagttcaaggctgcagtgagctgtgattgcaccactatattccagcctgggtgacagagggttcaagttcaagaccagactgcacccacttcagtccactcactaaaccactgtagaaaaaacaacagcaagaaaagccatcaggcaccctctctaatcttgcccaggagtccccacccttgtttgggcaaatccatttcccggctcccaggaagaagttgggaaggcccttttctttttttttatttttatttttatttttttctcctgcaaaaacttttttttttttaatactttaagttctagggtacatgtgcacaacgtgcaggtttgttacatatgtatacatatgccatgttggtttgctgcacccattaactcgtcatttacattagttatttctcctaatgctatccctcccccattcccctaccccacggcaggtcccagtgagtgaagttccccttcctgtgaccaagtgttctcattgttcaattcccacctatgagtgagaacatgcagtatttggttttctgtccttgtgatagtttgctcagaatgatggtttccagcttcatctatgtggctatgaaggacattaactcatccttttttatggctgcatagtattccatggtgtatatgtgccacattttctttatatatatatatatattatatatatatattttattatactttaagttctagggtacatgtgcacaatgtgcaggtttgttacatatgtatacatgtgccatgttggtgtgctgcacccattaactcgtcatttacattaggtatatctcctaatgctatccctcccccctccccccatcccacaacagtccccggtgtgtgatgttccccttcctgtgtccaagtgttctcattgttcaattcccacctatgagtgagaacatgtggtgtttggtttttttgtccttgcgacactgcaggggtagataggttactagttttgccactgcagagatgattcccacctcaaatgctgcctcatttcacctgccttgaaaggagacttgatatgatttccttgtcttttatttgcctgccaataatattccacctgataagaggtggctgcagttgcattactgggacagcccttttcttttatttgtcctcctcctcccctccctctcctgtcttcactatagcaaaataagtctttgtgtctcatttcattggtcttcaatccttttagggttttttttgtttgttttcatcactccaccaagaaacaagggtctgaggctgctattatgttagttaggttggtaataagcttgaagttgctactctacttggtcaataaagtctgagcccagcaggttgcacatctgtttcattaagaataaaaggtttctgtgcagacagcgacccattgggtgtatgcagctgccagagaggacactctgtgactcggtatgaagcccaggagatagcaatagtgaacttgtaacatacatttaaatacattaattactttgggtgtgaaaattatcacaaaagagtaacagtaaaatcaacataactaaccatcaccctatcataataggccctttttcaagtctgtctgctgatccacaaggttgactgtaaatagggtgctttctcactctgtgtcttatgtaagacaagcacttaatacttaaagtgaatgttgcttttagcaaggctgtcatttagtttgtgtcctggcccagtttagacagttgccttcaaggcaataaatattatcaacttttcccttttcaaactattttgcaaggaaatcaattctcatactatagaatatatttctagtatgactgcagtttttattatttagatcttaattatcttaggtattttgcttttctattttcttccttttcatgtcagctttagagaaattagatattgtttgtttgttttctattttcctcataaaatgaactaggaaaataaaaattcagcaatatactcctattattaaatgccctaaaaatatatagaaaaaatatgcccaaggaacctgggataaatgttttgtatcagaaattttgtggccactttgtggccctgctaacaaacatcctttaagctgctttttatggtgtttctttttctcaacaaaacaaaacaaaacaaaaacaaaacaaaaaacagtattccacgttaccattgctaaaaagaactaaaacaacaaactgcaatttttggagtcaaatcacaaaaggagtcaaggtcaaaatacagccatggcttgatgaagaaaagcactcctgtgttaacagcatacattattgcagaaacccagctgatgggacatctgagaagatcattagcagtggccacacggtattggcacaagtttcatttttttccctaatggttattagtggagttttatgattctaaattattcataaaattgtctaagacatttaaataatgtaaaaaaaaagttctaaaatttgtttttaagtatttggattccctttctatgcatgcttgggaaccagcaaggacatccattcctgtgagggtatgacagccctggtggacgcttaaatcaaggatttgaaaatgattttttaatgtttgctgttttcatttattcatattctgtttgcacattattattgctatacttgggagctaataatgaattacattgaaagctatactcgtcaaggtattctgaagaaattcaatgatttcgatatactgatgcaaatattagattggactatatgaaattgacattgttaggtcgtttttgcttgtaaaaatgataatttcataatgtttagcctagtattttcatttggaaattagtcatcttgtgcttttcattgtgttttggttctggttttgctttttgctttttatacttttaaattgtctgaacagtagtttatttatcttggatgttggatttttagtgtaaaatgtgacatatccagtgagtggaagggtgaaaaataattaatggatatgggatttctttgggaggttatgaaaatagtccagaattagatagtggtgatagttgcacaattctgtgactataccaaaagccactaaactgtacatttttagaggctcagctttatggtacgtgaattatatcccaattttaaaaaatccaaaggtgtaaaaattgggaaggaataaataaaactgtctttggtcacagatgacatgattatctacatagaaaatctgaaagaaccaaaaaaatgtcctggaatgaagaagcaattatagcaaggttgtaggataaaatgttaatatacaaaagtcagttgctttcctatataccagcaataaacaattgagacttgaaattaaaaacacaatgtcatttacattagcaccaaaaattgaaatatttaagtataaaactaacaaaatatgtataagatctatatgaagaaaactcaaagctctgatgaaagaaatcaaagaactactaaataaatggaaatatattacatgtttgtggatagaaagattgaatattgttaagatgtcagttcttcccaacttgatgtatagattcaatgaaatcctaatcaaaatccctgaaagttatttcatgaatatcaataaactgattctaacatttatatgaagaggcaaatgacccagaatagccaacaccatattgaaggagaagaacaaagtcgaaggactgacattccccaacttcatgacttactttaaagcaacagtaatcaagataatgtggtattagtgaatgaatagataaatagttcagccaaaagaataaattcccttcccctcaagaaatagaccaacacaaacatattcaactgatctttgaggaaggagcaaaagcaatacaatgggtgatatgtttggctgtgtccctacccaagtctcatcttgaattgtagttcccataatccccatgtgttgtgggaaggtcctggtgggaggtaattgaatcatgggagcgggtttttcccgtactgtgctcagggcagtgattaagtctcatgagatctgatggttttataaatgggagatcccctgcacaagctctctcgcctgctgccatgtgagatgtgactttgcccctcattcaccttccaccatgactgtgagctctccccagccatgtggaactgtgaatcaatgaagcctctttcctttataaattacccagtcttgagtatgtctttattagctgtgtgagaacagactcatacaatggggaagatagtctttttaaaatagggtactggaacaactagacaacacatacaataaaaaaagaaaagaatctagacacagactcacatccttcacaaaaactaactcaaaatggatataaatgcaaaacaataaagctcctgaaagatgacacagaagaaaacctagatgaccttagatgtggtaatgacttattagatacaagaaaaaagccacaatccatgaaataaataattgataagccagcctacatcaaaaatttctgctctctgaaagacaatgtcaagagaatgagaaggcaagccaataactgggagaatatatttggaaaagacacatctgaaaaaggactattatataaattatgcaacgaactcttaaaacccaacaataataagacaacccaatttaaaagtgggccaaaggacttagcagatatgtccccaaagaatatatacagatagaaaaaaagcatatgaaaagatgttctacatttcattagagaaatgcaaattaaaatgatgagataccaccacacacctattagaatggacaaaatccagaacactgacaacaccaaatgctgacaaggaaatggaatagccaacaccatattgaagaagaacaaagtcaagacattccccaacttcaagacttactttcaagcaacagtaatcaggataacatggtattggtgaatgaatagataaatagttcagccaaaagaatgaattctctgtcccccaaaaatagaccaacacaaacatattcaactgatctttgaggaaggagcaaagccaatataatgggtgatatttttggctgtgtccccacccaaatctcatcttgaattgtagttcccataatccccacacattgtggggattcattcattactggtgggaatgcaaaatgctatagccactttggaaggcagtttggcagtttcttacaaaactaagcagacttttaccatgtgatccaacaatcatgctccttggtatttacccaaagagaagttgaaaacttctatccacataaaacctttacacagttgtttatagaagttttattcatgattgtcaaaacttgggagcaacaatgatgtcctccagtaagtgaatggataaataaaccatggtatatccagacaatgaaccatcactcagcactaaaaagaaatgagctatcaagccttgaaaagatatgaaagaatcttaaatgcatactactaagagaaacaagccgccaatttgattccaaatatatgacataggtctctatacaacattcttgaaaaggcaactagggagaaagtaaaaaaaagatcagtggttgtcaggttctgggaggaaggagggatgaataggtggagcacagaggattttcagggcagtgaaaatactttgcatgatactataatggtgagtacaggtaatcatacatttgtcaaaacctacagcatgtaccatgccaagagagcatcctatggactttgggtgaaaatgaagtgccaatgtaaactcgttgattgtaataaatgtaccactgtgattcagatattgacagtagaagaggctgtgcacatgtagggacaaaaagtagacggtgactttctggattttctgctcaattttgctatgaacctaaaactactctaaaaagtaaagtgtgatttaaaaattttatctgtacttataaaaatgatgaaggatgtcttctaaagttggcaaagccacattttattaaggatgctcttcatctggttttacctggaataatcaaagtggtttccctcaaacacatttcctgtctgtttagattctgtaattttctacttggaatttggtgaagataccaaagaaaatgttcaaaatgatgaaacttcccactgcaagatgatgatgatgatgatgatgatgatgatgatgaatacttaatagttatgtaactgtagagatgcatgccaactaactagaatataagtatggagtcctaggtttgggtccaggttgaaattctagcgactcacagaggcaaaaaaagtaaggagcaagagaaaattcaagcatcccagaaaaactgactcagggaacacctgaatagcacaaagcatcaagttgcaaaaatctcaagtctggtagacagcaaaaatataaagactcagccatcaggttcagccagacggagtaggtgcaggagaaggaagagcaggtggaagccaggatgtactgggagatattcatgtatcaaaggtagcagctttttaatgtccctcattcagcccatctcacaggcgaggatgaaatgtccctaacagcagtgagctgagccaggcataaataagcttctagttcctcctgctcaagaaaccagtggtatctgttctcatctagaactgagattctttttattcctggtccactgatctccatggcctgcaggggctgcagttctgctgtctcccttggagcttagtgggtcctctgtgaggttgcattccttctgagcagaatagttgcattcatttctcagcaaatctttattgagtatctactatgttccaggcattcttctaggatgcaatggtgaagaaacaaatgaaaagaccaggttactgccttcatggggctttcggcctagaatggaagctatggcaaccatcaatccacaaggcatgcatgcgtgtggaaacttcccctgagtggagccttgggggaggaaagtacttgggctgtgcattgtggaaagagggccttgatcgaggcagggaaggccttcccagggcgtggggagtcagtgaggcctaaaagaagagtagaagttattaggaagttggagaccaattctaagcaccgggaaccttgtgatggaatgggattttgtgcagctgggattttgacaatgggattttgacaataccacaccacatatcagatggtggcagtgtatgtgatatgttctgtgtaatcatttccaggacacaagggtggcaggggcagttagttgtctgccgttgcctccttggtaacaggaccctgatgcttggctgggacgatggcacctagaaaaggattgcatttctcaacctcccttgcaattaggtgtagccatgtaattatctggagactaaccaatgagatataagtgatcagttgtacaggacttcaggaaaatatctttaaaaagagagggtaagaacatcttcttcctgttctccttcctcctgcctagaatgtagagtaaatggatggtgctgcagcagccattttgaaccataaggtgacttggaggctggaagtccactctagcctactagattataaagcctgtaggggacttggtccctgattatatgaatttcccattcaagctctaactgcctaagttgacttcatttacatgacagaaaaaaaaacccttgtgtgtttatgcctcagtgatgggagttggaatctcagttacctacagctgaatgacgtgccaggaatcaggaggtcattgagtatcccagcttatcccaccttactgttgtcaagcattctataccagatgtacagcagaatgcatctcaactgtctcatccattttcataatttttctgcctaaatataaaagacaggaccagatgcctgtcctttggaaaatccccaccagttatttcatcaccaattcttttttgttgttgtgttgtttggttggttggttggttggttttgttttttctttccaacttttaggttcaggggtacatgtgcaggttttttacatggctaaattgcatgtcatgggggtttggtgtacagattattttgtcatccaggtaatgaccatagtacccaataagtagtttttcaatcctcaccctcctcccagcctccaccctcaagtaaatcccaatgtctgttgttcccttgattttgtccatgtgcactcagtgtttagctcccacttataagtgagaacatgcagtatttggttttctgttgctgcgttaattcacttaggataatggcctctagctgcatccatgttgctgcaaaggacattacctcattcttttttatggctgcatagtattccatggtgtatctgtactgcatttctttatccagttcactattgatgggcatctagattgattccatgtcttcactattgtgaatagtgctgtgatgaacataggtgtgcatgtgtctttatggtagaatgatttatactcctttgagtatgtgcccagtaatggggttgctgggacaaatggtagatctgttgtgaattctttgagaaatctgaaaactgctttccacagtggctaaactagtttacactcccaccagcagtgtttaagcattcccttttctctgcaatctcaccagcatctgttactttttgactttctaatcatagccattctgactggtgtgagatggtatctcattgtggttttgatttgcatttctctaatgattagtgattttgagcgttttttcatatgcttgttggccacacatatgtcttcttttgagaacatcaccaagtctaaaattatccatcttggaagtgaatgtctggctaaatccaatcttctaacaatttttaacaacactatcagaatcttttaacagaccttgtactcacacaagggatgaaagtgttgcttagtgctgcaaaggggaagaacagtactaacaaaatactgtttaggttatcagctttaagtcacttttataggtatagaactagcaagtgaagcagaaaaaaaatgaaatattaatggtttgatcacattactctgtgacattgtaggtggcaggatggggttgtccaggtaaaggtaggtctgggggttcatctgaagagtctacaggcacacaacaagcatcagaggtcaaagcaaggaagagggaagaagtagccaagaaggttccagaagcctgcacttgttagatttgacttctcatcctaaggaaggctattttattttatatactaggtgtgagtgactgtgtaaccataggaattgtttataatggaaagaaatcacacatcttcagaaaaatgctaacctccactgaggcagaggcagaaactctaggattacttcacagccaaaaatatttcggtagcaaaaacagataagaatgcctggtgaccatgttattaactagaattcaatgattgggggtttcttaagattgaaaagacttttgaggttgtatagtaaataagggctggagggaaaatttttaaatgtggtacttgcagttttaaaacatattcacaaaatatatcttggaatttactgcccagaaagtgtggcttgagtcctttgtataatagttaaatgaatagcaagagaaaagaaaccttgaagtcaactaaagattagaaaaatgaggatcaggagtcatcttttactaactcaatggcttttttatggaatgataaaattaatggatgaggagaatgcaatcgatgtaatatatctgaactttcaagaagcagctattattgtcatgtcacagaatgatacttgataagtctattcaatcatgccaagatctaaatatggcccctcaattggaaagtagatgggaatctaggcaacataataaataatgaatgattggggagacaagaggaatcaacatgttctcaaaactttgttttgttttgttttgtttcgagactatgtttcactctgttgcccaggctggagtgcaatggctcaatatcggctcactgcaacctccgcctcccaggatcaagcgattcttctgcctcagcctcccaagtagctgggattacaggcatgtggcaccacacccagctgttttttgtatttttagtagagacggggtttccccatgttggccaggctgctcttgaactcctgacctcaagtgatccaacgcctcaggctcccaaagtgttggtattacaggcatgagctaccgtgcctggccaagactgggtatatttgaatttcactttatttgtcactcctttcactaatgatcagagagatggatcaacaccatgagtaacaacaaaacaaacaaacgatgccactaggggtgcttacattatttaatgtcacagatggaaagacgctaactcttttgtctgtgttcccagttgcctttttttaaattgggataactatcttgttttatatagttaattgaatttattaactttttggttgaactgtggtctcttttttttttgattaacatgtttgcaagatagattactgagcaacgtttacattgagctatagatttatgatctttgtacggctcctatcttctgtcaataattctctatgtggattaactgcactggagaaaaccaggggaaaaatgaacagatggaaactggagggtggggtaggaagtaagttcatggggatctgaaatcaacagaaatccagatggacattcaagggaaattgaagagtgttaaaaaagaggaaaaaagtgcttgaaagtgaaaggaagaatggtgaaaggaaagataagtccaggaataaatgtaaaaagaacgaggaataagaagtcaatgtttgggggatataaaaaatataggaagaattcagtagctgtcaacatgacagtcataaaggatttggtttgagatggatttggaatcgatcaaaacggaaataaaaattctattagattgttattgatgtcatggtttgtttgttgttgtttgagacaacgtctcgctctgttgcccaggcaagagtgcagtggcacgatcactgctcactgcagccttgacctgctgggtgcaagggtttctcccaactcagcctcccaagtagttgggactacaggcacgccactatgcgtagctgatgttgtttttggttaataattgtttacaaacctatcaagtgcaaagtggctctggtataactatagatgagaatggactttgagacagtcttaattacttgagtttgtataagaaaatggtggttcctaattcactttccatgttggtaaattagttcatctctgtcttcgtccgaagacaaactagttgtacatttgtatcaattatagcaaagtatcagcacagatcttcagagttctctcttatccatatgagagaagtattattaaaattagtctattctgtcactttattcagtgctcgtggggagccaaaaatagtaaaaaaatgcagattcatttttcaaaggaggctgtgtgtactattatatgcactattaatgattgttatgattaaacaacaaaaacatacaaatttaaagtatttggcatcccttgagtggtgaaatgaaatgttgcagttatgtggctacagaagaaaaatgtattcagattaaggcacatttatgcaaaatcctgcccagtaatttctttcctgtcttcctggccttgattccttctgtgggccttaaaaaaaaaaaaaaaaactcaaaatgtatttgtcttaatttctctacctaaaacaaatggattagaaacctttgttgaacagccctgtgagaaataactcattaataaatgtgaaatattgcccaatggcaaaacggcataagttttaagtgctcattatgccagtaaatgtttctgcattgtaaatttggattttaagttatatggagaaaaaatactcaggttagagcagagcaggttttagtttcctcaaagtgcatattaaaactgagataatttgatagccaaccaccaaaatctatttttaagttatttttttcagttacgacatatttttagtaatttttttctttatgcattcttataacttaaatattcagattttagctacagagggcattgtattaatattttcagtgacacattaatgtacgccaagaatgattgtattgtgtggtttgtttataccagtagttatatttgatgttagctatttggtacaaaatacaattcttatacattatgggaacataaactttattgctgtctcattaccatgcagaagccaaatatgagcaaaagaataatatcctgtattaatcttccaaaggttggctatggataacccaactgattgtgttacagtttaattaatggaataaaaagggaataaatagtttcaattctgcctaataaaggtaattctcccatggcaagatatgtacactgaaacatgataaaagaattctgatggaatggctttttgtctagttgaataacgcaatattctcttctgtgcccgtaaaaaaagatatctccgtccttaaggctatattttgtagtgtcattttaggtattcattttgggggaaaaaaaaatccttgcttattcagctttaaggaattagatctcattgaactagaaaaaactatctaaaatagcttaaaatgttttttgatttgtgaaatataaaaagtcctcactgtggataagtgaagccacattcatttgagcaacttcactgacctttttctcctctgcataaacgcttgtccgttgctgatggttctgtggaaatgtctgcaggcagaaaaaaaaatcagaggggtgtatttttgcagcaaaaatttcagatgaaggggtttgtatttttagatggcttagtttttttgagttttgtttttttgcgacagggtcttggctgtcattcaggctggaatgcagtggtgtgaacacagttcactgcagcctcgacctcctggacttaaaagatcctccttcttcagcctctcatgtagctggcaccacaggcacacaccaccatactcagctaatttgtttttgttgttgttgttgttgtttgttttgtttttgtttttttgtagagacagggtctcactatgttgcccgggctggttttagactcctgggctcacacgatcctcctgccttggactcccaaagtactgagattagaggcgtgagccactgcaccccatcaagatgcttgatttgagttaattacagacattttcctgtaattttaagattttctgccaacaaaagcattggaagaaagtaaaacgtcactacatatgttgaggtatcctgaatagtagggcatatttaaagacaaaagaaaatgcaactagctttactttcttccacaaaattaaggctacctctaagtctttctaacttcacacatctgtagccagttggttcaaccacccaggaacagatggtcatgaggccaagatgttttatttctgtgcgaacaggatggctttgttttattccataggctcaagtatatagcctggtgtcgtggactgaatagtgttctgaaaaatttatgtccacccaggacttcagaatgtgaccttatttggaaattgagccttgcagatgtaaattggttaaaatgagatcatactaaattagggttggccctaactccaatgactagtgctcttttttttattttattttatttttttttgagacagagtctcgctctgtcgcccaggctggagtgtggtggcacaatctcggctcactgcaagctccacctcctgggttcacgccattctcctgcctcagcctcccaagtagctgggactacaggcgctcgcccccatgcccggccaattttttttgtttttttagtagagacggggtttcaccgtgttagccaggacggtctcgatctcctgacctcatgatcctcccgcctcagcctcccacagtgctgggattacaggcgtgagccaccacgcctggccatgactggtgttcttataagaagaagggccacacagagacacaggagaatgccatgtgaaaatagaggaggcagggattggagtgagaaaccaaggcctgctggtaacccccagaagcaagagaggagcacagaacagattctctctccagcctccaggaggaacctaccatgacacaccctgattccagggtgagagagtaaattcttattgctttaagccactcagtttgtgacaacgtgttacagtagccagggataacccctagacccggacatacagcttgatcatattctaccggtcacacaggcattcaatggagactgtagacatctaggtccaccagtgggaaataatagctattttctaaaaataatacctatttttagaaaagcatcttcacaatttaaggttataactaatgtgcccaagtccattcctggtaagcaacagctcaggctctttacttaacaaggagcatgtccagaacatgcaatctcaaaagtgctactaaattctgccacctcaacaacaccaaatctgatgacaaagcagtagaaaagctttttaaggaagccagtttgttcctgcaagagtgtctttaattagggatgagtattgtagaagatgacagcatccactctattttaaacagaaaaggaattttgctcgcaaaatcactggaaaggctagaagatcaggatctaggctgggattccaaaagtggcttcctaaaatgacaccactgagcagagctggctcctggggaactgtgccctctgtcaagaccgggaagacgaggaccaggaagctgctgtcccagatgtccactcttgtatctcaccacctgatgcattatccagggaactggaagcccctgccatgcctcccggcttttgggaacacattgcttcgctctcttcagaatgaaaaagctgatagcagaaccgttagcagaaccagctacatattcatgtggccagtgcaaaatgaaaatgcagacccccatgttcacaattattaagacccaagacagcagcaacagagcattaagccaagcatggggcccttctaatcatgggagtcctgtgtgactgctctggtcacctcccataaagctggccccagctgttggcttcagagccatggtggcctgataatctacatcggcaaaagggatcaacatggatgcatcctgtactataactcttcctcacttgagtcagcagagagtttaagactttgagactctggaagactgggaggcagggccctggctgcaagggagtctgaggaacgtccttgttagctgtccaggctctgcggtgaaggaaacactccagaaggagctgcaaaaatgctgactgatggatgcagcacaccagcatggcacatgtatacataggtaactaacctgcacattgtgcacatgtaccctaaaacttaaagtataataataataataataaaagaaacaattccaaaaaaaaaatgctgactgagtctatctactgtatccacccaagtgataattttttgcagagcaattggttctcttctcacttacagaccccccctgttgcagccagctaagtgctttctatacacagcactcaacagacagctggcagaatcatgtgtgtatcttctctgcaccaggtgtgtgttagaagatcagaatacagtgctgacccaggaagacaaggtccctgccctttgatttccctcaagtgaacagacacgagaaattaacaagtgaacattctcactcagtcccatctttcttcccttcaatccattctcaacagcacatctggagaaatcctttgaaaaacacaaatcagttcacacacattcccctgcttagattatttccatagttttgccttgcccttggaaaaaagccagacctcctcatcaatcctgacaagagcctcgcaccatctggtgtctgcctatctctgatgcttccccacttgctaactacgccacatcagtgtcctctctgctttttggagcataacaagttccatcctatctctgtctttgattttgagctttcctagctcactgctcaactggttccttctcagcttccggcatgtggctaaaatgctaccttttcaggaaggttctctctaatcctaagataaaatccccacctcagcccagtttttctacatcatattgctttgcttatttatccccacttatcacaatctgaagttagcctgtgtatacatttgtgtgtttctctttcctgtccatgagaccagaggccttgcctacctggctcagtgctttaccccaaactcagcacagcacctgcgtatagcaggagctcaagaaatatttgttgaggagctgttactgacagattggtacattttttaaaaatagctacattcatggaaagtcaggtttgcattcattatttagatgaaagaaattgaacctaaaaatgaagcattatttgggatagctatggagtttaggaaaattaaagcagagagttcaaggcaactggcagtcatcaaaccatacaggtcagctattctgggaaaaaaaatgtgggctggcattggggtaaaaaggccaggccaaaaactgtccagtaatacacatgatctcacacttgtttacaggttattttgaggctgttctcttcctgttcccagtgagtgatcttcctgctcacagtgagatcacttactcactgagagcagagacctctgtctttctgcagtggcccccagtgctcccagtagctctaagagcagcttcctgctccttgtttaagttctctaaggatggaagatgctaagcactgggaaggcttgactttcatgcttttgcatggcgccaccaggtaggatggccaaccatctggattccttggaactggggaggttcctggatacggggccttcagttttaaaaccggaacaacccagggaacaaatcagagtacagtcatctttccatgggggcactagaaagaaggtggcttcattcttatttttgctgatggtctcagtccgaccagcttgcttcagcccatgtcatactccatttactcacttgtaactaatctttgttattttgccctccccttgtggcttcattgtgcttcccaatcctcactctcagccctgcttctctgacttccctcgttgacagtgtctggattctttctctgattgtgtcatactgcaacactcttacatcacctgatccatcttgccccctgggatcttgggggttctacccccaccccaggcctccaagaagccccgttgtcacacttgccccatgagtagtggtaggacattgagtgatgagaattatctatgaatacaattatggtgatacacctctgactgcacagctcagaaaaaaaaggccaaaatattcaggagttatctggtgaccctctatcatacagaggaggagtctgaaaactttctctgtaaagggacagatggcaaatattttgggctctgcagaccatgcagtctctgtcgtaagcgtgcaactctgccgttgtggcaggaaaacagctgtagacaatatggcaacagagactgcatggcctgcaaagcctaaaatatttgctatctgttcctttacagaggaatttctcaatttttatgtgttccaataaaactttatttacaaatataggcaatgggcctaatttggcccatgggccatagtttgtggatccctgatgtagaacagccttctagatgatttttaaattttttattgagtctataaaagttttttttgtcctcaccactcatggatcagccatagctccgcacacacaatttacacatcttcttcctaataaccctccttacctctcttaatttttcatagtcattttcctgtgcttatggaaacttttactccacaaaaattaactcttgcaccaagacacacggaaagaaagactgtgtggtacttatttctagaaggatgtttaacacacatttgtaatatgaaagatagttagggagttagagtgaactgttaggataactgaaattaatacacggttactgctttgttagattaatagggctctgatgggcaggagtatccttattcttggtgataaggaaggaaataactccaaatagtgttttttttttgggtggggggggatggagttttgctcttgttgcccaggctggagtgcagtggctcaatctcggctcaccgcaacctccacctcccaggttcgagcaattctcctgcctcagcctccctagtagctgggattacaggcatgtaccaccatgcccggctaattttgtatttttagtagagacagggtttccacatgttggtcaggctggtctcgatctcctgacctcaggtgatccgcccgccttggcctcccaaagtgctgggattacagcactgtgctgggccctaatagtgcttttaaaggtgagttttggggctgagcatggtggctcatgcctgtaatcccagcactttggagagtcagtgtgggaggattgcttgagcccaggaggtcgagaccagccttggcaacatggtgatgccccatctctacaaaaattagctgggtgtggtgagtgtgcctgtagtcccagctacttgggaggttgaggtgaggtgggaagatcacttgagcccaggaggttgaggctgcagtgagctgaaatcatgccactgcactccagcctgggcaacggagtgagatcctgtctcaaaaataaaaattaaaaaagtgagttttgggctattcactatttctggttttgtttttgttttaaagttaaaaagtctcaatctgtggtcagggctctgcagtcgtaagcagcttatgcagagtcctgctttcttcatatgtgtaatttaatgttcctgagcaaagcagtatcttcatcacatattttgaaatgtgcttcgctgaaaagtgtactttcatacggaaaaggggtggtaggagaaagaaaatgctgataacattttaaattaatctttaggaatgcactcacaaaatgcatggaactggaaactgcttatatcagataagaaacctgggaaatgaatgtgaaaagccaagaaaggggaggagggtgggagaaacgagaggaaggaaaaataactatcaagtactttgcttagtacccggggtgaccaaatcatctgtgtaccaaaccctgacgtgaatttacctctataacaaacctgcacatgtacccctgagcctcaaataacggttaaaaaaaaaaaaaaaaagaaacgaaagtcatgggaaagaagactgaatctagcaaaacgtccttacgtgcatttctctggtcctgaggtaagatgtggttgcaataggggtgatgacaaacagggccctataatgttgttgagccgcctccgccacttgctttcggtggagttattgcaggatgacagagttctctgtagcgcagagacagcatatatgggctcattgctgagctgattctgctgagcctagaaaaccgagcgccttaacaagtcaattccacaccccctcgaatttgtgcctcggtagggagtcctcagcaggaaatcctccatctgttttcctttactacaagggacttcagagaatgagttcatttctcttcagacatcctcacgttgctgtaaaacagcaccgggctgagtgaagagaaatgtcacaaggaatacaagaggacgccttcaaacagagatagcggagacagttacactctgaattagagtctagctttggagaggatttatttttcttttgttacttacatcctggatttgcttttttttttttaaaggcagctttgttttttactatttctagtaaagcatggacatttgaagaaataaatataaaaggaagatttctcaaagatttgtcctgttgagtaatgaagcataccctgaggacccagggagtagaactagatcagtctttctttttgagcaaaaaagcctaatttgaaattcaggattacttttaaaatatcactcaaagtaagtactttgtctttgtttttttttctcttttcttccttcctaaccccctagtcagccttttttgcatattataatctcaatgaagttatcagttgtactataaatatgagtaaaatgatttgccaactcataaattacttacaagatgagatactgagttttctgctgtgaacactgttcagtactagcaggtagcaggcaatatttatagtaatgtttatgtttttatgtcaagactcatttgatttcattaacatgtcatgtgaatatcttttgcctcatttcctccaataatataaacgatattttaacttggaaaatgagcaagcaaaagtctcttctgaaaagagcattgttgccctagcaagcaaaccaatttatttcaacttttgtcgacttctctggaatatttaggtacatttgctgaaagatctgtaaatctagagagtaaacttagctaaaacaataactcttgtgaaccccttttgaaattgccatgaaatcatattgcaaatgtgtaaaaatttttaaaaaaaacaactctatagcaaaaggatgttgaaacataaaaatacgtcaaactgctaatatcttgggttgcactattaggctgagctacagctgtgtgtgtcttgaagcctcctcagaactccaggaatccagagctgtgaggctgatctagctgtatgtggttaaaggatatacaggtaatcagagaggttatctagaagggcccagaatgtcctgttcccttaggggctcctaacatctaccacccatccctctaccctctcgtccttatatagtagctgtaaatccttaaagtttgctattggaggggtcatgctacctctcccagcagttattttggggaagagatggctgcttcaatgtgctgtctggccaatgtctgggcaagaaggaacattaaaatgatctgtgcttcctacacatcccaggtcccctaagtcacaaaagccatcacctgtaccaaggctctctacggaccagcatgtctgcaggagaaagacaatgggtgaaacccacttccgtggaagtagggtgctgcattcttcctccagctttccctattctttagatactgtctgcctcgacctccaagaaacatgattcctatgcgtcatctgttgccatagccaagtgctcccagaaccggccttgttactggttagcccttcagttaaagatcattatctgccaggccatctgttattttcacttaggagagtgtattatttcagacctatagatgtcctttaaatttcccctacatgttgtgtagtaactagatgtagtccaagggtaaagtcccactgtgaacaatgggaatcagagtcccacttttgagagcatttgtgacaatggtataatcttggatggccatgaacccacccttgggagacggggaggggaatctgagaacagtgaaaaatgaaataaaatgagagtctggttcttgccatacagaacagtggttgctttcagtgggattacttgctttctggtgtagctatgcttaagaattcgtgcttcttgctatggggcataatgttgcccctatagcctcttttatgagtgctggctagctcccatcaactatggtgatcttggcacgccacctttacaaaagggagccatgaagactaggagttttcctacctcgcacattcctccttaaccagttaagaaaatgctcagtagactttgccttctttaactggcctgttttccacctgctaaatgagaatgtgccttatgacttcttttcccccaatggaaattgtattgctgaatttcaaaaggcatcaagtcatctctgcaaccctggggcagctgtcatttgtaaagagaatggtttgcattgagtggcttttttatgaacctatattccagtcatatctgaactgccacatcctgtggtacaaggagatgatgatgaggaagatgttgatgacatctagcaagtattgactgacatcctttgctaggtgtgatactaaatattctgtgacacttatcacattaaatcctccttactttacctgtgtaatgcaggtaatagaggcagctcattcacgtatttcaatggacaggggaggaaaaagatccaagaatgatcctgtccactggcatcctgtattctttttgtttgctgttgttgtttctttcattcagctgtctagcttccaaggctgtgggttgtccaggctcccttctctattaccttcattcatggatagtatttctaggagaaaacaggtagcctagcataggtagcagcctagggtgggggtaaagtggaaacagacattgagacttcagcagtgagtttttgctacatgtgttggtaattgatttcagttgtctctcctctgtgttaacctctatgtaaagtctaacttcacccatgtcatgcttttctgggcttcagtttctgcagggttatgggaatgattaagcccttgtagcttaaagcatggacattcttgggagaaaatcgcatgttagtgaacaaatgtgttttagttgtttgtgttgaactagattgtcactgggagcaaataagacacttagaagacagaatgaagtctttcaaattgtcagaaatgaggagggagatgtcaaattttttgctctcatgaaacatgttttaagtaaaatttactataacatctactgtcatgaaaattttattagtatacgacaaatagaggttagctgatttgtagatgatttttcagcaaaatgcctttttcaacaaaaggcatgttaaataatcaatgaacaagtggataaagaaataagtttgtaaatatgggaagggaagtcactgggggttactaacattttctttgtttttctattgtttctaaccttggttatgggggcatttttaggttaatttgccacctttattacatactcaatgattatttactgaatatctcttggggcatcactaacgggtatgggggtgggtgtgttagatacagacatacatataactacataacgtgtggttatcttgatgctttgtgttcaatttttaaaattattttttaatttcaatttttattttagattgagagggtacatgtgcatgtttgttacataggtgtattatgtgatactgaggtttaagcttctattgatcccatcacccaggtgtgaacatagtacccaataggaagttttcagcccttccccccacccttttggagtccttagtgtctctttttcctgtctttatgtccatgtgtacccaagatttagctcctgcttacaagtgagaacatgtaatatttggttttctgtttctgtattaattcacttaggataatggcctccagctgcatccatgttgctgcaaaggacatgctttcattcttttttatggctgtgtagtattcccgggtgtatatgtaccacattttctttatccagtccaccattaatgggcatctaggttgattccatgtccttgctactgtgaatagtgctgtgacgatatgttcaaatattcaacatatcagaatagtccatgattatattggagaacaaatgtactgctaccaggtgattatatgcttgaagatggtatccaatgagacagaaaaaccaaattcagaaatactatcctctcacaattttagatttacacacattgaaactagaatggatttgggatcatcttatctgactcctctttatgaataagaaaaccaaagccagcataacaaaatgatttatgaaacttcactaatcagctgcagagctagaatgagaattctagcctctggcctccaaatataatgctttttttgtttactttttagtttttatgttttaaaagtactatttatttacaataattaaaaaataatgaagctatgcccccatggtcatgccgatttcattgctcttttgacttttaaatattttaatataaaaataatataaaacataatataaaatagtataatagtcatctgcaaacccaccaccaaaaatatgttattttgcatatattagttcagaaaacttgtagaataaaatagagcccattataaatacagtgaaagtacaattcttttctctcccccttcctttccaagataattatcatcctaaaattgctacataactttcccatgtgtattttggtatcttggcatttttactgtgtgtttgtgtgtgtgtgtgtgtgtgtgtgtgtgataacaggcatattcatgtctgtatgttgttgttatctatttgtggttatactactgtttattttaaaattttaaaatacataaagcatagtccatattcttttgtaactttgtttacattcaacattattttgggcatgtatttatattgatacctatatataggtccatttattgtaattgcaggatagtatcatgttgcataaataatccaaggttgatttatccatttttctactgagggaagtgtgggttgtccctgcagttttgccattacaaccatgctgcagtgttccttgtacacgtcttttatgtatgtgctagaatttcttgagggaaattttctagaagttgatcatgggggacacatatctttgttttactagatgttgttaaattgctctacaaactatactgctttatttgattatggagcagtagttctgaactctagctgccgatggcagtcacctaaggagctttttaaaattaccgatgcttaagtcccaccccagaccaattaaatcagaatctgtggagactcgaaaatggtatttgtgtaaagctccccaggtgactgtaacataaaattagggttaagatccactggttttgtatttgtttccccatatcttttccaatacttggaattatctgatattcttctttgctaatctcttagatgtaaggactttctgattactggtgaagttgagtatatttgtctaacgttactgagccttgcattgagaactgtgttatatattagtattctgggcagtaattttgaagggggtaatatatgatttgcaaatatcgacccccagtcaatgactttttccttactttatttaggctatcttttatcatatagaagttaaaagttttaatataattaaatgtcaacatttcattttatggataaaaaatactttgtactttggagaatcttaagaaacatttctccacataatttaataaagttctttttctatgctttcttttaaatgttttactttttctaaatgagatctttatctaggatttgtatttctatatgatggcctgtattatcctgatttttatctctttaggtatgaataagcaattgccccagtacaatttattagtttatcatgtttccaaccatgttggacagcttacttgttttagaagtttgtaaattatttttgatttttaaattaatcattatatatgcaaataatggcagttctgctcattctttagtaacatttatatatttttattatttctttttctcttattgatatcatgattaggaacgcttgtccaatgttgaatagaaatgttgataacaggcatcctgtcttgttccagatttaatatgagacgcctctgactttaaccattaagtatggtattctcttagcatatggtatattttatcaggttaatagcttccctctattccttgcttgctcaaagttcttatcaagaaagtgtttttcatgttatcaaatattttctgtatttattgagatgaacttgttttttctcttttaatgcattaactggtaaattatactaataaatttcctaaaattaaatcattctgctattctgggaaaaactctacttgatcccagttttataaaatatccgttctaaatttagtttgctaacatttcttagaatttttatattcataaatgagacttactcattttatattaactttattctgcctcataggatgagttaggaaagattatctggtttgttctattctatgagactgtttttacagcattagatttacctccccttagaaagctggtagatttgttggccgggtgcagtggctcatgtttgtaatcccagcactttgggaggctgaggcaggcggatcacgaggtcaggagtttgagacaagcctggccaatacggtaaaaccccgtctccactaaaaatacaaaaattagctggatgtggtggcacacacctgtagtccaagctacttgggaggctaaggcaggagaattgcttgaacccgggagatggaggttacagtgagctgagatcgtgccactgcactccagcctgggtgacagagcaagactctgtcaaaaagaaaagaaagttggttggtaaagatttgtctgaaagaatcctatgctctgtgtgtgtgtgtgtgtgtgtgtgtgtgtgtgtgtgtgtgtgaataggctttaactataaattcacttcctcttattattggttaattcagactttgtattgcttctcatgtaattgtaagctacatttataatgaattgaccatttttggctagatcttcaaatgtattgatacaaagttgtttttgatattttttctttttaaaaatctctaccttctctgtggtcatgtcactttttttacagctttgtaatcaaattctgagtatcaaagtagtccaagattttcacaatgcactccagtttttctttctactactcaccataggaccccagcagctaatactaatagtcatttctggtttccctttctctctatttctaacagtgaaaattgagtccattaggcttattttttccaaagaaacagttttcagttttcaaggatattagtaacaaataccctccatagtcagacattaatttagttggacatattcttctatattggcagttattttcctttatccttttgaagatatttcgctgattactgtcatttatttttgcttttgcagaatctgctattgtctacttgttaccgcttggtagctaacttgtgttttgtctctgcctgcttttaagatctcttttgtctttgtttcgttctgcagtttctgctacaatgtagctcattgtggatctatactaatcttcattcctccttgtctcaaagtaaccatatatttaatgaattcttggtaatgtataggcatatatcattaaataatgccaatttataattctattctctttcagaaatttatattaaacgtgttgaattttttgtttgttttatgctctctgtttcttaactttatgcctatcctcttatacaactgcattctaaattgtttccttaaacctgtctttcagatcattgattatgcttcaactttgtctgaacagctgtttcacctatccatggagtttttggttcaattgctatagtttttatttctagatgatgtattgttttaatacatatttttcttttcatatagtatttatgccctttagtcttagtcacttaaaacatgttagataatctgttcttttgttcatttatccaaacttcttagggtccaaagtcccatatttattgtttctggtgatgcagttcttctcatgacagattgtttctgcatgaaatttgtaatttgggattatgagctcatcttcaatggggaatactgtatacaaatatgtagccagattggatatagctagcccttcagagacattttgaatttgcttttaattcatgtcctaagtgaatccttaggctaatttcttaattcagttattcctgaaccacccacatagccctggttataaattctgagtgatactgtctcttcccttcacttggcatctagatagaaacagataggcatcattatggtgcccatttatttggacacttttcactatcctcttatgtccactacataagaatctaaacctaagcttctaggtcactgagacccattaagtccccttaatgcagatcaatatcagtttgtatcttaccacactgctcttaggtctctgtaccttacacctgggtctctctttttgtttgctttctctctttctctttttgcaagtccaataaaacacttgaaaaaatgtctttttgtcagttatttctaagtggttatagtaggaaagttatcaggttctttaagaaaaagaaaaagcagaacaagaagttctactttgaccttttgacctaaaacaaatcatattctccatgcaaaactttcctgctagcttctgtccaaatgtagactgtccaaaaaccagcttgaaaagtattaaactaatgtaaccctgaatgccttacagtataacctttggggatttgtgttcctttggacttttaaaataaatgcagccacagcctggtgtgttgagaaaagatagggtggggttggggagggtttatatcctaccttgaaaaaattttcagggagtatattgcagagaaacagagtattttctgaaatcgtgcaaatgtcttttgcttttccttattgagagactagaagagactttttaaaagttataataaaagtccaaagccctttctatccctggaatcctatgatttttctactgccttgagacatgttcctgacaaatccttttacagccggtgtacagctttgtaatcaaattctgagtatcaaagtagtccaagattttcacaatgcactccagtttttctttctgctactcaccataggaccccagcagctttacagatatgatggggactctattctctgctgttaatgcttctcagatctcattgtccacataatttttatgacatgtcaaagagtacattagcaaacaaaataattagttgattaaaaagaatgtaagttatcgaatattgtataacatgacatatttcacaatacccactgttggaaacttttattacttcctttgaacatcctgtaattttgaaatgttttgccctaaaattctctttggaagcaacatgttagtaataagtcagcaataagacacaattggaataaaaacaaagaattcacacacatacaaaaagaacaatattgcaaatattcttctcatactcaatacccaaagttatttctgaagcctcaccaaattattttagattaagtatctacaacaaattattttttaaaatccatcctttgctgaattttattctgtgtttggattgaggcggagtctgttgttagctgcatgatgagagcggagacgctgaatctttttattttcttaattaagaattaccatctcaggccctggtcagtggtttacaatggcaataatctcttccaaaacagttgttagtctggatcctaagggatttgccagaacattaacctcaattcgacccctcatggttgcaggaggaggatgcaagggtcaataatcatttttagaaaattatcaagcctgggttgcaccctagattatgtaacttgctttaaaaataatgataatgtgtttgtcattttaaataactgggatcagcaaagctaatgaaaatgtttaaatccttatcagttggaatgaatagggctggctccagaaagtgctgacttcaacatttttgcgctgcttttgttgatcctgtctgctgatgcacacgacctattgatgtgcagcttcgcatgccatggggactcattcatccatgttagaagtgaaaggggcttccgggcctctacatgtgctgtggcacattcctctggttctctaacaaagcttttaattgacgtctgtgactaatgagcatgaagtcccaggagaaatggagcacagtcttctaccacccattaagacgagctgcaagttcatagtttatcaagcttgaactgggagcaggcagggccaaagacttgagataaataagaatgaatagtttcattttctactttcataaactggcattaataattcttagctaaagtacattgcatttttagtgttattacctaagctctcgtagccaaggccctcaatggccctgttaaaggctgcatacctcttttcaagagaatcagaattaaccctacttcagctaaagtttagtcggagtgcatttccctaacaaagaaatattttccctctttgtatagggtagtaatcctttctcacctgaagtcatatgggatgaagtaaatgctggaagtgggccatattgagctaggcagaaaggtactaacctcctactatgtacagaaaatgctgatgcagatagttctacccgaaggtttttgttatctttgtcttttaatttatactttcaattatgtgccttactgcagtgtaatagagtcattatgtggattagaggagagccaggatgaaaaacttatagtcattacctgttatttattgtatctactcaagggcatcagagaaataacatcattagaattagtaaattgctaaaatcaggggtaggagttatacttactccctaagatcttagcattaatgtttgaaaggacacttgtaggtctcatttggtcattggtatattatagacttcatacttctaagtggcataagtgagtataaatatatattcaataaataattcaaatgtctttaaagtatataatcattaatttttaactctagaacagttatacttcataatcaataggactcctgccactctcatgattaatcttgattttaaacagcctaccatatgactctgctactgtatgacacctccctaccatatgactctgttatctcttgtcctatatctctgtatctgatcatttcaactaatctatttcagttactttataattgcctcttacccattcctagaaacttgatgtgaattccctttcctcctgtccagtggaccatccacttctcagtttttcacagagttctttttttctttattctttttatgccattccattgacttattattattttgattaagattcatgatcttaggcctcatgtgtctctcatgatcaagggccagattcatgatcataggctgcatgtgtctctgcccacatcccctgtcccgcataacctttgacttcctgtacccccttcctcctttcctaataagaccttcatccttagtatatgcatattcttcagaaacttgttcaccatttgcttctgccatctctcacagaaaaacctttttactcacatcctttcctccttcagtgtacaagttataactcaacctttcaatgaaaacttcctagattgggctattgggttattattattattattaatttagagacagagtttcactctgtctcccaggctggagcgcaatggcgcaatcatagttcactgcaacctcaagctcctgggctactgggttatttgaagtgctactagcttcaaatgtattatatataactcaagcatcacgatttcctatgtaaaaacatgtgtgattggcatgcattgggcatgccatgttttattattttcctggaaccagattataggctattttaaggcagttatgaagtttcatgtcctgtagcatctttttgtgtgcatcaatgaatccttactttgcataatctgtatcaaagcagttaatgatgatggtagtatccaactccatatgtaaaatgaactagcaaatgtatgcctggaatatagagttgatagagtactatggagttcctgcattcttaattgaaaaaatgtcaagaaataaatatccaggaactatcccaaacagatgtattattcagctgctcataaaaatcagaataatgccgattggaattaccttttcatgcacctcatgactcccatatagtaagttctcaataactatcaaatttactgtgattggaatatgtgttcagtaccatataattcgtcaccatcattaacttttccagcaacttctttataaaatctctggctatcttatggttacctctagatttcaaaggccaattggtagacatgactttaaactgacgccttttaatctatgggcacaagcctctaactttccttggtatacttaaaagataaaaatttaaagtttgtaaagattggtgagatagtgattacagttcttcctccagggggaataaaaatacatatctttagattactacataaatgatttagttaaagaattattacagctcagcattactgaatattgaaacatacttgttgaagatatgaaatcactttccttctattttattaaaaatagcattaacatactgagatccaaggtggatttgaagactattttaaactcttcagacctaggattttacattcatccataatagctctgctgttcttcgattacgtggtgtttctttcgaggtatttttaacctgggaacactgaagcaaagatgttcaaattcaaccttggagcttcatctctttcaccaacaacatttacccatcctgtgttatttaaaggccaaatggaaccgttattttgaaaatctgaaaagaatgtcagaatgaacacaatatggagaaaacattttcacaaaaatagtgattccaagtcttgtaatttaatatgcatggttgaatgaacttatctttctcctactccacaaatacagcctaccatatcctgaactgcagccctttggaaaagagacaagtctgtaagttagcgtcccataattatgcccgctgtacatctttatatcccataacaattttctaattaaaaatgaattatttgcctacaggcccgagaaaatgataaaaagaaggaaataattgttctaggtttctttgaactaaaaatgaaatcatttaatccaaaaagaatgatgaaatgcattttagtgggggcatggaaactatcatagaaaggaatagattgtgtacctggaagctgaggaaataaacttttggcatgttctctggggagttaataaaaagttcctcgaagaatttccttagcttgattttagaagtgtatcattagagtctagccctctgtgttagtagacataatcaccataaacaatctccacgtttcagtgacttctcactataaaagtgtggttattacacacagcatagttcaatgatggtccgatgaatacagcatgaggttctgctccatgcactcattcagggacccaagctacttataacatatggctttgctattttgagggcccccaccttctctgcctgcagtccacccatggtagaaaatcacgaaggactgcctgggaggtcttctgggtccagacttgacagtgatgtacctcacttctgccttcatcccattggctggaactcagtcacacagtcccacctaactgcaagggaggctgaaaaatgtaacccagctggctgaaagacgaaaagaaaataggatttgattaacacagagcagtctgtcacatcatcaataattttgagttggagttaataaggtgtgtgaaaaaatagccctgtggttggtcctgaatgccagtcgctgtaagaaaatacaagaccaagtgtgtccatttcagagagctatagctacatattgcctatgagagaacatgctcaattttagaggctacgaggaatataagatgaatcggacattgtctctgccctccggcaggacccagtcttctaaaggagcagtttctctgtaaactgttttctagctgtgcaccgggatgttaaattgaaaatttctactgaggctcccagttctaatagatatgaaattccaaagtgaggtaccagaccaaggtgccaatttccagcggaatatcaagaatgggttctatacatgaaacatttgtcagcataaagaggatatatggcccccaagagtgaaggttaagagaggatttcgtgaggataatttctattttcaaaaagacaccggatgaggctggggggctgtctgccgcctcacctaaatgctaagaagactgacttcaacagtaccattttgagaacttgacacatacctcctggagctggaagagggtagatgtggattgatgactcaaacatgagaaatctggaggaagttacaccctaactggctagttattcagatggcaagagcaaaggaaagttgttgctggttgaaatcagccagcaggagcttgtttcttagaagaatgaggatgcatctaatatggccactgagagaaaaaaaaaaaaatggaacctcaggagagaaaacctttaagtggagcctagatccctaggggctgagaaagaagcaaccagctgaattcagactgcttgcttaacaagaatgaaaagagtaggagaatctctgaggaacccgcacaaagtagtcttagagaaaggatcagtgttaaatattggttaagctgtcatgattctattagtcaaaaaagatcttggctaggcacggtgtctcatgctataatctcagcattttgggaggctgagacgggtggatcatttgaggtcaagagttcgagaccaacttggacaacatggtgaaaccctgtctctattaaaaatacaaaaattagccaagcagagttgagtgcacctgtaatcccatctactggggagggtgaggcagaagaatcacttgagcccaggaggcagaggttgcagtgagccaagactgcactattacactccagcctgggcgacagagcgagactgtgtctcaaaaaaaaaaaaaaaaatgtcttgcctattcctcttatctctcttctttacttcaaccctggggatggaagctgatcaaaacagcaactagtgagtgaaggagaatggacatagacagaaagagacagccaaacatattctttatattgaagacacccatttgcctgtgggcagccatggctgtaaaatgatgaaatgttagctttcagtgatgattcaggtgctaatgaatattgggctggacatccatcctaatttctgaaatcagactgtgttttgtaacctactgtgaaaatagaactttttcttaactaggagtggtcagaaaatagtagttttcatcagaggcaggagaaagagctaaccaaccccttggatcaggcttagaggaacaatgacaggcaaaagcaacattcttttatgactcttgctgacacagctgatttgtacaatatgatgtttgcctttgaattctgggaaagtgctccaggagaagtacaaataaagtactctgggaggtgaaatagacgtcatttgcttctagctagagtacaagggtgtttaaggaagggcttcatggagatgaaggtgtatgcaccagaccttaaagataaagggatttagatgtgcagagatttgggatgggctagtggaggagaggtggctgatggtgcattgttaagggcattttagcagagcaaacataaaaaggtaaggagacagaaaaacatagcagatgcaggtaggagagcaattagttccatttggctgaagccaagcatggggcaataattaaaattaaggtagaaagtgttggcttccagcttgggcaaaagcataagatatgcttgaaacctcagcaggttgtctgcacaaaaggcaaggtatctgggactaggtaataagggcaaaaggagaaccttgtagttgcgctgaccttcacagtaggtagtcagatgtctagtttacagtatccatagtgtccatggaggtattgggtattaattaatttattttttagaggcaaaatctcactctgttctccaagctggagtgcagtagcatgatcagagctcactgcagcctcgaacccctgggctcaagcgatcctcctatcttagcctcccaagtagctgggactataggcacaagccaccacacctagctaatcttttttatatattttgtagagacagggtctcactgtgttgcccaagctgatctcgaactcctaacctcaacccatcctctggcttcagcttcccaaagttctgggattacaggtgtgagctaccacgcccagctgaggcattaatttttatctaattgatatccaagcaggctgatgtgataggttaggtgtgaaaacaaggaagtgtaagcagtgggatgataaattcagtaagttgtgcttgaaggtagtaccctcagcttggagtaagtttgggagtcaaatttctatagataggagaagttccttttctgacaggcagctcctacattctgtgacctccaacaagtaatttgacttccctgaactcctgtttcttcatctgtaaggtggtaataataacatataataaaacaatccacacactcccttctctttcctccaagaggagaaggaggatggagattccaagcagcgggctgccacaccagtgatggtccccgtctcagcaagggatctggaggaaaaatcaggaagatgagacagatgttctgtttcatgaacagaatgagtggaagttgggggaagactttaagtcagtgagttttagctcccgtaaataccaagcttacatcaagaagcacccaccctctgccagttccgtctctgcttgcctccgctgggattggcgtggggactgggcggggctgagtttgcaggttcccagtcctctgtgtctaaagtgctcagggaggcagaaataaaatggataatggggaggagacatgccagccaaaagggcttgaatgttattccggtgtgatcacaggtttttaaggaggacagagctagaggaggggagagagctgacacctgacatatcggtccatgcagcgtggagaggagatggcaaggtgagcaaggggtgggacattcaagttagatgaaacagcacagacctaggcctgaaggcagaaaggattggcaagacgcaggagacagggactgtagtcccagctctgctgcgaagctttctgagttgtggtttctccgtgtatcaaataggttctaagtgacacctcacttatttagaggctgcaatttgaaatctcatctatccaaaattcaggcagacatataagtaagtaaaaactgtctctgggcattctgtataggtattacaactttcatgctgaaaacaggagacagaacttttctccagcttcttcttcaatagctacatacctagtttggagacaattttaacatttgacattctaattactcttcccagagaagtgaagattttgcaaagaaagaggggtattagagtatgagattcaggcatgagagaagggcccactctaaggaggagataaaaggaagcaaaggaattattttcaaaatagcaatatggatccattcggcatcggtacaaagaatatccacatctctgtatgctctggaggtctatgcatatttgtgctatagtttccggcatcttcaaacataatgagtaattgatgcttgcaaagatacttctgagtcatcaaaaaatggataaattatatccagaagtctcgatttctaaagaggaaggggaggggagtggaattttttaaattctagttgagattattagattttttaaactagggatttttgagaggataaattttcattaagtgaacatttatttattcagtgcttatcttttataagttattcttactatgataatgggactataaaatatgaaggctactttaaaagagagagagagagagagatacaccggaacgcggtcaaatgactagtcatcttcgagggtagaaacttacactgatgatcccacctttgctgaaaatatttttatgatttgtattgactgtctacataaccttttttgtgagtttatagtcatgcaaagcaacagcctcctgactttagaatctcacctggatatttacaaggaaaacctccatctccaataacaacatattttgagtctggttcttcgaggaaacattgactgagcatttaactagccctttgcagtaagagggaggttctgcgtggtccttgaaattcactcagagtgtagctgaattgtccacgttattcacaaggcttgttctttttagctgtttacaaaagcattaagcctaccctaaaggtcaagatgttgctaacattgagaagatttttgtttaatatacaatatactctggcatcagggtccaaagtagagaatcaaaggtggcttgaaagatgacggtgtcattaaaataaggtaactcttttgaagggatagcactcatttaatacgtaaattctgacatattcatgtaaaaacatgcatcatgtggaatcacatttgagaggacattggcaactattaatccctgtacaaaagtaaaagaattgttgacatcatcatcatattggagactacctacatgtcaaaaggctgcagaaaggcaggtttgccttcactgctgttggcaagacccatagttccccctgccccaggcagccacgtgtggtgatgactgaatcctgcagagacccaatgactgcaagtaggcatgctctcacctgctccaagccaaatgccagttttgcagcagggcatccctaggcccccaggagattgctgtcttcttggtgatcagagcagagattgacactttgcaggcattttctgctgctgcaccaacactctttggaagttctcacatttgagcaaaactgctattcttgagatgtctagcaccactaatgtgggccaagaatcaaaacgtttgcccagactttgttttaaattgttgacctgagttcaatttttaagcaaggagtttttaaaatagagtagaatcatattattacataaaatgtgacatgccatttgtaactctgctagggtataccaagcctgaacttgaaaacaataaagacactgcgttttatttggaaggttttattatcaaaaatatcctattcattctaaaaagtatgaagtgctaatgcttaggtatctgtttattcccttattaagctgatgtcatgacatcttagtaaaaacacttcttttctatgcatgctcttaaaaaacaagggtttaggtggacatgtgagttcatatttaattcttccaaatgcacaaaagaattttgttgggatattttttgttgcaaaggatggttgtttttctttaacttattttaaaatataaaaataatgtatttttaatgtagatttgaaaaatgcagaaaaatagaaattaagaaaaatgaaagataaacactatgaacgtatagtagcataaggttctttccaaccttagtattatgcgtagttttcttctggacttttggtttacagtatttggttgaatttgggaggtttttgctttttggttttgttttagaggcagggtctttctctgtcactcaggctggagtgccatggtgcagtcatggctaactgcaacctcgaactgccaggctcaagcgatcccccttatctcagcctcccaagtaactgggactacaggtgcacaccaccacacctgggtggtttatgttttagagatggagtctgactgtgtttcccaggctggtcttgaactcctggattcagcaatcctcctgtttcagcctcccagagtgctgtgattacaggcatgagccactgagctggcctgtatatattttttcacatacttgcaattattatgtatatgattagacttttttcattagattatgtgtttttatgttattgtaagctatttgtagacacagttttattgatgatacagttttctataaaatggatattatataatcgacttagttaatttcctgtggttttaaatttagatttcttccattcattaaccaaaaaaaaaaaaaccactccaatgaacatttatatatcaccacttccccctatctggaattaattttttgacatacagtctcagaaatgttactgatcaaaattgtaattacattcttaagaatcttcacacacatcctgaacccagtgtctaaaatgttttttgttttgctttttaaccattttacagttttatatcaaagacttcagtgtcgtgagattttatcactttttaaagctcatgtgacattatggtgtagcttcaatgtgctttttaaaatgttgaatttttgtgtctaattttttaataaggaaagaaatatatgtatgtcctttacataggctctgaatgttttcttaaaattgatgtgatcactgtattaataatagtaaacctttgtcatatttgggtgtacatttttcccaaaagattttggctttttcattttattttagttttctgtataattatttgtatcttttaaagagcaaaatatattgattgctgttatcacttttaagcttaggaattcctttagagatttaatatttacttctacttccctagtttattgaatgttcccatttttaatatatatatttggaatttggtttaggtatatgctataacatataattatacatactctaactagctaaataattattccaaaacaatttacttttgtccatattggtgtgtggtactttttttgagtatatattgatttctcatatattgtagattctgttttgaaattatctatgttgtctcgatcatctatatgtctttctgtatcagtgccaaaatattctaattattatacctttctattatatctcaatatttgttagagtttgcctgcttcattcttactcttttcaatcatgttttcaattgatcatctttgagtaagggcacaagtttgatggtctacccagtctaatatactgggccttccacgaatttactatgtgatattgaacaacttacataatttattttggccttaattttcctatctgtgaaatggagatggtcataataatatccattttataggtttattatgaagatcatctgatttaatatatacagtagtccccacttatccatggggaatacattctaagacccccagtgaatgcctgaaactacagatagtaccaagtcctatatatactatgttttttcctatactatgtttttatacctatgataaagtttaatttttaaatttggcacagtaagtgattgataacaataactagtagtaaagtcaagcaaatataacaatatactgttcacaattttatgaatagatttgttcttcccatagatcttggcaacctcagcatactttttttttttcccccttatcaaattgagaactttcgccttttcacctaaagaaatcactttatggcaatgggccgggcacagtggctcacacctgtaatcccagcactttgggaggccgaggcgggtggatcacgaggtcaggagatggataccatcctggctaacacagtgaaaccccgtctctactaaaaatacaaaaaaattagctgggcaaggtggcaggcgcctgtagtcccagctactcaggaggctgaggcaggagaatggcatgaacccgggaggcggaggttgcagtgagccgaaatcgtgccactgtactccagcctgggcaacagaggaagactctgtctcaaaaaaaaaaaaaaaaagaaatcactttatggcttctttttggcatatccaaattgtcagcaacacttttcctgccctttagggccagtatgaagtaaaataagcttgaacccaagcactatggtacctatacatgacagtcgatctgataacccagacagctcctaagtgactgtgggtgggtaacttagggtagatcctctggacaaagggatgattcttgtcctgggtggaatgaagcaggactgtatgagatttcatcacaccactcagaatggcatgcactttaaaacttaggaatcgtttatttctagaattttccatttaatatttttgaactgaggttaattgaaacatcggaaagcaaaattgcagataaggtggggctgctgtatataaattatctaaaggccgtgcttgacatacctttagtggttgcgaacgttacctcttattagaatttgcaaatagtgatcctattgtctcctttgcaatcattatatctcacttctgtgtcatgtcttattgcattgtcaacagtgtctaaaacaatattaaataataattatggtgcaagtcctgttctggataagagtaaaggcaccgtgtctctcccattgaatgcaactgaaaagcctggatagaatgcatgaaacaactctttgaagactgaaaagtcttctggggtagaagactacaattcaaactaccattgaaatggcaatgagtttactttctttcctccagcatctcccagactcagctcaaaagggtactggtgccaatagagacaccctaaggagaatccccttatttctggctcaaggagcaaaaaggagtctcttaatgctcagagaaagaataaaccccccccccccatttctctcttctttccttttctctgttctttgaagaaggagaacgttcccctccaatcctttgatcaaaggaactgtgattctaagaacctggggcaagtgcctgatggtttcattttctttctctctctccattttcctaccacttggacccagacacagtgtaatcacaagaaatatgccgtagcagcagaataaataaagtctcagattctttgaaagcctcagggaacgaaaaaggactatgttgcagagatattgcagaaaaggaggagcttaggaaggcaatcacttaaagttgtgtatgaactcctgggcccacccctaaattgtgtgtgctttgttctgaccctaagcagcatgcatcagtccttgagaactgaactatgagaatggccactggacgaagatcacactggacacaggaaggtgcaaacacaggacagacgcaaacagcactccaaaggctttgaaatcataaacaattaaattcacattggaatcacaacccgtagataaggctggtcagaaccagcagcctgaacccaaccaggtcatatgtgaacacctgctggcaccttgatcttggacttcccaacctccagaactgtgagacataaatttctattgtttttttttagtgttttttatgtgttttgtgttctaaattttatttttcagcctcaatatatgacattttaaatttttgttgtttataagctacccagtctatggaatttggttatagcagcccaaacaggtaaagacaccaatatatccaaaatattagttcatcatataatcaatatttttaaatgttaatgagatttttttgttttttttttctttctattaagtcttcaaaagccagtgtgcattttgtacttacagcacagttcaattcaggcattagattttcatcagaaatacctgatatgtatttagatttcataaaatttacaattgaaaaaaagtggattcacatactcaagttgttccaaacatacctacgagttttccagttagtgaatcgagtatcaatttaagtttataaattgagggggctacatgatgtgttcctgatctaatcatttgtggctctactttttgttaaattacatgattcattgttcttaagcattatcttcctataggtaagatagtgccaaggcagtgtcttggtgtagataagatggtttccttgtgtctagaaagatgagaagagaatagctggagaaagaaggaagatggacctgttgggtccaatccacactattcgagtgatgagtgcactaaaatcccagacttcaccactacgcaatacatccatgtaacaaaactgtacttacaccccttgaatctataaaaaaataaataaacttttaatttaaaaaaggataaaaatagaagatgctgggaactatttttagaaagacagatgagaggaaagagagttgctgtcaaccttgaacattgtcaagaatttgagaaggataaaccagcctggcctcccttggagtcatgtgaccaagagctgttactgagaaacatcactgttgtccctgtaggtttaatacaaaaagtgactgaaagacaaaatctgagtattgttcttgataataaaagacaggcagatatatcaggaagaggaaaggaatttattaccactgtcaaagaccaagactgcagtaatccacaggagggggaaaaacattaatccataccatgctgaaattattttcgtatacccttaaaaagcagaagggcggagaggacaaatagcagtgagcaatttactggttgtctcacgtagattctttaaggttacaaggagcagagagatgtgtagtttaccttagttgaaagttaaaagtgaaatagacaaaagaggagggacatgtgtccatttctgcatagaaatctcatggaacaggaaagccatttgggttgcagctgtaattccagagaccctctggacaccacagctgcagtgatccactcaagttgttatcccctcagcaagcaatatccatttcttcttttttgagatggagtctcgctccgttgtccaggctggagtctggagtggcacgatctcaactcactgtaacctctgcctcccaggttcaagcgattctcctgcctcagcctcccgagtagctaggattacaggcgtgtgccaccacacccagctaatttttgtgtttttagtagagatggggtttcaccatgttggccaggctttgaactcctgacctcaggtgatccacccacctcggcctcccaaagtgctgggattacaggcatgagctaccaggcccgacctagtatccactttttctaaacctatgccccaccattttggggctaagctacattctgcttctgcttctacttatttgtgctgctatacttattatctagctaatctgcctagtgtatcccatattcagtctcacggagaaccagggtgtgattggttttactggtcaccactgagacagggcagccttattgacatatctggcctccccctaggctagcagcaaatcttttgactggggctcattcctgattaaaaaaaaaaaaaacaaaaacaaaaaaccagttctgaccaggacagcaggatcatatggtaccaggcatctgacctagagatccatcagttttatcagaagagagttatgggcatggcagacactcaatgaatcatggacttctcagctgatttagggttaagtctgtaacccaactctgtaaaaatgaatgtgcatgtttgttatctgcagtattagactggacttaaatctacagaatctagatagaaaagtgagaggaaaaagaatcccagtaataaataggataaatagaattaagctgatcaaaaagttttattacaagaatgattctgtgtttattcatatgttcattccaatcttcaaagcatttttcaatattcaacaaggggctaccttctccatgtgtgaatctcattttaaattatctaagacacagtagcaattcggaagcttttcattgattaacatttggaaactgagcaaaagaatatttgcatgtcatcttgtagagcaaagggcagagggaaatagaagagcagatattgagcaaaaattaatgtagagtgaactctgctaaggaaagaagggatacatgttttaaaatgtgtttataaggcacacacatctgctttgccctcatgctttcatggctgattgcaaagacaagaggggtaactattattgacttaattttgtgattcctgcaaattcccaaagggaaagtaatctaacatgactaattttttaaagtaagaaattagggaatcctgctataaggaccaccggcttgaagcaggatgcgcaatcagtacctttgctgaacagataggaaggagatgatacgtgtctaaaacatgcctttttatagatctgaacttgaaatggcaggatctggagtacaatggcagatcaaatatctttaggacaatttcctatgcttctgctatttttaggtgttctaccctggcttcttccttaagtccccctagcctgccttttattgttctccaagttactcagtatctctgcttttctcttgttagccccacctttctccctcccctcacattcttgataatttgtatatcctgcttctctgtccagttttccaatcctagacaaagagttatttacaactgccaaatggtcacaatggttttgtaaacagggcatttatttgagttaatgattatcatcttatttgggttttcattatagatcaaagaatactttggaatttgatttaggatgagattgaaattcttaaaggtcctgtttcagggttgcatagagagaagaatgcaaacaaagtcttccttggcaggggccagctcttataagacacctcctctgtggttcatacttgttattcctctgacccatttcccgcggtcacacaaacaggtcttgaattgctcaaaaatcgggataacaattttaagcaatctggtcaaggacaatttgttctgttccttattgtctgtttcactctgacttggaggctttgctcacaaacacatccaggtgttgattattggagattagtcagaagcttaaatgataactaagtattgtacacacctgtgcatatggacctcttacaagagctagtctggcagttaattgttgtcaaagaatcatataaatcaaacttcaagaaaggcaaagccagaaaataagtgtttactgagcgtatcagtcagggttctctagagggacagaactaataggatagatgtatatatgaaggggagtttattacggagtattgactcacgtgatcacaaggtgaagtcccataaccggccatctccaagctgaggagcagagaagccagtctgagtcccaaaacctcaaaagtagggaagccaacaatgcagccttcagtctgtggccgaaggcccgagagcccctgacaaaccattcgtgttaagtccaagagtccaaaagctgaaaaacttggagtctgatgtttgagggcaggaagcattgagcatggaagaaagatgaaggccagaagactcaacaatcaagtccttctactctcttctggctgctttattctagccatgctgccagctgattagatgtgcccatccagattgagggtggttctgcctctcccaagtccattgactcaactgttaatctcctttggcaacactcacagacacactcaggaacaatactttgcatccttcaatccaatcaagttgacactcaatattaaccatcacgctgagtaaccagccaaataatttcttttttggctttgtaagaaactttacgtgtacctgataaaagggaaaaaagaacctacttgtagtaaggatcaaccgtttcatattgaattaatcacatttgctcagaaagatacaaaagggttacataaataatctccctgcatgcttttctttgtattttttagtttccctcaaagcatttggtcacctgaagaaacttcagaagttgcccattctaagtttttaagttatatgaagcatatgaagaaatagtctcttgataaagttatttttactatttaatatctggaagagaatccaggcaccagagccatcaatttgatctgcagagaaactgagtccttaattggacacaatttaattatcatcaagcatttgttaagaccctgattgaaatgtccagcaagccagcctgggcaacatgacgaaaccccagctctacaaaaaatacaaaagttagccaggtatggtggaacacgcctgcagtcccagctcaggagatggaggtgggaggatcacttgagcccagaaggtcaaggctgcagtgagcggtggttgcaccactgcacaccagccgaaatgacacagagagaccctgtctcaaaaagaaaaaaaaaagaaaaaagaaatgtccaaggagaatgcaataggcccagcctttgtctgctgtgctgatggaaggagacaggctaggataatccacctttccacctcccaaatatccctctaccccatctcccaaagatggagagacaaagcagtcacaaaacaggagaggaagagaaagtcaaagagaaagtgtcttggaaaatatttggtccttccagagaggtttgagcgttgctcgtatcttcaacatcaaaatgtgttactcgcacatttccgtgttcctaagaatcacttaaggaacatgtttttgttttgttaaaaaaaaaaaaaaaaaaaaaaaaacagttcccagagattctgattccagttcaaaattcaaatgatttggtgaggccccaggatttgcagttttaattaccctttctctgtgaatctagaatggtttgggtaatagcttctgctggttgataaatacagaacacattgctcttttctaccatgttttcattgcagacatcaaagaagtcttctattttcttttgacagtttgaaaatgtaatatttttatttttgcagttcagtggggacaagggagagtgaagagtagattgtctttatttccctaaacacattttgtttcataggaaaagaaaacctcttttaaagtgatctatattgtcaatgtttagagagcttttcctaaccttgaacgcaccactttgagaattctttgaagaggccagttaatatatctgagttttagagagtagattgtccaacagatgtgctatgtctaaattgtggtaaaatagccacaatgtcagaaatgtgtgctgagtaaaatcattagttatttgaaaaatgaacttttggccaggcacggtggctcatgcctgtaatcccaacactttgggaggccaaggcgggcggatcatctgaggtcaggggtttgagaccagcctggccaacatgacgaaatccagtctccattaaattagccaggtgtggtggcacgtgcctgtaatcccaactactcaggaggctgatgcaggagaatggcttgaacctgggaggcagaggttgcagtgacccaagaccatgccactgcactccagcctgggcaacaaagtgatactctgtctcaaaaaaaaaaaaaaaaaaaaaaaaaaaaaagaaagaaagagaaaagaaaagaaaaatgaactttctaccctgtgtctagattcgcattttcaattatgtactttgcaagattcaaaataaaagctattacacttagtgcatgtattaccaaaccactgctttttaaaatataaggttagaatattgttttaagtatggtcacttttgagcgtataagcccaaaagaggcaaaaggttttttctcctgttttctaaaaataagttgcctttgaataaaagccatatatggatatttatccctaaaggagacttttttttcttggttttaaattactgaaactattttgcattcttaactactgcattcattactatgaatagatttaaaatttttcttgcacaaatcgaaccgagttttatagaacacttatgtagtattatgtagaattgctacttctgatgctcatcttttacatgtaaatagaaagatacagttttgtaaagctaaaaaaaaacctaaagttaagcttagtgttttttttccatttacttattgatatggtatgaatgtttgttccctccaaatctcatgttgaaatgtaatccccagggttggaggtggggcctggtgggaggtgactgggtcatgggagtggatccctcatgaatagtttggcgctattcccatggtaatgattgattgagttctcgctgtaagttcccgcaagagttggttgtttaagggagcttgacactgcctcctcactctcttcttgctccctctctcatcatgtgatatgccggcttcccctgtgccttccgccttgattgtaagcttcctgaggcctcatcagaagcctcacagatgctggtgccatgcttgtacagcttgcagaactatgacccaaataagccctctgtttttttacaaattatccagtctcaagtattcctttatagcaatgcaaaatggactaacacacatcatgaattgttttggggaaagatagatatatgttattttttaatctgaatatatgtttctgtttctatacaatattcattcctgatcctcagatcttaatccatgttacatatcttaaaatgatatggaaacttctgtgagttttttactttttgttgacaacagataagctcattctgtgttgaggtgagaatcttggtgttggcctgacctctgcttactgcctgacatcccattccctatggaatcacagttaaagtttcctgaattttacagaaatatatgaattatttgatagaactgacagtttatagaaaagtataatataaacaacaatttttttcctcctcaagaatggttttatgttttttgtttttttaaaggcagagtctcactctgtcacccaggctggaatgcagtcacacaatctctgctaactgcaacctctgcctcctgggtttaagcaattctcctgcctcagcctccccagtagctgggattacaggtgtttgccaccatgcccgactaatttttttttgtacttttagtagagacgagtttcacccatgttgaccaggctggtctcgaactcctgacctcgagggatctgcccacctcagcctcccaaagtgttgggattacagtcatgagcctccatgcctggccctatttttttttaatgtaagaaaatagagtcagcttgttcataaacaggcatcagatgttgtgtgtgtgcatctgaagtggctagaaataagaaaaaaaaataaacaaatttttattttaaataaaactaaaaatgggagaaggatgaagggaagttaaggagtacacaaatacacttagctagaaggaataagatctagtactcaatagtacagaagagaagttatagcaaataatttatatttcaaaataactacaagaaatatttgtgatgttctcaacacaaaagagataaatatttgaggtgacgcatatcccagttaccctgatttaatcattacacattgtatacatatatcaaaatgtcgcaatacccccaaaataagtgcaactattatatagcaagtttttttaaaaaacaaaaggagcaataagaaccagaagacaataaaatgatgtaaaattgagccagatgtgaaaggaaaaacaataaagcttaaaacagaactaagagatattctgtatttttcttttttctttttcttttttttgagatggagttaaacttttgttgcccagcgtagagtgcaatggcgcgatctcagctcactgcaacctctgtctcctgggttcaagtgattctgctgcctcagccttctgagtagctggaaatacaggtgcacgccaccatgcctggataattttgtatttttagtagcgatggggtttcaccatgttggccaggctggtcttgaactcctgacttcatgatccacccacctcagcctcccaaagcgctgggattacaggcatgagccactgtgcctagcttgttagaaggcagtaagaccttgtcaaccagtgtgaccatatttaaaaagagaaccatcattgagaatccgtttaagagaatgatcatcttaccttcatacctccagagactagtctgattctgtctcactgtggagtatgggccagaccagagaaggtctgcaggagcagaagggtttgttttgaagccatcctggaggagtcctgatttccaagcctaccattccctccctcccttcttctattctttcaattgtcctgatagagtgtaagtattagagctctcacttgtcaggacagaaatcaaaataaattggcttagggtaggagtttatagataatcaactggatatgcagtaaaatagccaaggacacatcagcatcaggcatggctgcatctgggatccctgaagtcctcattaggaatctcccctcctcccagcatctctagcttctgtgtggcttccttctcggtagctgaattatctgatagagctgaagttcattaaagagcataattttcccatgacagtcttgatcactggaactgaagagggttagttatctttccccagggggtactgaggcagcatgctcctggctgtcattcttgaaaattccagttcacacctgaaatggaagggaatgttatcctaagtggccaggagtaggatatgcctgagagtgagacttagggggctagagaagctgaaatctgactcccgttctgggagacaaagctggaggaacagaggccaggtgtgctaggagctgagcagggaaggatagtagagtcaggggcaggaggcgcatctgagccaattgctgcaagtaagtataggaatgtgcgcttctcctgttgttcatttactttttggttgtagagggtgggggaagaacatattaaagccagacatcacatgcttcatttcacaatagttgggctgcttggactgaatttcacatattttatctcattgaatctttattttaaaaatttagagttagcaacattcatgattaaggataaggagactgaggatttaagagactaagaaactaacccatgggcacttatgctgggcaggtatagaatctgactagaggagagattttcctggagttcattcactgagtatctagtatgcatcgggcatggttcaaggttctatgacaggcgctggaggaaggatgttccagccacatcatacacggcgttgtaagaattaatgtactctaggtgtgtgtgtgcttcagagttgatgcgtaagaattcagaaggacttgaggtctctctggagagagaatgctctcttagctcaagaaacagtatggccgccttcttccctgctgaaatccctccctgaattttgctgagtggtaccacggaaggccccttgctagatgcaccactggctctttgtgttactttattggagaatcatagccttttacagctacatagacttagggggaggatttaaccaatcctctcattttacaggttagagaactgagggccagatgggatgagtggtttacccaagatcacacagctggttagtggcaaagctatgatatgaatctcatctaattccaaatcctttctatgctctatctgtactcttcccaaccatttaagtttcatgtttgaatatccaaaggtaagtttcttgttgttaaccagagtagttaagttttgtgaccataggtcagacctaacattctagttctccttcctcccttccccgctccctccctccctgcatggctctctccttctttttagcctccactatcttaagaatgctttggttcttagatatgggcaataacctctctctttttctgtagctcagcatttagtattcatgcagcgagcatatgattttttcctgatgtatttttatgtattttaaactctggtttgactagtctacatttgctgtaaatgcccagattgcaaatggtagcaatgtgctataaaaataaaatattcttattgtagtaaatatccacagatacagaatgagcgcctgttttatctccatttcctttccttctcatttactggctaagtacttagccttttaaaaacctttccgtgtgaatcagtatgtaaaatatttgtcatgtgtccaaactgaaagttaatgaattacaaaatattcttattttgtgaaatagcattttatctctttgtgcatgaagtacacagaaacaggcagtggctttaagtgtgatgatggtcttcacaaagcagagattatgttacttctgtgagatttctaaatctccctctatatccagtaattctctccttggactaaatagggcagaacatattacatcttttctatccattgtctaacacgtaaataaactttactatcttgtactttctattcccttaaaaaaaaaaaaaactctttgtaaagaaagattgtgctgatttattttaaaagcaacactaaatctttcactatacaaggaaaactctaaggttgaacttttttcttactaaaaacgatctgctcctagatatggtggaatgcttgctttaatcaggaatacataagtcttaaatgactaatatagaagagcaacaaaatccactcattctgaagttaagaataaatgtaataacagtcttgtatgcaacaaaatcctagaaagtctacaagaagaacctattcagaacagtgcctgctgggtgcaaatcctctgttctccagctttagatcctactgtcaaattcatgaactactagccttaggtcagtttgcccatcacaggacttcactcctttttaccatgaagtctgactgtggggctgtctgtttcgctcctgggttgattggctacagctggtcttggaagcaaataactcttcatataacattaagggctgcaaattcctacaccctaggattcaccaacagctgagacagcagccgggaagggttagtttatacttttgagggtaagaacaccacttgtggttatgtctgtctggaatcatattctgtgttttcgagagacatttaactctaaacattggaagtaataaaaacatgttctgtggttacatggtaccatatgtctttcagaaggcacttggagctttacacatttgatctaactcatttttatttcaccttagttttaagaaggtaccttgtgtaactttgttcttactaatgtacacatacacataatttatagagagccggagaccgagctactaaggttttaagcagcctattataatccagtcaaggctgagagttgaatgaattccactgacctgtatattgttctcaaacttttgttatctctttgctagatcactgctttctcattaaatgcattgttattgaattacagtaatggaagtttcagggctttggaagcagttaacccatgtgtcactcctgggccagtgactcttagttgcatgatatacagcttcccatcaaagccttagtttgttcatctttttggtattttttaaaaagataattcccccgggcttatgcctgtaatctcagcactttgggagggtgaggcaggaggatcacttgagcccaggagttcaagaccaacctgggcaacagagtaagactgtgtctctacaaaaaatatttttttttttttttttgagacggagtctcgctctgtcgcccaggctggagtgcagtggcgggatctcggctcactgcaagctccgcctcccgggttcacgccattcttctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccccgcccggccaaaaaataattttttaaaaaaagtagccagacgtggtgacacacgcctgtgtcccagcttctcaggaggctgaggtatgaggattgcttgagcctaggattttgaggctgcagtgagctgtgatcacgccactgcactccagcctggctgacagaatgagactctatctacaagaaaataaaaataaaaataataatgaagaggataattcctacttcctgacttattggaaggattaaataagataatataaaagcacttagtgcattgtgtgatgctgcatacctgaagcacctggagtagccaaattcatagagatagaaagtagagaggagaggccgagcacagtgactcacacctataatcccagcactttgggaggctgaggcaagtggatcaccttaggtcaggagttcgagaccttcctggccaacatggtgaaatcctgtctctactaaaaaatacaaaaattagctgggcatgattgtgtgtgcctgtagtcccagctacttggggaatattttatttcccagtctctgaagttgtctaatcagaatagagaatactccttgaggaaggagaattgctttcacctgggaggcaaaggttgcagtgagccaagatttcgccactgcactccagcctgggcaacagagtgagactccatgtcaaaaaaaaaaaaaaaaaggaaagtagaggagtggtagccaggtgtctggggaaaagggaatggggagttagcgtttaatgcatacagagttccagtgttgcaagataaaaagagttctggagataggtgatggcgatggttgcagatgagtgtgaaagtacttaaggcactgcactgtacacttaaaaatgattacgatgataaatgttacggtatatgtattttaccacaataatttttttaaacacttagtgcactcccaaacaactcctgttaacctgctcctgcctcctttcctagtcttcctttttgcccttgacaaatggctgtccgtaactggagataggatcaggggttatctgaaactctctgagttgggcaacttggatagatccacagaaccctagttagtggtgctggatccacagttgagaaatgacaagtacttagagaacatctaagttccacatattcatattatacacaagaaaactgaggtctggaggaattgaatgatttgcctaaaatgacacagcaaatcaatggcatagctggaaccaagacccaagattactaattttgagtccaatttgcttttcaaaaaatgtcaggggccgggtgcagtggctgatgcctataatcccagcactttaggaggccgaggtgggcggatcacctgaggtcaggagttcaagaccagcctggccaacatgatgaaaccctgtctctactaaaaaatacaaaaattagctgggctcagtggcgggcacctgtaatcccagctactcaggaggctaaggcagggagaattgcttgaacatgggagatggaagttgcagtgagccaagatcaagccactgcactctaacctggtgacacagtgagactctgacttggaataaaaaaaaaaatgttaggtttgcaactgtctctggggatcatttgggccactctgtgacctgaagttgagctaagagttttctctattctgattagataacttcagagactgggaaataaaatattcccttgacaagaagttgttttaaatagcttatttgaagtataaatgcacacatttatacctttagtaactgcacacatttaaattttcccatttgataaacctcaacgtatgtatataccatgaaactatcaccacaatcaaaataatgacaagtccatcacccatttttaatgtttttctccatcatacctcatcaccaggccatcaactgatctctgttctgtcactagaaactagcttgcattttctagagtaaatggtatcatacatactccatttttgtctccctttttcaaccagcataattattttgagattcatctacatttttgtgtgtatcaataattcatttctttttactgttgagtagtagcctattgtttggatatgccatgatctgtttatccatttaaatgttgacgtatatttggtttgtttccagtttggggctattgcagataaatccaatatgaacattcacatagagtttctatatagagatagaattctgtattaaccatgtgtttctgatattttgacatttgaaaccttgctgatcttagagacattgcctctcccaaggtaagccagttcctaaaggtaacaagactcacctgccaacatcacttttatacataaactaaccagtccagagcctggaatcccctactgcctctttgatcagactcttacactctgggccactatccaccttccctaatcaccccagggctgagtaccagaaaactaggggcaatctctacaccctagagccggctgaaactattcaaactagccagtcctaagctcatttattcttcttatcctgcctcacacattccttcctgcagaaaccacataaaggctcatgttttcccctggctcttcttactcaggactgaccttgtgcttgctcatatggcctctttgagtgtcatgcttcccatttctaggaaactgtgagtaaaacaacttccttcacaacagtcatttctgtgtctgcatgtcttaacatacctgattaaagtacatcttaagtacacttttaaacactcatttttcttgaataaatcctaggagtggaattgctggatcatataggaagtacgcgtttcagtttttaataaattacaaaactgttgcccaaagtgcttgtccatttcacattcttagcgatagcatatgaaattaccagttattccacttccttaccagactttggtatgattagtctttttaattttagccattctaagaactacagtctcattaatttgcatgcccttaatgaacaattttgttgaatattttttgtgtgctaatttgccatccttttatctttcagatgtatccatagaaatcccttgcatacttctttattgggttgtttattttcttactgttgaaatttgaaagctctttctatattctagatacaagtcctttatcagatgtgtgttttgcaaagaacttcccccagtctctggcttgtcttcttgttctcttaacagtgtcttttagagagcagaagttttacattttgatgaagtcaatttgttcttttatggattttggttttggcatcatatctaggaaatctttccttgacccaaggtcacaaagattttctcccctgttttcttctagtatacctgggatttgtaaagatatatctgagagaagatacaaggatggcaaattagcacacaaaaaaaattttcaacataattgtttagtaagggaatgcaaattaatgagattataactctcagtatagctaaaattaaaaagactgattataccaagtgttggtgatgaagtagagcaactggtactctcatatgatatttctaagaatataaaatagaagttcctgatgcaatggcagcctttgccatggaactccaggtgcctgcattaggatctgaaccaatgatgctggcttcatctccaaagccaggagttaatgcccagttcttacctggattttgaatgtggaatttgccagccctggtgactccacaatctcgatcaattagtggcccttcagtaggagtagtggaaatgagatcacctttacttgcaggtgggtcaccaccacaaccagttttactagctcataaagataaaagtggcgctccacaagttagaagtatatatgatgacatttctagcctgggatttggatcaacacctttaacttcaagaagacagccaaacatttcatgatgcagagtcctcttactggagttacatctactcctggaacagggcaaagtacgtttagtccagcaaatgtcggtcagtcatgaaagatgacattttctccttcccggttggatcctttttatactcaaggagattctttgacttcagaaggtcaccttgatgacacttgggtgactgtgttcgggttttctcaagcctctgcttcctacatattattacaatttgcacagtatgggaatatcttaaaacacatgatgtctaacacaggaaattgaatgtatattcattatcagtctaaactgcaggctcggaaagccttaaccaaagatgggaggatttttagagaattcatcatgattggtgtaaaatcctgtattgactaaactgtaatgggaagcactgacagacgtgctttatcatctccatctttcgcctttacaccaccaatcaaaactttaggtacactagcacaacctgaaagtactcctaggatttctgccatgagacctcttgctacagcatacaaagattctactagtgattatcaggttatttctgacagatgaaaatcttgtatccaaagcaatggagtacatgtctggccggtagtagaagaccaaggaggaggttgttacactaaaacagagttagcagagtgctgctggttccttcggttagttatataactgttcctgcagtattggacagttatacttcttttaggaagaagcctttttcattaaagatacagcctatttgtagctcacactttagaagatgcttgagatacattttaaagaaaactaaaaatccctgtaaatagaattttgtgctttctgtaacagtgcatgcttcaacacagaaaactcagcattgattattgtaaattaagtaactgaaattctggtgagacttcatagtcttcatgagaaggtgggggtgaatttcataaaaggggactatagttatttctaccaagacacaaaggttataattagcaatttgaattatggtgttttaatttagatagtatttaatattataattatccttgtttgtatatgtcctgtcacagagtgttctcttggtgtattaaaaaatcagcattcttttaaaaaaacctactactacagtttcttcataataaacattgtcaatgattttaaaaagaatataaaatgggacactttgcacaacagtttggtagtttcttaaaaacttaaacacataggatccagcaattccactcctaggattcacttaagaaaaataagtatataaaaatatacctaggatttgttttaacagttttgaaggctgggggtggtgactcatgcctgtaatcccagcactttgggaggccgaggcgggcggatcacgaggtcaggagatcaagaccatcctggctaacacggtgaaaccccgtctcaaaaaaaaaaaatgcaaaaaaattagctcggcgtgctggcagacccctgtagtcccagctgctcaggaggctgtggcaggagaatggtgtgaatccgggaggcagagcttgcagtgagctgagatcacgccactgcgctccagcctgggcgacagagctagactccgtctcaaaaaaaaaaatagttttgaagttttaggttttacatttagttctatgatatatacagtgtctatgatacatatttaggtctatgatatatatagagtttttatctggtgcaagatacccattgaagtttgtttccttctttgatatctaattgttctagaaccacttgttgaaaagcttattttttccccatagaattgcctttgtacctttgtcaaaaatcagttgtctatgtaatattagtgtgggtatgtttctggattctctagtctgtcccattgatctatttgcccatcttttctctgttaattccatgctgtctggattacgataaatgcataaggcatgacgtcagttagtgttagttctctaactttgctcttctttttcaaaatcgttgtggctattctaggttctctccaattaatgagcattttgatatcatttaaaaagcatttaataatatcttgtcaatttctacaaaaaaaaagccttctggaatgtttataggaatacatcaatttaggcaaaaatgatattttagcaatattaatttttccaacctaagaatgtggcatatatctctccatttatttaggacttctttaactttttaagccatgttttatactctcggtgtacatatagtacacatcttttgtgaaatttatccttaagtatttcaagttttggatgctatatgaatggtatttttttcttaatttcaattttcaactggaaaaaaaccttgttacttcaaacttgaatgctgtgtttccatagagaacagtaaaacaatagtttccctgttctgttttggctcctatctctctaaagaagttctgcaaatggattttcctctcggcctttcaaactaaatgccaagagtcctataatgaggctgaaaatgtgaccatattgcccagaaggagctaactgtgctgtcctcttttgcaaaagcagctgaataaattgagtatattagagacacaaatttctaggacttgtaaggattctgtcaaaaatgtgtaacagggatgtattactcttgccctgagaacttcaacttttgcacttcctgactttgctgtggctaaaattgaaataccaaagtggtattccccaaagtgtttgaatttaatagcattaatgactaggcccctacaagtctataaattcttatttgaaaattcagctattctatttgtactttctgtgagtgcttgacttttagtttcctacctgtaaacttttcaaaaagcaaataacctcacctcagacatcaagtccttgtaaggagtgagtgagcagccctacctccctaaagaaacagctatactcaggagaagtcttgtggtttaaatttagctgggtcttatctccttctattccatttaactattatgctctcagagccttggggaaacatgttctgggaaactccttcgccataaaatgttaagaacagagagcaagttaacacttctaagaccatccacatttcaaaagacagtaattctaatgtacaggcattcatggtaatggtgggtttcaggcattgtgggaaggagagacagaacagcaagagagcctttcagcatcccctgtgatgtcatcattagtcttgccttttagatgatctggtccaaccttcacctctgactttgtgaacgctgggctctacgtcctgaaatacactattaacacacacaagacttttctgtccctgtgtctccaactatgtgacaatggatcatggattttgttttgttttgttttactttccacacaggaaagttgagaaggtataaagatataaagttataaagatataagttgagaacacaatactcaaagtcgcaataaagaaagttcaagtctaggttgagttgacgctgttaccattattcaaccccttccttaccacaccagcctctcaggcactggcattatttggtgacattgattaagcctccactgttaaagctttgattgtccgttatctttgagattcaatgttgggaaccaggaaggacacccatagagacaagaggaatgtagaaccaagctcagctcttctcctgaatgaggcataatggttcaaagtagatggataagaaatgatacgagctagatagaatcactttagaaaagctttatgaatctgatgagctcaaacttaacaatgaagaaggaaacagatgcagtctagcagaaaaacaaaggaggtatatctgaggtgctcagtgatgctttctagacccaaagcacaccagcacaaataaatcccactccccaaactgcaagtattttgaagtgtccacagccctggaactggttaagaaaatatcaaatttgggttcaaaggtactttcaaatatcctttctacagaatccagaataaacttgtaacagggcagggaaagaacagcctctggaaatttccagtcctccgaaagcataagacagcagcaggagactgtgcatgtttaaaggaagtctgcctaaagccatgctttgtattcactactctctgtgaacatcaaactgctgccatgcctttgttgcagttttgccaagggaagttgagcacaggctaacagccgccatgaatcgtccttgaggaggcgttgttggcatttggcagaaacattctccaacctcttcatccctgtggcagagcctgagctcaggcaggccctggagcaagcaggtgtctgtctctcctctgtgcaaggagtgagaaggtagcattgtcactaagtaatgcagcccatcacatggtacctgggatgatttcaaggaattaaagcacaatgcctatattagttatctgttctgcacaaaaaattgcccaccagaatagcaacatgaatcataaatttttattatctcacagtttctggatgttaggaatctgggagcagcctagctgggtggttcaagctcaggatctcttgtgagattgcagtcaagcttttggctagggctataggtgtgtgaggctaaaagatctgtttccaagctctcttatgtgattgtgggcaagactcagtttcttgctggctgttggctgagtgtctcacttccttgctatgtgggcctttccaaaggctgcctgagcaatttcatgacatagcagctagctttcccctgaggacatgatccaagagaaaaagaccaatatggcagccacagtcttttacaatccatcttggaaatgacatgggaaaaaatcacttctgttatattctattggtcatacagaccaactctggaacaatgtagaaggggagtgtcaggaagcaggcatcactggggaccctcttggaggctgcctaccacacttctcatctaacagtgctaagaacacagttggccccagccttcgatataatgtatatcaggtaacactttttagaggtactgcaatgcagtggcaagactagtagactgctagtaaagagattttgattcaagttcaattctgacaatcaaaaatgctctgtgtctttggaatgctggttaacctttttgcccatctgttatctcatctgtaaaatgagactattgtcattaatggcctcaaggatgtctctcaactctcaaattccatctcttcattcatatatcttaattgccattaagaaatgtgccatttcaggcatgaaagttatgaaggtgattttgttttacaaaatggacaattttccaatgagtttcccttgttttaaagtaataaaccaactggagaaatggcaccctagagttttcttgaagcttatttcttttccgttcattattcatactttagtaagtacgcctcacaataacatactgttatttgcatgatgctttaaagtgtagtacacatattctacatatgcaagtgaattcatctgtaaaccacattaggaaggtattaggcttggaaagccttccagcttcattctcccattacctagtggctggtgtttgcatgggtggcaatttggccagaactacaatagccttctaataaagacactcccaggcacatggcccaaatagatgggtgaaaaaggcttcctcctgtctgaaatctctaagtctaagtgaggcacagtgacacatacctgtagtcccagctacttgggagcctgagctggaaggatcactcactatgttgcccagaagtttgagtccagccggggcaacatagtgagaccctgtctctaaaattaattagtttaattaaataaaaaataaatttctaagtctaaagagacagctgcagtggcctaccatatatagagtagactagcaatggaatgaacagtgaactcttcatctcctgtactagcctagagtgagctaaggacaggggacaacctcttgggagactgaacttctaagatgagaataggaaagccacccagttgcttatcgtttaattacttgaacgagatgaacaggcttccgccccaggacatttgtacttgccctgcctgggaatcacttaggttcacttcaaggatcacattttcagattagctttctctagccactaatcttaagtgacatcctctcccctacaggcattctctaccacaccctattttactatcttggtagccctatctaaaatcatctactggtgtacctgtttcaagagttcgcctccaatagagtgtaagctgtctgagagaggtaaccccatctatcctggttactgccacatctccagtctggaatagttcttggtgtagagtgggcactcaataaatatttgttaaatggatgaatgaataggtcagtctgaaaaagcttgtagtttgatggatgtgagtttcaggagacacttagatagtagtggaaaagaatattaaatggacctattttctgttcccttggaatgggcaagtaggggtgaaatctgagaacaaagagacttgtgtatcccacgtaattaagataacccccaacaattgggagcagacacccccctcagggattctaggtggaaaggccctgctatcagaaccagttgtgccccaggaagaaaagaagaagagagaataatatttctgaactatttgggaccactcaatggatgccatgctcattgtgacaggggatactctcccctggagacaggaagggtgccttccccttcttgaagccaagggaagattgcattgaagagaagagtgctggcaaaagtggaagactggtacctctttggctgggcagatgtctgcttagggagcaaacaaacagttcagttcctcagctttgttaacctggggaaaagcgaataagagaaaaatggcagagtaaagcaaagagaagtggccaggaagccaactgtacttacactgcatggaatggcaaggatggcggtgattcccacatagaccatagacaggctggtgccatcttgagagttctccaccagcccacaaggctcccaagtttcttagaggatccacttgtatctgtaagggtggaagagtattgctgggaatggaagaagttgaataggagcctgacctctcacctccaggaactgtccgcaccctggtctggcacccaagatccatatgtggatggctgtcacacaagagatgctaggaatgtgtcagtgttagtgcaagatgcaaaaaacagaaaacgaaaaccacccagagaggattcgcctaatccctctccactaacccagacccaccaaggagcaagattttgaatggaggtggaggtggaggacccagaagcagaacattttctgtacccatggggtataccctgagccatcgcccagcctgcaccagagaaaaagagattagatttaagctggatacaaaattcgagttttaaactggcccagactttttgtaactccaagtgaccacaagtttataggatcttgctcaggtatcattaaggaacaggaaaatggtatttgacagggcatggttgaaggccataactggaaaaattaaacaaatgaaactatttcatgttttcaacactgagttcaaactatccaatctcctaactagagcagaaaaaaagcagtttgctgaacctttagcaagagagttcttcaggcatttgatttatctttgggtgaactttgctggcttttatcagtggccaaggtgacaagacagtttataaaaagcaagactcaagacacacccttggtgctgtagactcagttgcctttcttcttccatgctccatcctcctccccacctccaattttttaagagtcaagagagaaaaggattaaaaacttattttttgaaagtcatttttctgcagcttcaaaggactttttagacatttggacaaatcgtttttaaaatttcaaggatactttttaataaaactgagtgattgaaaaaaaaaacaccaccctcatttcctccttccttgataaataaatcaccttaataaagaaatcacctgtgagattgtttctgagtgggcgtacaacctaggaaggcatttcctgtggctgttgaaaactagattaaaagaaaatgcactgaaattcatgttaagaataatcttggttgttgattaacgggtacaaatatacacttagataaaaaaaataagatctggtgttcaatagatcagtagggtgacaatagtcaacattatcaattgtatatttcaaaataggggccagtcgtggtggcttactcctgtaatcccagcactttggcaggtcaaggcgggtggatcacttgaggtaaggggttcaagacgagcctgaccaacaaagtgaaaccccatctctactaaaaatacaacaattaactaggcgtaatggggcatacctgtaattccagttacttgggaggctgaggcacaagaatcacttgagcctgggaagtggaggttgcagtgaactgagatcatgccacttcacttccagcctgactcagtctcaaattaaaaaattaaaaagttttaaaaagctagaagggcataattcagatgttcctagcatatagaaagcataaatatttaaggtaatggacatcccaattaccctgatttgattatatggatgtatcagattatgtgctataaaactatgtacagctattatgtatcaacaacaaaaaaattaatcatttttttaaaaaagaataattttgatcagaagaaacacatttcaggtgctgatagctggagaagaaagctgctttggaaagggatggcagcgaataagttaaaaattaagcataccccctttaggtttcacataatctctttttaaaaggaaaatatatttcctgaatgattaaaaaacaggaagcacacttacttttttaaaaaatatattgaatgacagtcaactggtaagattcctttctgcttggacttctctagtctttgttttaggttctctccttttcaaattcctttcatctttctgataaaaagcactgaataacaaaataacacttacttagaaatattagaaaggtttggtgtgtatgtgcgtgtgtgtgtgtgtgtgtgtgtgtgtgtgtgttactttagatgttacaaaaatatgaagcaaaccaatgccctatatttgtcctctcacaatattgtaggattcaaaggtgtcatagcattggtgaagtcatttgttggtaacagcacaaactcaggatgtctttatctttcctgtagttctctacaacatgtgcaaactagagcccaagatgtaaaggcctcctgtccctttctagcagtcaaggggtgattatcttttagagggacagactcaggccctctcgcttctgagagctaagtgtttttccacctttacccaacttggacaactgtgaagaactctgtagccttccattattatgtttatattcatgaacaaaactctttcctcactgacactactcccctccctcacacaaactcaatgttttctagtgatcatttagaacaatacaggcatgtcttagtctgttttgtgctgctgtaatggtatgccacagagaaatttattggctcataattctagaggctgggaagtccaagatcaaggggttggcatctggcaaagtccttcatgttatgtcatccagtggtggaaggagcaagtgagtgcaagaaacctcaagatgggagccaaactcacttttataacaaacccaatcctgagataacgttgcccatccatgagagcagagccctcacgaaaacatctctcatgaggccccaccacccaacagttttgcactgggggttaggtttccaacatatgaaccatgacctctgttaatggatagaacataaggattctaattctggcagattcttcactctccagatattactgaacttgaatcctggggattgctaggggtatgtgacacaaggacctaaaaattataagatttgaattattcatcacaatgataaaaattatgaccatcaattaagcgcctctagatgtcaggtcatagaggtataggtgtataatttttaatcctaaagcttacttataaggagggaatattttttcagacaagaaaaactgaggctccatgaaagtagtaacttgtctaagcatgcacaattagaaaacagatgaactgggattcagtcctgagtttgactacagcatggcctctgtccaaagaaaactcttaagcagaagctgaaatccagcagaacatttcctctgtgctatggagacctttgtgagacagtgggggtgtggaccattctctccctacatgggacacctacatttttcttaaaagaaacgtgaccagctgaatggctgattatttaaaaattgggtccttttctgtatgataaagtgaggtgggaagaacgagcagactggccaatatatcaaaggatttcctgacactccccagaagcagaagacaggctgtccctgtttcctctgttcactgaagccagcctcggttctctccggccactgtctgacattatcagtgttcacacacattagcctcaaaggctgtcctacatagcagagcactttacctctcacttcctggagaaattatttttcttttcttaagcaaaggaaactccagaatctaaagaggccatttttcatctggatcatcaagcagtggctctgaaggtgtgcttaagttcactcttaggtgtgcttgccaagcacacgatctaggtgctggcagagcacagggtcattcaagtgcataattcacaagactctagctgccagccagtgggacctggagaaccaggcaggaagtgcagttgataaaatgagcatagttaacccttcagaaacatgagatacaataacattttcaaaagtcttcaacatgtcaaatgtttgtgctgtgcccaatgttgatcttcatttattatttatctgctatctttaaattgcctggagcattaaagctcagaactttaaggatgccagtaaatgtaccattgcttctcctcatcacacttggcataaaagtttatgaggcctcaatggtttggcccatgcccgttcttcctgacccatgctccatcactcaattctcattctctccattctagtcccaacggctttcttacccacaatcaccctcccacccaccctctgaataagaccaccatcagtctctagcatatattctgctttatctttcttcactgcattgaccactcattgtttaccattgtcttcaccaccagaaggctatctctgtgaggatagggaattcgttttgttccctgccataactgaatacctaatagttatccaataaattaaaaattcatgatgaattaatgaatgaagtgtagatctggaaaagatggttgtattcaatcagcaagtccatcaaattctgcagagtatttaacttgtccaatgtttgctgtgccagggtctgcacagccctcaggcatcctaggttaccaggacccttccaaggaaaagggtgcttctcttagacaaagatgagctcctctcccagtctgggtcatcatctggtttccatggcaacccatataaagtgcctctgaccctgagcaatttataggacataaagtattccacacttataaaacagtaaacaacaacaaaaagaaaattaaaaaaacgaaaaaacacctaagctccctaagttactattttggaagataatttattagtattcaaaaagctttaagggatacttttcataaacaggctatatctgatagcagtggttgattgtgttatgtaagtgcagctctctgctagccatggaaaatgtagattttatgctagtaaagacactattggttgtgattatctacatacatccatgctttatacaaaaactcatattaaattaagagtaacattttccaatgctagtttctgtcctaaatacagcagtgttgaaaagactttattctacattcaatattttgcagcactggttgctttttgccgggtggtaagttggggcttcagaacaaggaaataaatagactcgctcctgaaaggaggagaggaaggtgggactcccaggggaagctggcctttgtgtttgatgaatgagtctttttcaagtatctccgttgtttggtttttcaaagaaaacagagacagtctccaatctgttcccaagctcattgtgtgaaatttgcctcgtttgggaacttcattattttcctggctgtgaaatattgagtcagtgggtttcacagggatgcactgtctgaggggaggctctttgacaacaccccactacgaaggccaaggatgggtgcacagtaaataagtccaaagtcagtgatatagagaggacaaaggcagtagtgaatggacatgatggtcaaaagaccctcactgcttctgacgctatataaataatctccactacctctgctgcttatagagcaaaagatttaagttgctgccattcatttctattccgagttgactagaagttcccaaatccaaataagtgccctataaacttgaagaaaagtctacatggattgaaatttagaaacctacaaaatagtagtgtgtagctgtgagatatcctccctggaactggcttatgagtgaagggggcccacatcctgtgggtgctctggctgtgacatacccttgaacgcatgcccagttgggcctgttctgttcagagatgtgttctgctcaataatgctgagtagaaaagcaaattccaatgttgttttctaaacactctattttctctaaatggcatcagcaaaactaagacttactaacccattggggacccctaaaagcttagattggtagcatcaatctgccaagagcaaagaaggcatcaagcacttcattcactcaaagacataatcagaattatcttcagccaaattaggtactcccagaatgtgagtgctccgagcaaatgggtttgtgatgacattgttatcatgatcatcatcttcttcatcatcagcttacaacgaatttataacaccaaaatacatggctctgataagaaaagcaacaggaaacatttttattgaaaaactctcataaatagggaatatagcatggctagaagggactccattagtctagatatttacaaagtcttcatgaaatactttaaaataaatgatcctaatgaaaaacattggaagcacgtaaaattttaaaaattgaaaatgtttaatttccaaattacaataaatgtttttaaaagttaatattgtttttccttcaataataatgatgatcggctgggcacggtggctcacgcctgtaatcccagcactttgggaggctgaggcggatggatcacctgaggctgggagttcgagaccagcctgactgacatggagaaaccccgtctctactaaaaacacaaaattagccgggtgtggtggtgcataccaggaggatgaggcaggagaatcacttgaacctgggaggcggaggttgcagtaagctaagattgcaccattgcactccagactggacaacaagagcaaaactccatctcaaaaaagtaaataaataaataaacaaataaataaatgaataaataaataaaaataatgatgatcaacaccataatcaaaaatcatagcaaaaagctagaagttattgaaaccttcctgcaagctaggaacggtagggaggagtttacacacattgtcttaatttcatcctcacaacatcctctgaggttggggctattattatccccatttaaacagagaagaaactgaggcttagacatggcaaatggcttgacagagatcatacagttgatatgtgatgaaacaaaaaattaagccccaaactttggctattatactgagagtataattcacacaaggtagtacagaaaagaagataataaatttgaaattcttggtttctattgagacagcaaccatttaaatgggaactatgggctttttctgtcttgccccatcatggtggaaaaggagaagagatttacaggaaacgctgtcaaataatttgtcactcctggaggaaccattttcctatgaccactatgccaagaggatatctttcatgtccaaattcatagagacaagatagactgctctgggattccgaagggagaaagcatctcagtaacaattttgagaagcagtttgtgtagtccctaagagcacaaaaaccagagccaaattctctgggttcgggtcttgaccgcagtgcatcctagctgagttaccttagaaaagttgcttagcctctctgtgactctattttctaatctgcagaactgagacaataacagtacctattttactgagccattgtgagattaaatgagttaacatctgtccaatggttaaacatgcttagcacatcataagactatataggtgctggccatcactagtaccaacattgaaataacctgttgaagatctgaaggacacagttgaccagagacatcaacattgttcacagttccctacctgtgcacaagttcaaactcaggcactccgtatattttgtttttacaggtatttggaatctgcttttcacttctgttttctctatttgatgtgatacttcagacctgctcttgactgtctggctcattcctaagtgaactgtggactgttcctttgttttgtacccagaattataagtttcaatgaagttattaacaagacaattcccataagcatagtaccctaagcaggggtccccaacccccaggccatggactggtactggtttgtggcctgttaggaaccaggctgcacagcaggggtgagtggcaggccagcaagtgaagtttcatctgtatttgcagccgctccctatcactcgcattacctcctgagctccacctcctgtcagatcactggtggtattagattctcataggagtgtgaacctgattgtgaacagagcatttgagggatgtaagttgcatgccccttatgagaatctaatgcctgatgatctgtcaccgtcccctatcacccccaaatgggaccatctagtttcagtaaaacaagctcagggctcccactgattctacgtgatggtgagttgtataatttttcattatatattacaatgtaataataatagaaataaagtgtaaaaataatagaaatagaaataatagaaataaagtgcataatgcacttgaatcatcctcaaaaccaccccctgaccctcgtctgtgtaaaaattgtctcccataaagctgatctctggtgccaaaaaggttggggacctctgctctaaagttaccaagactacttagatgatatcataatagttacagaatctaagacttccagttctaaagagatcatctggttcaatactctacctaaaagatggttcaactttatatattaaaatatttcatagacactcaaagtagaaactgattctaaaactggaattgttcctcaataattctagaacttcaaaagcttagaatactgcctggtccataggaaatacttaacagttatcaactacctttttaataagagtgttagtattagtttgagtaacccaaatctttttcctccaaggactgtgacttcaaaaaaagtcacgttgccttttaaatgtccaaattgcaaagtccaagctgcatctctttgccataagtttatcaatttccatgtgcccctcaggcatttctgaatgtcccatggggctgtcttgtaccctcaggaacatgtgccttgtgacacctgccatgttctcttccatcatggaaatgcaccattctaattccagttgatctctgtgatgacactgtcaagtctactgcctcctgacttccggagaaggggctcaagtctcagcaggggtaagacaagggcttcattgtgcatggagacaagcttttctggaagttttatggaatggcaataggacatggagtatgagttatcattattacccctgcccagtatgactcagagaccacaaatgcaggcccttctatgtctgtctagctcttggcttgctgccttgccacctgggcagcttgtccttcaccaaaaggtgtgtcccaggtatctctgcacatctcagcatccacaccaaccacaccagaccctaggggagaggagagtatttttcccatccaaactatgtgcacgtatgtgcatgcttgtggacacacacacacgagtctaaagctataccttgaaaccccatttcctatcacagaagaggattaaccaagaaaggctttgggctaccaaaaactgaaagtggcaaggaaggatccccacctagaggcttcagagggagcatgaccctctcaacaacttactttcagacttctagcctccagaactatgagaaaataaatgtctcttgttttaagcaactcagtttatggtattttgttatggcagtcctcaggaaactcatcgaggaactacagacattttttaaattttatttatttattcatttcaataggttgtgggggagcaggtggtctttggttacatgaataagttctttagtggtgatttgtgatattttggtgcacccatcactggaacagtgtatagtatacccaacatgtagtgttgttgttgttgttgttgtttttggagatggagtctccctctgtcacccaggctggagtgcagtggcatgagctcaactcactgcaacctctgcctcccgggttcaactgattctcttgcctcagccttccaagcagatggattacaggtgtgcaccaccatgcctggctaattttttttttttattttcagtagagacagggtctcactatgttggccagcgtggtctcaaactcctgacctcaggtgatttgcccaccttggcctcccgaagtgctgggattacaggcgtgagccaccgcacccagcccaatgtgtagtcttttatccttcacgccccttccatccttttcccgagtcttcaaagtccattgtatcattcatatgcctttgcatccctatagtttagctccttatagtttagcatccttatagcttagctcccacttatcagtgagaacatacaatgttcggtttttcattcctgagttacttcacttagaataatgatctccaattccatccaggtagctgtgaatgccattatttcactcctttttatggctgaatgttattccatggtgtatatatatgtgtgtgtgtgtgtgtgtgtgtttattgtttttcattcctgagttacttcaattagaattatagtctccaatcttatccaggttgctgcaaatgccattcattcattctttttttgagtagtattccattgtgtacggaattggtgggttcttgggctcactgacttcaagaatgaagccatggaccctcgcggtgagtgttacagtccttaaagatggtgtgtccagagtttgctccttctgatattcagatgtgtttggagtttcttccttctggtgggttcatggtcttgctagcttcaggagtgaggctgcagaccttcgtggtgagtgttacagttcttaaggtggtgcatctggagttgttcgttcctcctgtccagacttgttcatgcctcccagtgggttcattgtctcactggcctcaggagtgaaactgcagacctccaccatgagtgttacagctcataaaggcagtgcggacccaaagagtgagcagcagcaatatttattgcaaagggagaaagaacaaatcttccacactgtggaaggggacccaagcaggttgctgctgctggctctggcaacctgcttttattcccttatctggccccacccacatgctcctgattggtccattttacagagagctgattggtccatttcacagagagctgattggtctgttttgacagggtgttgattggtgcttttacaatctctgagctagacacagagtgctgattggtgcatttacaatcctctagctagacataaaagttctccaagtctccactagattagctagacacaaagcactgattggtgcatttacaaaccttcagctagacacagagtgctgattggtgcatttacaatcctttagctagacacaaaagttctccaagtccccactagattagctagaaacagagcactgattggtgcatttacaaatctttagctagacacagagtgctgattggtgcatttacaatcctctagctagacatgaaagttctccaagtccccactagattagctagacacagagcactggttggtgcatttacaaacccttggctagacatagagtgctgattggtgcatccatgaaccccgagctagacacagagtgctgattggtgcatttacaatcctccagctagacataaaagttctccaagtccccacctgactcaggagcccagctggctttacctagtgggtcctacaccagagccgcgggcagagctgcctgccagtactgtgccgtgcacccacactccttggcctttgggtgattgataggactaggcaccgcggagcgggggtggcgcccatcggggaggctcaagccatgcggtagcccacggggcaggggaggctcaggcatggcgagctgcaggtcccgagccctgccccacggggaggcagctgaggcctggcaagaatttgaacgcagcacaggtgggctggcagtgctgggtgacccagcacaccctctgcagttgctggcccgggtgctaagtccctcactgcccggggccggtggtgccagctggctgctccgagtgcggggcctgctgagcctgtgcccaccatgcacagccccgattcccgcccgtgcctctccctccacacctccccacaagcacagggagccagcttaggccttggccagcccagagaggggctcccacagtgcagcagtgggctaaagggctcctcaagcatgaccagagtggacgccaagcctgaggaggcaccgaaagcgagcgagggctgctagcacgttttcacctctcaccatcatatatatatatatatatatatatatatatatatatatattacaatttctttgtcatatatatcacatatatctttgtatcttatatatctttatcatatgtgtatatatatatatatatatgtgtgtgtctcacaatttctttatccactcattgatcagtgggcatttaggctggttccatatttttgcaattgtgaattgtgttgctataaacatgcacacgcaagtatctttttcatataatgacttcttttcccctggatacccagtaatgggattgctggatcaaatgatagaactacagacattttttgacctgtgatatatgtaaatctgtataataaagatattctactacttttactaatgtctacaaagatgacagtttaaaaatctcaactcagaaaaaaagtacacaaaattccaatcaatgcctatatttatttttccccaagcagttagacaaattgaaggtggtgggggaggctagcttcacttgatttccagtgaatagtgctgatgagtcaggaccattacatctctcagaaaatgccctgtaaaaaacaaaatctgagtgttgtgtttactaaagtgataccatatgttggttgattaacaagttgtcagaatattagaagttcttggctgattgcaagaaggagcatctgtttgctggatcctttatctaatgtgtgtacagatagcaccaggtctggtgcttttcctaaatatcaaatataaattcctgtagtatttagcttttagagagtaacaccgatgtacagctagagttgaagatgtttattctgaggagagcaaattaaggccagacaaaaagataagtgtgcatataagagtatgtcatttagcattgttttaccattatctctgacattatgtaccacagtgaatgtttacgttaatgtcacttgcatagggatttaggaaaagaagaaaaatctcttttagagctgtttattgttttatctgttgatggaatttaataatgctttatttgtataaagtgacttacagtttaaaaatactttcacattgaattctcacaacattgtaaaagatggcaaggaatcctatccccatttcatggatgaagaatctgcagttgagttgggatacatccatctggcttaaacatggtgaaaccaggacataaagccaggtcttctgaggtgctatgatgggatttactcagggtgaaattctggacttttcctttgtaacttcctgcatctgttctccaccacctttgataacagccagctaccatatattagattgtaccattttaatttcagccagtagattccttttcactgcccatcaaagcagacataaaataagtaaagggaggaaaagggactcttcttatgttaactgagttcaaagttagaattagatttcagttgttccatttcctttgaagtttctcagcacccatggtcttagaactaagtggctctgtgatatgacatacatttcacctttttctttagcctgagttttttttgttctatattttttgcaacatacaggaagactatgttatggagaatttttttaatgtttcagggaaatgggacatatgaggaaaaacagagtagtttcttttaagtatcccaaattttagttatttatttaaatcataagtcagatgtcacttttgagcatttcttcctattattcatttgcttaatgtaggggaggaaaaaaataactgtttctttaccctcttagattcagtggctggggtctgtgaattaaactgacgaaggataattaacaggagaaagtgtttatctcccatgtacacagagtgcctcacagaaaagaagtaaaaaccttcaaaaagtacttaggcattgatgcttatataccattttaacaaagagcaatacattgtgtataagtgacaagacaaagtaaaaggcttttgggcttctgatatgatttggatctgtgtccccacccaaatcttgtcttcaattttaatccctaatattggaggtagggcttggtgggaggtgattggatcatgggggtggtttctaatgatttagcaccatccccccagtcctgtctcatgatagacttctcatgagatctgtttatttaaaagtgtgtggtacctcccccctcacttcctcctgctctgctatgtgaagatgtggctgcttgccctccaccttttgctatgattgtaagtttcctgaggcctccccagccatgcttcctgtatagcctgcaaaaccaggagccaattaaacctcttctccctttaaattgcccagtttcaggaaattctttctttcttttctttttttttctgagatggagtctcactctgtcacccaggctggggtgcagtggttccatctcagctcactgcaacttccacctcccgggttcaagtgattcttgtccctcagccacccaagtagctgggactacaggcatgtgccaccacatccggctaattttttgtatttttagtggatgaggtttcaccatgttggccaggctggtcttgaactcctgacctcaagtgatccgcctgtgtcagcttcccaaagtgctgggattgcaggcatgagccaccatgcctggtctaggaatttctttatagtagtgcaagaacagactaatacagcttctatgtgcaacaaattgtaggaaagtaagtatatggaggaaactagtggaagatgtggattatttaatcagttttattatgcagactcaagttattacaatcttcagtgataagagttatctccttttcctggtatgaaatttatcccctgcttttaggcaaaaataggggtggcagagagttccttctgtatctgctgtttctctattgcctttgactcagaaaaatccttatgccaaagtggcttcttttaaggtggcttattctgctcaccttcattaactttgaggacctctacagtcaggtccttccctatctttccagctatatcctcaactcctcaaccttcttttttttttttttttttttttttgagacagggtctcgctctgtcacccaggctagagtgcagtggcacaatctcagctcactgcaacctccacctcctgagttcaagcaattctcctgcctcagcctcctgagtatctgggattaaaggtgcatgccactatacctggctagtttttatatttttaatagagatgtggtttcaccatgttggcaaaattctgcctgtcttgctctacgattttcctcctctgaactcatatactcatactcatctctctgtaataccatttcctttcctcttctccttcccaaccttacccatccttcaactcaagttcaaatttgttttcctatttcagtgtctccccagacctccagctatatcaagtggcttttccttccaaatgttttgaagacacatatcattgtctgaggaattaatttgacaatctgtcatttagtcctgtggttgtgttgttttaagttatgtgagtcttctattgttatttaacttctcacattttgctcccttttgtctctttaacctcagcttctctctcttgctcatgtctgtaatcctggagtattgctttccaaagtgtgagtcaagaacagtctgagtcaaaattcatcccctattgttgttgaaaaggtagggtcctgatactgattatggatcagctaaattgacttcccaaatgattcctctgtatagtgaagtttatgaatcattgatatagacagcacatgttactcattcatttatccatgcaacaactatttgagcacacgttaggagctggttacctgggatacagtagtgagtctggcagacatggtccctgttatcttggaatttcttatttagtttggaagacagacaatgaacaaggacttaagatatgatgtcggttacaaaggtgagatgtaaagacctgtggaaatatctgagaggggaacctaatctggcaagtgcaggtatcagggaatatttcccagaggatatggagttgagacctaaagagaagtaggacctggctagatgaagtgagagggggaaggatgaaaggccaaaggaattacctgtagaaaggctctgaggtgggaaagagcatgccctcttctttggagggacagcagacaagatcaacctaacttgagtctccaagtcaaaggagaaaagtaataggaagaagagctagcaaggtaatgcatggctggattatggggggctttgaggccatgataaggagtttggaacttaccaaatgtagtaggaaacaactgatggagaacagcctgatcaattttgtcattcagattatttcagttctagaaggtaacaagaatgtacctggaaaaataattaagggacataatgtaatattccaggagaaaggagatgatagttttgtccaggttggtggtagtaggatggattcaaatgattcttaggagatagattagatggaatttagtcattaattcctttttgggtgagagaaagggaagtgtcaaggatgtctctgatttttgttttaataacattttgtggaaccatataacactgaggaccaggttttaaggacaaaagttcagttccgggtacacaggttttggagtacctacagaccattcaggtggaacatgcctgttctttttcatatttcccatggaaagggggaattttaagtggggctttgagagaattgtggaatttagatgagcacgagtgggatccagttaaaggaccacaaatgtgtttatctaccaaaagggtccctttgtgtcttttttcttacttgatgcttagtgatgcactgaattcatagttccatattttttaatccatcttcaaaaatgactgtgttggctggaagcagtggcttatgcctgtaatcccagcactttgggaggctgaggcaggcggatcacttgtggccaggagtttgacaccagcctggccaacatagtgaaactccgtctctactaaaaatacgaaaattagctgggcatggtggtgtgcacctgtagtgccagctacgcgggaggctaaggcaggagtatcgcttgaacccggggaggtggggggagggctgcagtgagccaagatcgcaccactgcactccaacctggatgacagagcaagactccatcacacacacacacacacacacacacacacacacagactgtgttctccaaggagattatgatggctttgtttgtttgtttgtcttcattttgttttgttatgaagtgatttgagtcaatgagtctctttgcatggattgtatttatgttggtcctttggttgggggtaagctaagggtaggggcatatgttctttaaagttaatctataaacacaatttgtattttgcttaatgtagtatattaatcagttttgggtgagttcagacatacttgaggatatgagagaactcccatgaagagaataagtgaaagcagaactataacattttatactaaaattgtagtgctcctggtaaacatgtttggagagggattttaggagattatttgcaagaatcagttggtctttgataacaatacactctagttatgcaaggggctatggtttcaacatgatttgtttctccccaccaaaatgcatgttaaaaagtgatccccaatgtggtggcattaggagatgggatatagtgagaggtgtttaggtcatagatgcagatcccttgtgaaaggcttagtgccattcttgtcgtagtgaatgaattcttgttctgaagggactgaattagtgcccacaagagcgggttgctataaagctgggacaccccccaggttttctcttttcacacatgtctgcttcacctttgaccttctctaccatgtatgatgcagcacaatagccctcaccggaagtcaaggtgatacccttgaacttcccagactgcagaatgatgagctaaataaacctcttttctctataaattacccagtttcaggtactcttttatagcaacacaaaatggatgaagacacatttcatagaactattcagatatagccaaatttccaaaaaagaggaaataatggaaagctacagattctccttctacctcttttcttctgattgtccttcctctctttctgttagtcatctgcttctcattcatcttcagaaaagagaataatgaaaaaaagacagtggggctaaattactctgtgtcctaaaaataattcccccaaatcattatttgctgcgttttgaaaattatgcaaaaggctttaaaactaaacatgaatgatagaatgtaaaagtgggtcctttggttgtcctcatgcattccagtatgagaaatccttccacacaattcctgagcaatcctcaactagcctcttcttggttattcttagcagcggggaactccctctctattttaggaaacaaccatttattcccactaaatctggttagactgaataactttcctaaaaatgaatcaaaattagtctacctcggggaatggttctgcacctcacagcaacacagaaggaatctattctatatgctatatgacagcctttcaaatatattaagacaactgccaggtctcttcaaatcttctcttctgcaaactaaatatccccaattccctcaaatacatttcttacagaacacagtgtctgcattcttcaccatctttacaaaaacatatctcccctgagccctcccaaaggacaatcacccctttctgagtgacactcacactttaaacagcaccatctatagtaggacagctgcctcttggttattcttgtgtttacttttaatgacaaacactttagctttcaacagagccagtgagtgaagacttggggatatgtgctgtttttaaagctcaagctttccagggtgggtggaatgtgtacgtatggtttaaaacagaagtggtttttcatttgtgggacttgaaatgggctgaatcccagtggaatcactggataataaatgggaggggttttaaatttcatcagagtaaaatgggaagatatttccccttttgcactctttatgtggcagttgtaccttaatctgcttttaagaacagctgttgcaacagatgttcattttagatagtatctttttttgaaagtatacccagcaaatccttttcataaggagatgtttatgaaagcccaaaacttttcctaatgcaaataagctatcatttgtgcagcaccttcagactatcacccacacagactaagcaccttcaaagcgcacagtcctcaagtatatgttatggaggatttcccatgaggccaaagccccattttggcctcaagaaactcccaatgcactgattgctgtccagcagcaggattccagcccatggggaggtcactggtcaacagagcagggctaggagaaacagaaaagctggctgcaatactggcagtattcaattcaaaaccaggagcacatgattgtcccttttcctagttttcctttctgccagatttttggctctggccccataggtggtcattcaaaccagatgaggtctttatacttggaaatcacagacacgctggagaattctgctcttggttggtacagggacacaaaactatattatctcagaaaaaaatatgtatttctctcattacgtatggtatctaatataggtatgtgtgacatttataaaatatatgtttctgtatgtaaaaagagaaagagatgcataggctgaaattttttttaatcaataaaagttctatctgaaataaaataggatgcccttaagaagagactgctcttactagtctctattctccaccaatctctcatctagaagggaaacttctttgctaaagagggaactctcagaatcaccatttacccacctgtctctgttgtgggagtcttcacacttctactacataagtagtaaaacccacaggtaacctgcaggataaggaattccagttggggtaggttacagttacatacaaggacaccactcagttccagtttggttggttaaggcttaatgagaatctcctccaagacatttgcttcagcatctccttgcaagtcctcgaactcttcctttgttgtaactatctgttattttgttacttttaatttatttgaattaatccatacccatgattttaaaaatcaaaggctactaaatcatactattacctaatttaccagctttaaagaatcaactcttggccaggtatggtggctcatgcctgtaatcccagcactttgggaggctgaggtggacggattacttgtggtaaggagtgcgagaccagcctggccaacatggtgaagacccatctctactaaaattacaaaaattagccaagcatggtggcttacacccctaattgcagctactcgggaggttgaggcaggagaattgcttgaacccaagaggcagaggttgcagtgagctgagatggcgccactgcactctagcctgagtgacaagagcaaaattccgtctcaaaaaaaaaaattgcaaaacttagcggaatgtggtggcaggtgcctataatcccagctactaagaggctgagacaggagaatcgctggaacctgggaggcagaggttgcagtgagctgagatcccaccactacactccagccctggtgacagagcaaggctctgtattaaaaaaaaaaaagattctgcatttgaaaaatgaggaaaatcaacatatttactctaatttctgtcttcccttcccttctcctccccttcccaacacatgttagcaatattatttttaaatggtcattgctcataaaatttaagttctgaaatcatcattctatggttgtcttatttttagttttagtgctaagtgggttcagtcctaaaagcagcccttttgccctgactttttcaattttctgttggatgactggggtttggacttccaatatttcctcaaaaggactcatgggaactattttcctgagcatttaaatttgaaaatcctctggttttatacttggatgacagtgttgtgagtaaaattcttgagtcatactttacacctctgaagactttgtgtctattatccactgccttccagagttgacttttttgtcacttactatttgatctgtactcattttttcttagcctatatttccatgtgtcaactcatgtcctttatttcaataaaacgtcttgaattatctttggatataattataccttttcctcttccaattacttggttttctccagtgataactgttacttagaagggggatctttgttgtatctcccatctatacatttttaatctggccaggcacagtggctcacccctgtaatcccaccactttgagaggctgaggcgggcagatcacctgaggtcaggagttgaagaccagcctggccaacatggtgaaatcccttctttactaaaaatgcaaaaattagccagcatggtggtgagtgcctgtaatcccagctatcatggaggctgaagcataagaatcacttgaacctggaaagcagaggctgcagtgggccaagacggtggcactgcactccagcctgggtgacagagtgagactccgtctaaaaaaaacaaaacgaaaaaattttaatctagtatttttcattcccttttctcttccccagttcattttactcagtttcctcaaatgtactctctgtgactcaggctatgtttttcggcatcatctcttctgctctactcctcttccaacggtgcctcatttttacgatggttttattgatctgcctttgagactctccgtacagccctggtctgccagtctgaccattgtccatcggagctgttcattaactaattgcagaaaaccctgattatagaccccatctttgactcaatttttcctaacatgagcttcctgtcttgtcgcttgtcacagcatcctgggtccgctgcctccctttctctcattcttttctcttttgtatttgctcatataacctttgtagctgactgggctaatggtgattaatctgctcagaatttctccctcttcgctgcctcccaggtcatttatttcctttctcagttcagagggtccggcttccaaaaaatgtcactgctctatacttctccatctcccttcactcattaatatgttctgcacttttaattcatttccacttggttataaaacatcataactatcagcagagaaagagaaccagtacacttgaagattcatcatgcagtcctgagggggtgggcctcctgcattcaatttctttgaagtccagcattttatctcagaaaataaggcaatggccaggcgcagtgtctcacgcctataatcccagcactttgggaggctgaggcaggtggatcacctgagggcaggagttcgagaccagcctgaccaacatggagacaccccatctctactaaaaaaacgaaattagccaggcacagtggcacatgcctataatcccagctactcaggaggctgaggcaggagaatcgcttgaacccgggaggcggaagttgcagtgagccaagatcgcaccattgcattccagcctgggcaacaagagcaaaactccatctcaaaaaaaaaaagataaaaggcaataggccgggtgcagtggctgatgcctgtaatcccagcactttgggaggccaaggcaggcagatcacttgaggtcaggagttcgagaccagcttggccaatatggcaaaacttcatctctacaaaaaatacaaaaattagccaggcatggtggcagcgcctgtaatcccagctactcaggaggctgagtcaggagaatcgctcaagcctgggaggcagagtttgcagtgagccgagaacccaccactgcactccagccctggtgacagagcaaaaaaaaagaaagaaaagaaggcagtaattttatccaacaccataatatctgtgtttgttttaaatatgtttatttgtagtgttttaagtgacttagctcttcaattaattaactcctttatcccacctccaaacctcaagtaaaagtgaagcctcaaaaacataagccataatactaatgagctttccaatactttctgtcatgcccctgggaattctcaggggtagaggatcacagccagggataaatcacatgtaaaaaagggtcccttatatccagctttgaacctctagcctgtggcacagtatgaggtacacacctgattcagtgattattgtatgtggaattgactgaaattgaaattgcaagcattctctgcagtattcaataggctgctgcctatttcagtttattcttggtgttgttctaactaaaatggaatctctcttctgtagggaaagaaagatggaggttgggccttaaagaatcaagtgtaacgtgtttgtcctttttcaggagtcagctattgaaatcgtctttgttagttcattcctcccaacatggaggagaccggacactttcctcaagcctcatgtccatgggcttgatgattgatgagtcaaagcttcatattcctcggccgggtgcagtggctcacgcctgtaatcccagcactttgggaggccgaggcgggcagatcgcggggtcaggagatcgagaccatcctggctaacatggtgaaaccccgtctctattaaaaatacgagaaaattagccgggcgtggtggcaggtgcctgtagtcccagctactctggtagctgaggcaggagaatggtgtgaacccgggagatggagcttgcagtgagccaagatcacgccactgcactccagcctgggtgacagagcgagactctgtctcaaaaaaaaaaaaaagaaaagaaaaagaaagcttcatattcctcacctggaatctggggatgatgatagtaccagccttatcaggtcgttgagaggaatacatgatcctaccattgaaagcgcttgacctgcaacctgacataaagtgtacactcattcaaaatagctgttgctactgttaagtggttggccgaaggagcacagagatcataggatgaccccaaatcattttggctaaaaatgcttcgaaaatatgcccctgaaactgaggagcaattctagacaatgattggtcgccttggtatagaactctacaattcccacaattaatacaataatttaaaatatttttctatcccttatcttccccccaaacacacatgtgcacacacttttacccatgcagaggagaaagagtaatacctttttctcacccatcacaagggtcatggctgataccctataacaaaagacagattaacaagagaaaagcaaacaaattgatttaatgtaagttttacatggcacaggagccttcagaaatggagatccaaagacctagggaagactgcgtgtttttatgtttggtttgatgaagaatggacagtcttgtacaagtatgattggaggctgaatgcagtggctcactcctgtaatcccaaggactttgggaggccaaggtgagaggattgcttgaggctgggagtttgagaccagccggggcagcctagtgagaccgcatctctacaaaatgaaaattttaaaaattagctgggtatagtggtgcatgcctatagtcccagatactcaggaggctgtggcaggaagattgattgagccaaggagttcaaggctgcagtgagctgtgatcataccactgtgctccagcctgggtgacagagtgagactctgtctctatttaaaaaaaaaaaaaaaaaagtatgattggacatacaaagggtatgatctaatgataataaactgagggggagcttagcaaggcctgtttgttcagattcttcttgacctctctttgcggcaggcgtttccccttggtataaggcaagatacctgtcacttagggatcttatggcccattttcaggggaggttggtcagagaattcctttatggctggctcttaaacagaaagactggggaaagtcaaagctagtgacctgcaaggtaccatattttggggtaacatgttttgcaccccaatgcccagaaatagtaaaacagcaaagcaggaggaggttttacctacaggtcccatgcggtagccatttctcatccttacttcgaaagcctgaacttccccaaacagcttattctatgtgaggcgctgaacccaagcctcccttgactcagagctcaccgtatggtagaatggtcagcagccctaaattcccgtgggctttagaagttagggctttcccacagcaggattgccctggttgacaaacacaaggaatccagaagtttctcctacccacagattcccccatatttcctgggagaacccagtgctatctaggagttccagaattaggacgagccatggaggatatcctgtttaagggaaggcaggctgctgaccagttattttcttaacacctttccatcctttggcacctactccaggaaatgccagccagagctctccaattagctaccatatggatagagtctataagaagaaaatgtataatccatatcagttaagtgctctgaagagcagatcattccagggagggaaagggataaccaggacatgggtttgtcatgcttaaaaaaaaatgatcagaggcggggctcggtggctcacacttgtaatcccagcactttgggaggccaaggctggcgaatcatttgagcccaggagttcaagaccagcctggccaacatggtgcaaccccatctgtatacaaaatacaaaaattagctgggcaaggtggtgcacacctatgggaagctaaggtaggaggatgacttgagcccagaaggttgtggctgcagtgaactgagactgtggcgctgcacttcatcctgggtgatagagtaagactcctctcaaaaaaaataaaaaacaaaagatcagtcaccttgtaccacattgtctaattttttcataatgtagttttactctatttaatgtgatttaaagacctgcattcctgactattaatctggtcaggaataagaaacatttaacaggcacaataggaaagttctccattcaggagagttatataaggtttggaaatacctgcaaaaatcagacatactatttgatagtacaatagggtgactatagtcaacaataacttaattgtacatttgtgtaaatgcattgtttgtaacacaaaggataaatggtgccccccttctccattatgtgattatttcacactgcatgcctgtatcaacacatctcatgtacccacaaatatatatatatatatatacctattctgtacccacaaatattaaaaatttaaaaatttacaaacaaaattcttgcaaaagcaacccagaataggatcaagcctggaggcagtgaaactgtagtgggtaacagatttcattgccagcttcatggttgaggcatgtgtaacaaaggacttattagcaagagaaaagtgtacaaatttactttttattttttgagacagagtctcgctctgttgcccaggctggagtgcaatggcgcaacctcaactcactgcaacctccacctcccaggttcaagcaattctcatgcctcagtctcccaagtagctgggactacaagtgtgcaccaccacacctggctaatttttgtatttttagtagagacagagttttgccgtgttggtctggaacccctgacctcaagtgatccccctccttggcctcccaaagtgttgggattacaggcgtgagctactgctcccaaccacggatttacttaatgtaagtttgggttgacacaagagcttttgggtgttaacacaagagcctttggaaaggaagatccaaagaaagaggtgaatgtatgtatgtttatgcatacgtctggtgaagagcggaacagtcacgcagaagtatgattagaagataaaaggaagtgatctaatggtaatgaacttagggactcagcgatgattctttgttcagattcttctctatgtccctgtgtcttcagagacaaggatgctcctttcttccaggtatagggagggcatctctcacattagggtcttgccacctgcttcagtgggaaaggataaggggaaaggataaggggaaggtgcaagaaaccttcctgcttctgctgttttctcaatgtcaaggtatcatatttggggggtagtatgctctggaccccatcaaagcaatcattgcgaccttgttttccagtgtcatccccataaggttaagttcatcacatcccatttgttcacagcccaggcttctaagagaagcacatttgggacagagggcatggggccctgagatggccctccaacctcagttagaggtcacacccacaccaggactcttgaggtccctcaggggcttggagaaatgcacaggacccaattcactctgcatgtgtgaccagaggtgacatttacaatgtctggggtggtgcttacagcaagaccttgggaagattatgttatttggtgtttctttatttatctttttgagacaggatctcactctgtcacccaagctggaatgcctggtagtgcaatcatagctccctgtggcctcagactcctgggctcaaacgatcttcctgctcagcctcctgagtaactggtactacaggcatgtgccaccacacccagttaattttaaatttctttttggagagatggagtcttgctatgttgcacaggctggtcttaaactcctgggcttaagcaatcttcccatctcagcctcctgagtaactgggactatgggcatgtgccaccatgcccagttaattaaaaaaaatttttttgagagacggggtcttgctatgttgcccaggctagtcttaaattcctgggcttgagcgatcttcccacctcggcctccccctcctgaagtgctgggataacaggcatgagccaccacacctaacctaagcttacattattaatggctaaaaagctctagcttcttaaggttccctcagtaaagatacaaatcttataactctgattttataggagtcctgcggacttatctggagagaaaatttgctatgaagcaacagtcagatacaagatgttataccagtgttcaatttcaatagctgcttcagaagctgttcctccctgatccaaatgtagccctgtgtagacaatggggtctttgctgtcctatctctggcgatctgtcctgctcagctataaacacagcgttagatgtttcttcatcttccccatggtcaggtcagataatacttatcttcctttatctgtgggggagaactctctaaattgttgctatctaacctgaacatgaacaatggcttaaattgtttcttcttgaggaaataaacgagctgcgccatgcagaactgcgctaatccagataactccatctgggtcaacagtaaatgaggaaagtgctcagttcttaacatttgacagttagagcagatcacagtactcaaggatttttttttttgtatgaactccatctgcagcgttttctacacacacacacacacacacacacacacacacacacacacacacaaagcagtcacgtgcatgttcatgtactttggtttcttcatttggagataatttaaaataggccaggtgcggtggttcacacctgtaaccccagcactttggaagtctaggtggatggatcacctgtggtcagaagtttgagaccagcctggccaacatggcgaaaccccatctctactaaaaatacaaaacttagccagatgtggtggcgcacacctgtaatcccagctactcaggaggctgaggcatgagaatcacttgaacccggcaggcagaggttgcagtgagctgagatcacacccctgcactccagcctgggtgacagagtgagactccatcttaaaaaataaaaatgaaaaataatctccaaggagcctataaatacattaccaaacctatgaaacctttcccaccaatcttggccttcatttccctcctctcccctcccctcctctcccctcccctcctctcccctctcctcccctcccctaccccaccccaccactccccttccttcatcccttccttccttccccttgctatgttgcccaggcagacctcaacctcctggcctcaagccatcctcccaccttagcctcctaagtcactgggactacggacacttgccactccacctgacctctggcctttattttcactctgctgaactcccaaaccaggtgtgtctacagctcactttgtccttagcacaggcagcctcttttctttgttttgggggttgtttttggagacagtctcgctctgtcaaccagactgaagtggaatgacatgatcacagctcattgcagccatgatcttcccatctcagccaggctcaagcgatcctcctgcctcagcctctgcagtagctgggactataggcatgcaccacctatagtcacacccagccaattaaatttttttttttttttttttttttttagagagaagagtctcagtatgttagtcaggctggtctctcaaactcctgacctcaagtgatcctccagccttggcctcccaaaatactgggattagaggcatgagccacagtgtccagcccgtgtctttatttctattgtatatgactgttcttctctgtacgaggataacaagtccccagtcttatccctccatgctccttccaagtgctggaggccaagaggagaatgaggctgtcttcctcctctcctggtcccctccctgccaggccaccctgggtgggctgtattcttccagggaaggcagattcctccaggcaaccctccccttgactctctctctgggctggggaatgagctttctcctcttgctccttcaggcctaggagaagtaagagtccctgtccctggactgcagcatccctggaagtatgatcaaaaccctgtccagtcccatggaaactctgcagtgccttttattaagcttcctgtatttccagctacaagatgccatgtcttcttaatccagaccctgaccgagaaaaccattaggagatggctcaggagtatttctccttgttccagctgaagcccaaatcatccttcaatgatggctctgactctgcaggttgcccaagacaaggaacccagaaaacagggcttttgtggacgaggcagccatgaacctgccctgtctcgaaggttctttggggattaattgttgggactggggataagcgtttctgtttcaggacttctacctccagaaaagaacagagggaggttggaatcagagggcaacagagccactaagataatatgtgaaaatgctcccaggaaagtcagaatatgggaaaatctgatgacagcgagatactgaatgagaattgtttttaatccgccaggaaaggaagtggctctggggagagccactgaggagcaaatcttttaggtgaaatgtgctaagaaagggaacttaggaaaggttttgctttggtttttgttagtttttacaaagaactagggctttgctgattatgtcattgaaaaaatatgtattggctgggcgcagtggctcacgcctgtaatcccagcactgtgggaggctgaggcaggaggatcgcttgaggccagcagtttgagactattctgggcagcacagcaagattccatgtctacagaaatttttttttacataattatccaggtgtggtggtgtgcacctgtagttccagctagtgggaggctgaggcaggaggactgcttgaacccagaagttcaaggctgcagcaaggtatgattgcaccactgcactccagctggggtgacagagtgagaccctgtctcaaaacacacacacacacacacacacacacacacacacactgccctcacaagttggagcatacttacattaaaggctttattgttacctgatttgaattaattaggcatcctgtgttttccctggcaaccccacccaacgcgcagtgtctctggtcacagtgcctggaaggagcacattggggcctcacagcttccaggcaattgcacaggaggcagctcaaaacagtaatcaatcttgggaaattttcctgatttctgttttcatgtttacatttttattagaaaacaaaaagcattgccaaaagtggatgtttacaattgcttgggggtaaaatattactatgattcctgattcttgctgtaccaagtatcggggatgattagggagaagaaatccaagaatgctttcattggaaattcaggaaaaagtttacaccttgaagagggcaaggctgacgttcatatgcagccttttgactctctcgccccctagtggccatatgcctaaacaggggtttgcgttcctgctggtgacagttgcgtccccttggacttctccattgcactaactctgcagtaagtgaagtaataataaaatacataggaaggtgaaggtccaggcatatctaagccccaaaaccagtctgagcggtgcgtagagacagggccgaggtgcagatgctgcgctgctcccctgtagcctccagctgttttatggggctcctgggctaataggggaaaatctggcttcacaccctggggattgaatctgcctagagttggttgcctttatttacactcatttacccaacaaatatttctggagtgcctactatatgccaggcaccgtgccaggtgctaagcatcattacacttcacatccttcactacgatatggagttaaacgaaagagtttgcacagagttctagaaattgtacccaaagcaaactgaacacacagctaggcacaggcagaaatttgagaactgtgaggggatctatataaccaatgaccttttagttaaactaatatccctgccacatcctttctttataactcatatatacacggtttcagcatcttttttgataaatggtcattagacttcttgacaactatttataattcggcacccagtaatcaatcagagttgcatatggtacaaaattaatgccatgtgatgtgcctggagccatttctgacttatggaaaaaagatggtgttggcagaatgttgaattttcatccctgtttctagaacgtgcaatgctgacttgctgacattgaaagaatgtaccaacagaaacctattagagcagtgaacttgttttggaaatagttgggttgggcctatttgtggtagcactgaccaaagtcaatcagggaaaagaactgaggcggaatgttgaaacataacctgagtttgttcagcagtctggagcatctcccaacttccactaccctatgtgcaatttaatttctacatcctgccaattttacttcctgagtatttctcaaagctttgccttctttttatctttataattcccttagtttcaaatctcacatattttttcctgaattactgtaacagaaactttattgtaatctcttttcctgcttctctcaaatccattctccacacagatttatctcaaacacaaatctgatcatgtccttagtctgctattgtcttgttcatgactccatggtgcttgcaggacacagttcaagctttttgtgcatgaaatgcatggacctgacacctgtcctggtgcgcggaatgcatgggacggatagttgtcctgccacatccaccatcattccatcatctttcctatcacatccctcctggggttttgcaggtgctctgaattggtctgtgagcctattgagtgaatatccaaacatatgcatccacctctgtgctgtgttgcttatgagttttctccttggtaaaccaggtaaccctgatgtgaccgaatgccattattcaaaacatgttatgagtctgtgttgttttaaagagtcccattatcagtgggtaatatttctgtccgattccagaagcttactgcccttctcttccccacttctcagctacagagaattcttcagctaattctctttggtgttcaggatttcattaatcggattctgacctcaacataaaatggaaatgtttgggatactgggtgggcgtggtggctcatgcctgtaatcccagcattctgggaggctgaggcgggtggatcacctgaggtcaggagtttgagaccagcctggccaacacggcaaaactccatctgtactaaaaatacaaaaattagccaggcgtggtggtgcaggcctataatcccagctatttggatggctgaagcaggagaattgcttgaacccgagaggcagaggttgcagtgagccaagatcgtgccactgctcttatctcgaaaaaaaaaaaaaaaaagcatttactcaggatctgtgtgtgcctcgggctgtggtaggaaatggggattcagagacaataaagctagtcttactccttggtgacctcataaatctcatgaaagaggctcacatataagcaaagaaagtgcgacaaatgttcaaaaatctacggcttctctgatcaatgtcaacatccttggcctccaccactggcaaactggggcttaatagttttttgaaaaactgaaggtgtgagtgagtaacgagatggatgaattgatcatctttggcctaaagcagtactctccgaactactaggccttaggaggcaatgttcagtattacatgaacaagccaggtgtggtggctcacgcctgcaatcccagcactatgggaggctgaggtggaaagaccaggtgaggcaaggaattcaagaccagtttgggcaatatagtgagaacccatttctataaaaaatttgtagaaaattagccagacatggtggtgtgcacctgtagtcccagatactcaggaggctgagttgggaggaccacttgagcccaggagtttggaggagtttggggctgcagtgagctgtgattgcaccactgcaccccagcctgggtgacagagaaagaccctttctcaaaatagaaaagaattaaataaacaaaacattttacattttaatagttatatatttactatacaggatgtaagaaaatatgcaactgttttatcaaacccagaatctaacaataatatagatgagaggaagcttaatattttaagcaagtcagtataaagttaatactaatataaatggtaagaatttgacccaattacctcttaaagaccccacctttccacattgccacacattagtgattaagtttcaacatgagctgtggcggggacagacattcaaactatagccgaagagaaattgttgaagtttgggaaacaaagtaattttcactgtttccttttcttcaggttttattctttccccaaattcagcctacagttgactgttttatgtgcaaccaatggcaatttttaactatggaattgaaacctttgaaaagataagacaaagctgtgtgtgtatgtgtctgtttttaaagatgaatcaaactgtgtttattatttattttatttcataagtgattctgtaaactgaccacgtgaatgtcctgattttcatagattatgactggctcaggtgacaagaaatagacatactaataacctaagaaccttgggttattatttatatttggaagtaaggaaaaacaggaaatggctttcccaagcctcctgagcagcatttaggagacattttatatatttttatttatatatttatatacatattttaggataacatttaggatacagcagtagtggcatcaggctgacagaaactctgggaaacccacagtacactgtccttcccccccatgcacccctgcccaggcttcaatgtctccactcctgcttccttctctacctcctgctgctacgcggtctgctctgctgatctctctctttctccttttctctctttctttggtttgtgttgcctcatggcttttggttgctgtcacttttttcattattttttaatttttttttttttttaagagatggggcctcgctgtttcctaggctagagtgcagtggagctatcagctcactgcactctcaaactcccgggcttccggctaattttctgaaaatatttttgtaaagatgaggtctcgctgtgttgcctgggctggcctcaaacttctgggctgaagtgatcctcccacctcagcctcccatgtagctaagactacagacaagagtcaccaagccaccatgccactgagccactgtgccactgcaccacctggctatgcttgctgtctttgtgcacctcagctttcgcctgccatactgcctgcatctggggtgaccaactcaacccagttttcctgggacttttccagtttcagcaccaggccacacccaaagtcataggtgaactgggatgtttggtgacgccacctgtatcccttcgctatatatttcatattcgaattctgtaaaggagaagaggggaaatctgactggatctctttgtcccttgtccaacccggggagcatctgagctcttccagctgagcctactgattgcaccagtcaagcttgggggtgatgaaaggaagcatccccagctgcctttctcagaaggggcctgtgagcagagtgagcctgggaatatcatcaggtcctgtagtccattttccacaccagtttgtatcagtgctgctgctgaacatgttgggtgaaggtatgtgcagatgagaggtggcagtagggggcaagcagaaacaattttaaaaatcattgcagcagctgggtgccatggctcacacctgtaattctggcactttagggggctgaggtgggtagatcacctgaggtcaggcgttcgagaccagtctggccaacatggtgaaaccctgtctctaccaaaaatacaaaaattagccagacgtggcggcacgcacctgtaatcccagctaccacggaggatgaggcaggagaattgcttgaacccaggaggcggaggttgcagtgagccaagttcccaagactgtgctccagcttgggtgacagagcaaaactccatctcaaaaaacaaaaaaattcgttgcaccttttttacttttatgaactcaagcgttacacaaattaggctcctaatatagtgttatggaaaccctggcccaaccagtcattaaatattttatcccactcaatattgtccagttcagagattgtaaattttgcaaaagggagtgtttacaaagcaaaacgatgtcatctgggaaatgaagaatgttaagctctagcagccctggggagaaacacaaaatgcacttcggcttagggcagagaagcttagccatcaatactttgtaaatcctggagggcttcctctacctcctgcatgccagcaccccctctacccacttggctccagaaattagtccttctgtattaaaactgtttttccatctgcaaggaacagaagtccccaccctgccctaccccgcctctgcttccgccccaccttcaattctgtggactgaggtggggagagaaaaataaaatcactgtaaaaatacttaacttctgaagcacgtgactggctttcaagaattctataaactcgagggtgaggcacttgaagaagttggaggcatggctcagggcaaagcaggggctacagtgagccctttgagtctctggacacccctctcgagcgcccccaacctcctgatcacccctgatcctcctatccagcaccccattcccaattcttcctggtgttctgagacccccgagggagtgcaggctgcacgcaggcaggcggcccagccccgggtgctgggtgaccccctcagctccaggtgtggctgcaggactgtcagcctcccgggggtgacatggaaaggtgaatgtatttgcactgcgcctttcattctgtaacatctgtgtctctgtttctcttaaagcctatggccatcactcaaccggaggctgagaactgatgaaaaagtggaacaaaaacaaaataaaactagctgcgttgttgaaacaaagtcaatttcagtgtttatttggcagagaagccagtagaggtgatcaaagtgatcagggcaattcacttgtttcgctggccctgggagggaaggtgaggagctctgaattccaaaggtagggggagaggagagcaaagctcaggggagagagcggtcaggaaactccctgggcacaggcaatccctgccaggactccaagacaccagtcacaggcttctccttctcctgcatcagggtgacctgcagggccctgttctcggagcctccaccctccaccctgggctgcaccacggcccccaagccttcatgagcaccgttgcccaaaggctgtgctctggttgcacccttgctcccaagctcccctcacaggcgctttcccctatcctagcagctccacgtctcctctgctctgagggtggtttccatctttggcctcatcctcctggaagccctgccccccagggaggtccctggcatcacagtcttagcttacagactagaggtctcagtgactagagcaggcgcccagctgcagggagactttgataaatatctatggccgaactgcatgatgccttagggctcttacagcaatgccccccaaataataccagacccaattctatagttgaaagaagaggaattttagaaaataggtataccgggccaggggcagtggctcatgacagtaatctcaacactttgtgaggccagggctggaggattgtttgagcccaggagttcaagaccagcctgagcaacatagtgagacctaatgtctacaaaaaaatataaaattagccaggcatggtggagtgtgcctgtagtcccagctacttgggaggctgagggtagaggattgattgagcccaagaagttgaagcagtgagctgtgatcataccactgcaatctagcctgggtggtggagtaaaaacttgtcaaaaaaaaaaaaaagaaagaagaagaagagagatacctccccttttattcttcatttccatctagcaaaataataaaaataatattgatgattgaggggtcgccttggacaattgccttggacttcagtagtgaaaaaagaggataaaagatcctaaggtattcatcaagtataacagagcaaaggctgaacaggaccctggagacgagaaagatgggagagatgagagccacacgttcgagaatgctccaggagtcagtttgttcagcagcaaagttgggggatgttggtgggggaaacagggagaagtgtactccatgatcctagttttggcaacttgattggttccccttccttcttgctccccctaccccccaacccccacctccacaggtcactgcagctttgagaaatggcagaggagaagctcaagggcagaaaataagccaggagagtctctttcccccaaatactctattgaaagggttgataatgaggcactgtgggtaaagcaaggtagcaacccaggtgcttgtatctgtagaagctctcatattctcgtggattccaccctggcccttcaggaactctgggaaatatgccatggttttgctccctctgggataaaaggggtgagcagatacatgttacacttttcacttataagttgccacctggaatccagactttgtctgcagtgaccagagggcagagctgagcggggctttcaagacggtatgctgcacagatgccagctctggccacagtgctgtgcacacggggtctttgctgcccagcatctatcttccaacttaaaatagataaaagaaaccataataaaaaccaacatcaatgggttctcttaaaaagaaagcaaatatgcttaaagtattaacacattggatctatgtgtagtttcacatcatatgaccacatgaggaatttgtgtggagtagcaggagagttccaagacatttcatagggagatttgagtgttggtgggtggcgaggggctcctgggcacctcacttattgtctggcaggatctccttggagccactggaattttaaggactttaagtaagggaagattggttaccctctggagagaatgctggaggttacctggtgaaattgttgctcttaacgcagaagggaaaattctgttttgatctatgagtcatatagaaatgtattatactatggaatctgcgaaattgtttgttagtggggcttgtaatacggtccgtgtgaggctcacacctttgctctaattattgtttaagattaattattttttaattattgtttcagattcttttatagggtctttgttgggaaactcaaacagtatcattatgttcccctcacatttggaaacctaaggcgcccagagggcttatcttgggatcacacataggtggccatctgtgctggtttgccagggacagtcgtggtgtcttattgtccagttgtaattattaatagtgtctactttccctctcacaaatgctggtttatactaagtataaggtcaccctaaccacctgacacattgctgtcaaaactaggattggagagcccacatttcacatgcgccagatcatccatttaagcaaatgttatcccagttgttaaaaatcctttatttctgacttacagggcctcataccatagcagcctgtcttttagaaacagttaatgtggaacacatcaaacacgaggcctctggttgaaacacttttgttgacttctttgtttttcactttgttttaattgactctcacagttatgaatgcctttgaaaagtacattttaaggacttcagcaagcattaattatttcttttgtgtcctgatgtcaagtcattttcaactatctggttcttaataggatttaaagtgaaaaaatattaaatatgtatcagggcaattccacttactcttggttcttgcaatgatttctctgttgaaaaacttacataggccaggcacagtggctcacgcctgtaatcccagcgtgattactttgggaagccaaggtgggcgaattacctgcggtcaggagttcgagaccagcctggccaatgtggtgaaaccccgtctctactaaaaatacaaaaaaaaaaaaaaaaaaaaaaaaaagccaggcgtggtggcacatgcctgtaatcccagctactcaggatgctgaagcgggacaattgcttgaaccctcgaggcagaggttgcagtgagccgagatcgcgccattgcactccagcctgggcgacaagagcaaaactccgtctcaaaaaaaaggaaaaaatgccgggcgcggtggctcatgcttgtagtcccagcactttgggagcccgaggcaggcagatcacaaagtcaggagatcgagaccattctgactaacacggtgaaaccccatctctactaaaaatacaaaaagttagctgggcgtggtggcatgtgcctgtagtcccagctacttgggaggctgaggcaggagaatcacctgaacccagaaggtggaggttgcagtgagccgagatcatgccactgcactccagcctgggtgacagagcaagatgctgtctcaaaaaaaaaaaggaaagaaggaaaaaaggaaaaatttacatgaaggaagttgacatgctttccacaaccctataattggcctgctgagaaatcatatgcaattgtttacgatttttgtgattaattctctttatggtgaatgccatttacgttgcgttatcaacaccaataatggtccagttctgtaacgggttagctatgactgcaaaatcaccatttgtctttacagcactcttttatctcgtcacttgtctttccttttaaatgacatttgttttatgtggtagctcattttgagtcatgaattgcaacatatggaaccactaaccaagaaatagtcttgcacctttccctgttaacagaaacggagttgaaaacttagcctcctggtattattattattctagttctttatatgactggaggaaaatcagatttcaagttcttcccgctttccttatgcctttcacagcaaatttcaaagtatagcagtaggcagattgcaatgtaatagcaatttttaagcccagaaattaaattaaaccagaaagaaatacacctacttctagttcaaatagtgtttcttccagaaagaagaacatctccacagtaacagcagtgacaataagagtattttcatgaagatcggagttaccaggtttatatagattgcagaatacagctactgttttccagagacactgacaatcagtgctaaattgttaggaaggtctctgtgctttggagaaagatatggaatagtcggtgcaagggcaaatagagtgccttctcaaattgttttcagttcctcttcttaaggaggaacaaaaggccagtaagtaatccaatagaagcttttccctatagaatggtcagaaagtttgatcattcaaaagaacattattttaccataaatacatgtctaggtttcatgatccttaatgattcatgttaattctcttcccccaatgcctttttctgttgtgcatatcacagagttttgtttcctggaatatcagcagagagggcagtgggcttggcccgtatgggggaggggagggtcctagcagctggaaagcaaggtcggctgaccaagggggttccttgggctgcctggaaaatggtagttcagacctggtgggagacatttccctatttttgtccatctaggggtcaacagaggcctgaaagactgctctgacaccttccaaacagcccccaggaaatcttaatcagcatctgccaatggatcttttctgcctgggttgagctagccaggagggccctggggcagggtgctgtttgtggctgccaacggctgtggcagccctctgctgcctccttcatcctggggtttttgcctttgtgctacaccaaatgacaggtaggagctgttaagcacgggctctctggacaccagagcaaggggattggggtcacaaccaaaggctgcgggacatctgatttgggctgctgcatctcctgctacagtgtttctctctctctctctcacacacacacacacacacacacacacacacacatacttttctcccaccctcctccccactcttcctagcattaatactttaaagacaaatacacaacagtatacaagaatcaggatgatctggacctgaaaggctgaacacagcagggccctccttcatgaacattttgcacctaaggaaataataaggttaaaactagattcatctggcctttgcccaggggccaccaggacagaaactgtgtaagattagttcctccttaaagcaagattgccaggtaattctgttgcaaagtcatagagaccttaagttatctgccctgcaaatcccactgcctctattcaggctgccgaggcactgctttaattttttgaaagattcaccgcgtcttcttggatttcaagaaaaatcccgttaagaattgaggggctctcttcttcccctcctgacgtgagtgtaactcacttcctggtatgtctcctttccttttggcctacatcctttgtctgttaggtgcttccacatccttatgtcttaaatggccaaaatacgtcacccccactgccaaaacacacaggtcactcgaggtcacaatctggaacataggctggccattgttcagcacacattcttgatctaaatcaatctcaaaccttgctggaatgccctgtaaactggggcaaagtatggtcaccagactaaccattgtccttttttacccctcctgtgacggggctactacaggttacaaaatcgcgctcttcctcctagctactgtgttactctgagatatctgacatcgcagagctaatgttgcctaaattattttcccatcctcttttttttttttttttcggacatcatgcctcctattttcactctctgggaactctgccagtttttcaaggactgggtaaagaacaaaataaatatttgtaggtggtttaaaaggagaagtatgttggttgtaactctgcctgtccaaagaaatgcattttcactgtctttcagatttttggagtcgttaactgggagagcttcagaagattgactttactagtttacctttcagatttgtgattaagggctgggtgtgtgtgtgtgtgtgtgtgtgtgtgtaagtgtgttgggggagggaggagtctgagaaagtgagcaagtacgtagaaacttttttttaaaaagtccagattaagtgattgaaatcgactgtgtgcaaatgacgctatacctcttcatagatgttaatcgggccctaaaaagttagtgccggaaagtgcttacttacaacactcagcatatactctttctttcaaattgtttgggatttttttttaagggagttcactgaaatttgggaggttcaacaggttgctgttttttaatatgtggatcacccgatttgggaggctcactctgcctctgagattaaagagatgagggcactggctcccagcgaaggctctcggccttaatcatgtgtgaaatgttttccttcctcggctgcagagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcagggtaagtaacagacccattcaaagatggagttacagggacgcgtgccccttgccgcttgctgctttttataaactgcagctctgggacccggcaaaggaaaaaaaaaaaaaaggcaatttcttgggatggtacattttccaaactgagtagagcatagagaactgtgatttcttaggcttgactttatctctggcacgattttcttaagcagcaaaagaggtggtggggtgatgtcacatttgtagtgcagtgagccatcagcatgagctgtatctctaagcaatgacaaataaatcactaagcagcttttaatcatttccccccggggctccagccacgggagaaaggagctgtttttgtgaaactgtctctaggaccgcagcttccattcattggttgggggattccatgtggcagatgcatgctggctgcaaagtttgtgcagaattttagagttaaatcacagaaaccaggcatgttttattttacagatccgagcagcaggggagggcttgagcatctgggtgatagatagaactctggatcttcttttatgttttaattcaaaacttgggagttgttggacaattttggtaaattttctccaggcagtttccctttaattgtgtttataatagacttgtcttttccgtagggaatttccagaagcttatgttgttccaaagaaatttcgcaccgggttgggtggccagaggaggtccctgctctctggcatctgatgcctgtgatgccaagagctgattctgtgggatcctataggcagcatgttcataaaccacacagccctggaccacccgccccaccctccctcaggttcatgcaggggccagtacacaacaaaaagacgtgcgggagtgcagtgctgtgcgtgggagtagggattatgcacaggggaaaaggtgtgtgttttatgaaaatgtgaaagggaagtaacacatgactcatccacgctgaaaatgcaaagctaagccagtcaggagaacttacaatgacaagagatagaaatcccccagtgaaatgcagaaaacttgaagttttgtaatggctggagaatccctgagtctgaacagtcatctgtcgaagtgtctgccttcgtgctgccaaagcacagcactctccttcaggctaccggggtcagtggcatccagtggaagataaggctacctcgtccccctgacccccgcaaccccccacccccattttctaggacaggatcctacttcaggaattcaacctctgggcctgtcctgaaagagatgactcagattctagaggggccattagaaagggatccatttaagaaatgactttccaacaatcagggcaattcagaggcttcagaggctaggatggtcagcctgagacagtgtgctcctttgctcactaattcattcattcagtgaatattgagcatctgttatgtagacgtcactgttttagctgccagacatccagtggtgaacaaagcagactaaaaatacttgccttcatttaacttccagtgtaaggaccaagtttcagggggtggggagctggtagagacagacaatgaacaaataaataaaatatatagcatgttagatggcacggctgctggatttagcaaataaaaatacaggaggcccagctaaatttgaatttcaggtaaacggtgaatttttttttttttagtataagtatatcccatgccatatttgggatatacttatgttaaaaatacttctccattatttatgtaaagtgcacatttaactgagcagtcctgtatcttatctggcaaccctatttgatggaaataaggttacagagaaaaataaagcaggaaaaggaataaggagtgaaactgtaaataggattattagaaagagcttcgctgaagtgatatttgaacaaagacaggagaggtaacagcagggatgtaatgttttcaaagaacagcaagaacatgggagaaggatgggaggaaaagagattgagaggtaatcccaggccagatcacctagggcccatgaaaccattgtaaggactagagcttttattttgaaagaggtgggaatctcctggcaggtgggactactttttttttttttttttttttttttttttagagagggtctcatttgtcacccagactggagtgcagtggtgtgatcatagctcactgcagccttgaactcttgggctcaagcaatcctctggccttagcttccaaatagctgggactactgggacatgccaccatgcatggttgtattgtattgtattgtattgtattgtattgtattgtattgtattgtattgtattgtattttattttattttagagaaggggtcttgctatgttgcccaggtgagttacaaagggatttgtctttttaaatggggtaatactgggtgctgtattgagcacaatccaagtagggttgagggaagggcagggaggcctttaggaagcttctgcagtcaaggaggcaagaaccagggctagcttggaccaggcggtgattagcaggcggtgataagccagcagattctaggtgtatattgaaggtaatgcccaaagcatttcctgtagcctgggcagcatagtgagaccccatctctagaaaaaaaaatttagctaggcatagtgccctgtagtcccagctacttgggaggctgaggcaggaggatcacttcagccaggaggttgagactgcagttagccatgattacaccactgcactctagcctgggtaacagtgtaagattctgaaagaaagagagagagaaagacagagagaaagagaaggaaggaaaaagaaaaaagaaaaaaaaagaagagagaggaggggaggagaggagaggaaaaaagaaaagacaaacaagacaagacaaaagcaattgctaaaggattcaacttgggatgtaagagaaaaagaggagtcagagacaacttccaaaattttggtgtaagctgctgggagaacggagttgccatttgcctaagttggggagtatttacgaagaacagatgagagggtgtttatggtttgaggttctgaggagcaatcttttgatagattaggattgagaagtttatcaggtatccaagtggagatgttgactacaatttggatattaatcactagagctgaaggaagactgagaactgagagatcccctaagattgaatctgtgtgcagaagaaaaagtccaaaggatgccccccgaggcagtccagcatctagaggtcagggagattggaaggaagggctggaaaaaatagcaaaagtggaataaaaatccaaattagatttttaaaatcctgttcagttctgggtgaatatgatgctgtagagaagcatggcttcatttttagttctcccggtgagcacgagtgccgcaagggagagcaacatctctgatgctaacatcacccataacgttcatttctatcattgcattctctcttgtgtctgcctgtgtatctgttttacccaatgacaatgtgatattccacagcaaggaccatgttttatttattcacgtttgcatttccagcacctaacagagcactgggcaacctaacagagcactcactgggcactgtagaaggcactcaataatcatttgttgaatgaaaggctaattttaccactttgggactttgagtttattatcctgctatagataaggatccctagggtgatcatgtaacttactgtccaaatgagatccttttgaaagtgaaagggaacactcaaataattttactgggacaacagttgtaacccagagctgttttggcaaactggggtatatgatcaccctaagaatagctctaatcaatgaagcttccatggctgaatagcccggctaccaggtaaataacaatggggaagtgtagcgcatagtgtgctttgcggagtaggcactcaacaattattggtggaacatgaatctaactgtatcatattctctttgaagcccatgggctctacattgtgaccctggggcataggcattccttgggatgactctgtccacagcagtcctgacgtgtgtgcttttgctctggttcctaaggtcttgaaacctctatgcaagtgaagtgctattagcccacctgcttgccttccccactgtctgattggcagcctcccatcgagtgcaagcctggggaatcagatatgcagaagcctcctctaaaacagccccctcagtctctgtacccttatcccgtttcattcttcaaagcacttaccgttacatgacatttagagtctatatgatttgtttgtggttggcctatttcaaatgtggactcctctatgagggcattaagtctgacttgatctacttcacactgtatctcctaactcctttcagtgtgggagcaggcagtcaataaatatttgtatgaatgaatgaatgaatcaatcagtgcttgacacagaatgcttttctgggaagaggagctcctgtctctattttgtctaagatctataccagaaatcctcttcatcactggtaaaattttaaggtactatagaggaatataatgacctggtttcagctgtaatttctgtgctgatttgtatatatattatgatagtaacaagggagctaaccccatcactttgggatgctgaggcaggaggatcacttgaggccaggagttctagaccaccctgggcaacatagtgagaccccatctctacaaaaaaaaatgtttttaaagtagccatgcatggtgactatgcacctgtagtcccagccactccagattctgaggcaggaggatcacttgagcccaggagtttgaggctgcagtgagccatgattgcatgactgcattccaacctaggtgacagagcaagaccctgtttctaaaaacaaacaaagaaaaaaaacaagggagcttgaaaactgagggatgctgtaggattctgcggcctgctaaccgattatgtgtattaatcagataggctaattgttgtaaccaccctctaatcttggtggctttgcatgattaaggttaattgttcactcagacacagcacagtgtgatttctgtggccaggtggatttcctgggtggccgatgaggctcctcctgccttgtcactatggcatcccccacggcgttggagggttctgctggatcctttgtattcaactggccaaagagtaaagagagagagaacgtggaaggttatttgggaggtctaggggccccaacaaaaggtggcccacatggcttctgcccacaatacattgactggaattagtacaaggacccagtgagatggagatggctggaaaatgtggtcttcctctgtgtgcagcagaagagcgttctggtcgaacacatagggctgtctctgccacggtacacccagagaggttgtacaaccagaccaaacagcaactccctatgatgctccctatgacaagagagcttctcagcacaattgagaaggagacagctaaccagaagccactagaaagaagtgagggatgccttccctaagagtctgtggcctacctaatcttgacccaggaataggatctcagggaagccatcagcactgttgctggctctggagcaggtgtggaatgcctgagtggtgcaaggccccaaatcccttgctgcaggtcagctgacccagccagagtaacccgagttgtggcaaagaagctggccttggcagcgcctgcagttgcctgcctgccggacttgcagtgcggctttctccttgaggaggccccatcttccatgagcctctgcgtgtttggtgtctgccccagcccctactttctatgctttctttccagaatgccaaatcctagcctgggagctccttggattcctgaagagtgtccctttagcatttctgcctgccttgtcctcacttctccagggaatgttccagggattttgctcggctttaagctcctatgttgctctttgccctgcttgaagtgagctcccaggaggagttgccctgggctctgcagaggctgggaggggcaggaaagggaaacaggactgcctttcagcaagcccaagccttgccttcatgctacagcttcattattttgtttgacaaggattcccagaatagcgaacagctagacacacccatatttaaatgttaacaccaaagcgcattccaaacaagaaatcgaattgtatttctgttttgatgacttggataatccacacttgagcttttctctattcatgtggataatgaggagttggccaggctcagatctctgacaacatggctgtggaattgtgactaaatgtcctctgcctgatccctctctagtttgtaatcattcttagtttttctccactgaaaagaccacattctccttaaatggctggaatggcagagttgttgcttctcccccaggtgtggggcttgacgcttccaagagctgagccttgtcgaggaaaaggctcaagtgacagatgtgctgaagtgcctttgtgtggaaagtggcgttaggtggctctgagtgctggtgacaggagagcaggtgcctcgaggtaggaggggaggcagacaggatgatagagcattgggcattgggtggaaggcacaaggcaggaaattgagacaaaaggaaggagtgagctccaaaggcaatccgatgtttgccaagtggctgcattgagccttctagccttgctagtggttgatgctttttgtacctttcctctaaatcgcatcaatccttgttaagcaactggagatattttggaaaaatccacaagaaagagaaaaaacagaaaagcaacatgaggtgaaaagtgctaggaaaaaaacaggggtctgatgagtctagtccagtaagtcagggctgctcaaagattaatgtggactgaagattggctctgacccccaaaactctccccttccatctcccttcccaactcatttcaaagaagaaagagggtttattgtcccggctgtcttgaactctcttgatgctctttggatgaaacagaatagatcatatgagcctgtgcagcatagtaaggcaggatgcgactttctgccgttattgccgttggacatgcatggatgtttatctgtatggctgtatgtgtgtatgtagacagatgtgtgtatgcctgcataagaaatcacctttccagaggctcaatcctgttaattcatctagctgtcctggataacttaaaatatattttcttaataatgtcaaaactaatcttccaattccacttaaaagtcaatagcattgctgggtgtgatggctcatacttgtaatcccggcactttgggaggctgaggtgggcagatcacttgaggtcaggggttcgagaccagcctggccaacatggtgaaaccccatctctattagaaatacaaaaattagccgggcatggttgcgcacggctgtaatctcagctactcgggaggctgaggtacaagaattgctcgaactcgggaggtagaggttgcagtgagctgagatcgcaccactgcactccagcctgagtgatggagtgagactctgtgtccaaaaaaaaaaaaaaaaaggtaaaaaataaaataaaatacataaaaataaaaataaatagccagatgtggtggcacacatctgcggtcccagctagtcaggaggctgaggcaagaagattgcttatgcccaggaggtaaaggctgcagtgagccatgatcatgctactgcattccagcctgggtgacagagcaagaccttgtctcaaaaaaaaaaaaaaaaaaaaaaaaaaaggcaagagtgttagatcaagtatacaacaattttggctgatatgaaacacatgcacagcactcaaaagataaagctaaacctcttcagattgcacaggtatttatcaacctgagagacagcatttttggcatctagctttgttcagtagatcctgttatttctctgttattaaggaagagatcattttaaaggtagccatgatgtgagtctaagtgttggaagcgcaacctaaataaatgaaatgacagtttagcccccaatatcttttaaaccaatagttccatcttcttctccttgtaaacttactgctgaaactaatgaaaagtagaagaattgactaatttggctgtgcttttccttcccttccccatcagtgtctgatggagatgctataattagcaatgtaatgagaattgaagggtaaacaagaagaattattcccagaacacacatcaagggttagaagactggaacaggaaaaccagcctgagatgaaaatattttctctgcccaaccaacgggcatctatacctagagttctatatacagatctttctaggcaaagacaagggaaagagtggtggtcacattgctttcaggaaactggtttatgcctagactcttaacacctgttgctttgcaaaactagtgtgaaggattggttctctgtttatctgggattcaactgagcagaactcccaaatattaaatctgtatttttctgcacttaacttgtaaagataaataattggcaaatatgcttctattggaaacttatttttaaaaaaattagaatagttttaaaagatttagaggtagaaggctctttgcatacctaatgttagttcagtcgtcttcattttattcatgaagagaatgacactgagagaggtcacatcatttgttctaaatgtcggattaaagccaagattcctgagatccagcctagtactttttccagggaattcagtggacaaggaaacattattctgcctatatcagcaatactttatgataagaactgttcttcgtgaagagcctgacttcatgaagagagcctgtctaactcctgaagtgcttctgaatgttttactttttctccctaatctatttgttttttttaaaaaagtaactcttttttctgagctagctggaatattcatacctgacaccccatctcccaaccatcgaggatgaatggagattccctttacatgctccccactctcagcattgacatcatatgacttggttgatctgttcttagcagaaaccaacttgtcccttcaaagccagctcagaaggcaggatgtcttaggtccaggctatcaggatgtaccattgctcttccttttcactgtgttttaggtaaagtccacctcaagtaaaatttgtctaagcctttactttataactcctcgattgttactttttttttttttcttttgagacggagtcttgctctgtctcccaggctggagtgcagtggcgtgatctcggctcactgcaagctccgcctcccaggttcacgccattctcctgcctcagcctcccgagtagctgggactacaggtgcccaccaccatgcccagctaatttttttgtattttcagtagaaacggggtttcactgtgttagccaggatggtctcgatctcctgacctcgtgattcacccgcctcggcctcccaaagtgctgggattacaggcatgagccacggcgcctggccctcgattgttacttctgatggtattcttatgcttgcttggtttatgccaatatgagaaaataaaattttcaaatggttcacatgtgtcaatgattacttacgtacagggtgatagctatttttgttcttggtgatgaagcaaatgtttcagaaacccgactgagcttatataagaatcctgttaccagaatgcaactgttattaaaaatacagaaataatcagaatcactggagttaactctttctataattacagacaaggataaggaataaccctattgcctgcacacaagtagcctaaccaagtgttcttgagggttttcttgtttttgtgttttgagacagggtctcacaactgtcacctacccaggcttgaatgcagtggcacgatcatagctcactgcagccttgacctcttggactcaagcagttgtcttgcctcagcctcccgagaagctgggaccacaggcgtgcaccactacgcctggctaattttaattttttgtagagataggggtctactatgttacccaggctggtctcgaactcttgggcttaagcgatcctcccgccttagcctcccaaagtgctggggttacaggcaggagtcgccatgcccaatgaacatctttatttctaaagtacgatttttcatatttctttgattgtggattttctcccctgactgctgcaaagcagaaaaagaaagaaaaagaaaaaagatttgcgaagttaacattcatacattaacaactgccgcaaaccctcttggtgttctgcaaatgagacttctagtgtgaaatcattaattgtgaaccgaatttttttgtctttcagaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccaggtacgaatatgctctcatttctccttgtgtagctcgctctctaatgaacatcgaggaaagcaaacttactttctttgtaaaaggtaaaggatagcttagtggactgtgcatactatttagttgttctggatttctttggggccttgggaggaggaagccgggtgtagaaaacttctgcctgcaagctcagtcttctttgccaatacagcaagagaacaggaggccaggccagagaggaagggcctagagagtatgcagttccccaaaagagtgttcccatgttcaaccacaaacacatctaaacacatctaaagtgcagggaatgaaggggtattatctactgaggaaagcatggcaccaactaccgtgtaccctgaaagcacggagtgcttagcactgtgaatgaatgaagtaatgaatgaatgaatacacaaatacataaatgtattttcagggtaaaatagatcttacagatacagacttgtggtaactccttttccttaaaaagctgacattagggttttgtttctgctcttcttttttttttttttttttttttttttgagatggagtcttgctctgtcgcccaggctagagtgcagtggtgcgatcttggttcactgcaagctctgcctcccgggttcacaccattctcctgcctcagcctcctgagtagctgggactacaggcactggccaccatgcccggctaattttttgtatttttagtagagacggtgtttcatcgtgttacccaggatggtctcgatctcctgatctcgtgatccgcccacctcagcctcccaaagtgctgggattacaggcgtaagccactgcaccccggcctttttttttttttttttttttttggagatgggttattgctgtattacccaggctggagtgcagtagtgccatcatagctcactgcagcctagaaatcctgcactcaagatcctctcatctcagcctcctgactagctaggactacagacatgcagcaccatgcctggctcattttttatttttggtagtagagacggggtctttctctattgaccaggttggtcttgaactcctggcctcaagtgatcctcctgcttctgtctcccaaagtactagaattacaggcatgaaccactgtgcctggcatttttttcttttgaatcacagatgtgctccttctgcatgcgttgctttgtgctagctttctgtcttcacctacctgtttcctctggttattttgacagtcatatagacattacccaactgtggctagggatgtttttgtttcttggctgtgtgcaattacttttagcagatagagcaagtttggggtcacaggagatttgaggcctcctctaccgacctcactggcgagttaccagattgacctttgtgtatggagaatgtagggaaggaagcagaaagcacttaaccatatatgtgacgggtgggggtgggaaggagggcaggatgatattgatttccacacaagggaggaaagctcagtgttttaagtctgctgtcttcccagttaggtgcaaaaattatgtctaactcactcagcctttgattatccatggaaatggagattggcatcagcccgaataattgaaatctatactttattctcaatctcatattcttccttaaattcaatcttctcttctagagaatcattatctgagtggctaaaaatgtgaaacgtgctttatggacttcatgtttgctttttgttcacacttccaacagtcagtaaacccagaagaggagaaaagaaaaagaatcctggttgctataaggatgggctaatgattaattctttgataattttaaaaagactctgggcacagtggttcatgcctgtaatcccaacactttgggaagccaaggctagaggatcagttgaggccaggagcttgagaccagctgggtaacatagcgagaccccatctcaacaaaaaaatttaaaaaaattaactgggtgtggtggcacacacctgtagtcccagcttctcaggagactgaggtgggaagatcactgaagccccaaaatgagaccccgtctctaaaacaaaagtatcaattttgctgagaaatatagaaattggcctgtcaaaaatggtatatttttccatgtcaaaaataatgattattgttactcttcttatttgtagtgttataattattgttattgctgtaataatggtggctttggttaaaacaattacaagggaagcctaattataattaaggttgaaaggagtaatgaatatattttggtgttctcaagctctgatctgctgttacatacattgctagttctgccatggctggccagctgtcccttctctgataatgagggatgaacaagtcacattctatctttctgcctcttttgtactcgaagctgaccatccaaaaggagagagtttttaatgcatgaatctatgtatacatttttattctcttattaacaggaaaggggtcctgatccagaccccaagagagggttcttgggtctcgcacaagaaagaattcagggtgagttcataaagtgaaagcaagaattttgtttgtttgtttttgtttttgttttttgagatggagtctcgctctgttgcccaggctggagtacagtggcgcaatcttggctcactgcaacctccactcacttcaacctccacctctcaggttcaagtaattctcttgcctcagccccccagtagctgagattacaagtatgcaccaccacacccagctaatttttgtagttttagtagagacggtgttttaccatgttggccaggctggtctcgaactcctgacctcaggcgatccacctacctcggcctcccaaagtgctgggatcacaggtgtgagcccccatgctgacaaaaggaagtttattagcaaagtaaagaaataaaagaatggctactccatagagcagccctgagggctgctggttgcccatttttatggttatttcttgatgatatgctaaacaaggggtggattattcatgcctcccctttttagaccatataggataatttcctgacgttgccatggcatttgtaaactgtcatggcagtggtgggagtgtagcagtgaggaccaccagaggtcactcttgtggccatgttggtttggtaggttttggctggtgtctttactgtgacctgttttatcagtagggtctttatgatctgtatcttgtgatgacctcctatctcaccctgtgacttagaatgtcttaaccgtctgggaatgcagcccagtaggtctcagcctcattttacctagctcctatttaagatggagttgctctggttcaaacgcccctaacactgtcattgcccttctgcaagcaaaccccaaccagcattgtaaacaccagagatcggtgtagacatggcctatgaaattgctgcagacatcatctcatcttctgtcttttccactctttttctcctaccacccatttcctctttcctgtcttcctctctgcaatgccatttgttcctcctggaccttctcagtatggactatcccaggcttcctttgcaggaagattacacagccagctgtgagaaggaagtcagataacacacatctgatgctctcctccagatactgaggctcttaataccagatgctcttctggcagctgtttttctggcttcctctcagagaagtatccttgataagaagagagccaatcagcaagatagagaataagatgttgaaagtgatgtatctgccgtctaacatgaaatctcttaaaatctaggttcttttttttttttttttttggaagacagggtcttgctctgttgcccaggctagagtgcagtggcatgatcatggctcactgcagcctcaacctccgcggctcaagcaatcctcccaccccagcacccaccacccaccccgcccacccccagataactgggagtccaggagtgcttcatcatacccgactgaaaatctaggttctaatttcctgctattaaacataagaagaatgagagcatgccttatgtttccaaatctgacttcaaacactggaagattcacggttgcaaaacttctgtttgtctttaaaaaatatgttggtcaagagttttctttagtctaaaattattgaaaggctaagaggtcaccttaactcccttctacagtcttcaaaaaatgcgggtggcccttattgcaacataatgctgatctgcataatagtagctgtgatcgttaaggactcttatcagcataaccttagttgtgcagggcagtcaggctgtacagcctcattgcctggcagctaagggcttggtttggatgcaggtgggactcatcaggatccagccttcacaatatgctaattctatgatttgggctaatagcttaatctttctttcttttttctttcttttttttttgagacagagtctcactctttcagtcacccaggctggagtgcagtggtgcaatcttggctcactgcaacctccacctcctgggttaagccattcttgtgcctcaagcctcccgagtagctgggattacaggtgtgcaccaccatacaccatacccagccaatttttgtatttttagtagagatggggctagtctggaactcaagtgatctgcgtgcctcagcctcccaaagtgttgggattacaggtgtgagccactgcacccgaccttaatggcttaatctttctctgtttcagtttcctcgtttgtcaaaggaaaatagtatctacatcatggagcactgagaaatacaacgatggaatcttttactgtttcactggcagcttttagcgtgataatattctggtttttagtgtcccaaagaagagtctcagaggctcttatttttaaattagtacttaaaatcatttgacttttttttttttttttttttgagatggagtctcactctgtcacccaggctggagtgcagtggcgcagtctcggcttactgcaagctccgcctcccaggttcacgccattctcctgcctcagcctcccgagtagctgggactacaggcgcccaccaccacgcctagctaatattttgtatttttagtagagacggggttcactgtgttagccaggatggtctcgatctcctgacattgtgatctgcccgccttggcctcccaaagtgctgggattacaggcgtgagccaccatgcctggcccaatcatttgacttttttattttttcaagacaagatctcactcttgtttagagtgcagtggcgtgatcacagctcactgcagccttgaactcctgggctcaagtgatcctctcaccttagcctcctgagtagcaactacaggcacacgtcaccacttctggccagttttaaaaattatttgtagggacagggtcttgctgtgttgcccagattggtcttcaaagcctggcctcaagcgatcctctcgctttgacctcctaaagtgctgggatcatgagccactgcacctggcctcacttgacttttttgtcaacaaatatttgagcacctgaagaggttaattttttccattgttaaagaataactttattacatttctgaaactggtatttttctttcattcagtgcttagtattcatatttcttttatttatttatcccatatatatttatttggcacctaccatggtaaaggtatttgagaagaatgcaaaccattggacttaaccctgtcttcaattcagtaaaagaaataggcattcacatataaagaatagtctttccagatccagcccagatggcatgccttctgagatggtcataacattgcagtactgcagtacttacattgtagcatctaatcaggttgcattacatatattttttacatttctttttctcacctagaataatcttctggaggtagaaaccttgtcttaccacccatttcttctttcgcctctgtaaactcagcatttaaaggaatacacaacctagattaggctagatccaaaatttctgttgcgtgaaggaatgagccactatttctaatacagttagaatgtgatagatggtacagatagagaggggtacagagccacagaattcaatgattgattgcagtttgagcagtcagaaagaagagatttcttaactaagaagttaggaatggctaagtaattttcccctaagttaagaagtcaacatttgaaccagggccagaatttcctgtcctcagaggaggtctccaggaaaaaaaaaaagaatttccagtttatggtcttttcattcattatgggcctatggaccttggttttcttaaaggttttcttccacctctaatttttccaaagtttgttgacatcatgtacatcacattgggtcaagcaatagagccatagacatgacttccattgccgtttctttaaaaaggcaaatctgactgggtgcggtggctcacgcctgcagtcccaacactttgggaggctaaggcgggcagatcacgaggtcaggagatcgagaccatcctggctaacacggtgaaaccccgtctctactaaaaaaaaaaaaatacaaaaatacagaaaattagctgggcatggaggcacacgcctgtagtcccagctactctggaggctgaggtgggagaattgcttgaacccaggaggcagaggttgcagtgagccaagatcgcaccactgcactccagcctgggtgacagagcgagactccatctcaaaaaaaaaataataataataaataaataaaggcaaatcttactccattccagagcatattaaataaccaataaccatagaaaatagattcctatctgtattttatataaaaagaaagttgcttcttttaaaaactctgagttcagaaagatctgtagtccagcaatccctcacagttgtggtcactgtgtaactgcacagtttggaaatgctattttttatgtcttcattaatgaatagatgttgatggcttcttacttgcagaaaccaactttccactcctagtctcagaaaccattctgaaattaatttttcaatctttactcccagttattcacagaatttctacctaacttacttggtatatagaatctactctgtggtttcagttagtctatgtggattcttttatctgatgtgctcagatcataaaagaaacgaataatacattttaacctaaaaatctgacatgtccaacaaagagtaagagagatataaagggattattattattattattattatcattattttgagacagagtctcgctctgtcacccaggctggagtgcaatggcgcgatcttttctcactgcaacctctgcctcctgggttcaagcgattctcctgcctcagcctcccaagtagctgggattacaggggtccgccaccacacccagctaattttttgtatttttaatagagacagggtttcactatgttggccaggctgatctcaaactcctgacctcagatggtccacctgcctcggcctcccaaagtgttgggattacaggtgtgagccaccgcacctggtcgggattattctttaacatgaacattacagggggcaaaaataaggagataagaaaatgaacaccaatatgagcactttttttttcttttttttgagtcagagtcttgctctgttgcccaggctggagtgcagtggcgcaatcttggctcactgcaagctctgcctcctgggttcaggccattctcctgcctcagcctcccaagtagctgggactacaggcgcccgccaccatgcccggctaattttttgtatttttagtagagacggggtttcaccgtgttagtcaggatggtctcgagctcctggcctcatgatccacccacctcggcctcccaaagtgctgggattacaggcgtgagccactgcgcccggccaatatgagcatttgaaacagggtcagtgaggccaagaggtcattcttctggtttctcccatcagaccagggctttgctgctgtctgagtgcccctcaggcttccttagggtcccctcctcaaccatcccctcctttgaatgtgtttgtgtaaaaactgctctggagaccaggagagctggctcacacctataatctcaacacctagggaggctgaggtggatcacttaagtacaggaatttgagaccagcctgggcaacatgggaaagcccctactctacaaaaaatacaaaaattagatgggcatgatgactcgtgccagttggggggctgaggtgggaggatcaattgagcctgggagatcaaggctgcagtgagctgtgattgtaccactgcacttcaccctgggcagcagaacgagaccccttcttaaaacaacaacaacaaaaaatcaaatataggttatcataagaaagctgcaaagagaagtatgtcttaaagctgatgtattaatcaggattgtctattaggttggtgcaaaagtaattgcagtttttgccattacttttgcaccaacctaataggttatgctacttaacaaattaaccctgtgatttattaatatttgtggtattttctgatatgacagagaaacattttatttcttacacacacaaatcttattctcacaatgacttaggaattctggctacttccctcttgcgatcatgccatctcaacacatggattccaggtcaccatgacagagagagacagagctgatgggttgtatacacgctcttaaatatattggcctggaagtggcatatgtcacttcacttcatagtagcttcttggttctagtacccactgggatatttgttgtattcaggttttggctgtggaatctagcttaagactaaaatcttcctgctctagtttgtttcatcagctctcccaatgtaattgattattttatcaattttgttatacctagcactttatctgtacaatgacgtcattggcatttttacagaatataaacatattaacagatattcctatctgtaagtaatggcatctatgtctttgtgacttatttttgatgaatttaattgtatcaaatcaaattgcagaactccagcatggactatgctgtatgctgtagatctcagggagtcagtttatacctcagggaataaacgtactaccctctgttatgtgtgaaaaactccaaattcattagatatgcatctgtcatatttgtcttggctctgatctatatctgtctattcaaaatttacgtacatgcatctatatttatgaaggtaccttccagtgaaggctgaaaagtaaggctaattgaaattaagacacatgtatactatacactgttcagtaagtcgcagcctttggccacagtgaaggtctggatacaaggctaatgttgtagaaagtgtatgttttgaaaaactaggcatgttttgtaaataaataaataagtaaaaagtttagaaatggaactagactcagctaagaatttcctcttcagagctattaatttattctaatccaatggcgaaatgatgggagaatagccacatgtagtagaagcagctacttagttgtgtgaactaatgactgaatatgagtttacagagctgtttcttttttatttttattttgtttatttatttattcttttgagatagagtcttgcactgttacccaggctggagtgcaatggcacaatctcggctcactgcaacctccgcctcccgggttcaagcaagtctcctgcctcagcctcccaagtagctgggattacaggtgcccaccaccatgcctggctaatattttgtatttttagtagagacaaggtttcaccatattggccaggctggtctcaaactcctgaccttgtgatctacctgcctcccaaagtgctgggattacagtcatgagccactgtacccagcctcagagcagttttttacctaaacttttgggaggaaaggacataaattttttagcaattaagaaatctagtatactgtgtgcacagcaaataataatagcaccaaaatctcacaaatcaccggtgaagaacttactcatttaaccaaatactacctattcctcaaaaacgtatagaaataaaaaataaataaataaaatattaataagccacaataggaagagggaagaaatatccttatgcaaactatgaagaacacagagaaagccagtaacatgctcagtattttttttagcactgttttctcaacaaatatttataatggtggaaaagactgtaaggagaacgtattatttgccatcagctaaaattgctgtgctgtttctctttacatgtattacaggttgagtatcctttatctgaaatgcttgggaccagaaatatttcagatttcaatttttttggggggtggattttgaaatatctgcattatatacttactggttgagcatctctaatttgaaaatctgaaatccgaaatgctccaccatggcctttgagtgtcatgttggtacgcaaatatctcagattttggagcttttcagatattgaatttcaagattagggatgccgagcctgtagtgtagtccatcctctctacaactctgttgggtaggcactactatttgttttgtttttttttttttttttttttgagacagagtctcactctttcatccaggctggaatgcatcttggcaggtgcgatcttggctcacagcaatctctgcctcctgggttcaagcagttctcctgcctcagcctcccaagtacctgggattacaggtgcctgcaaccactcctggctaacttttgcatttttggctaacttttgcatttttagttgaaatgtggtttcaccatgttgcccaggctgatcttgaactcctggcctcaagtgatccacccaccttggcctcccaaagtgctgggattacaggtgtggggtaggcactactattaactatagttaacagaatgggaaactgaggcacaaagcagttcaggcttgtctgaggagacacagcaagtaagtggcagcaccagtatttaaatccagttatcttcctgtgggagccttgctcttaaattctagatcagaccacctctctgatgggggatgaaacagaaagatgttctgaaatgctaaggaaaagaaagactggactggggaccagtctgcctcgtgtcagtaagtgtgaatgagatttaacgctcatcctgcaatggatgaagtgccagcgtcctggttggatttgcctttaataatttgaagaagaaaaggagtttggcactgaagaagcagtagtgtgcctgcctgtagtcccagctacttgggaggctgagctggggggatcatccatgcccagaggtcaaggctgctgtgagctgagcagtgatcgtaccactgcactccagcctgggtaacggagtgcgactctgtctcaaaaataaataagtaaataataaagaagcagttgcatacatagtggtgagtacgcagaaagtgaaaactgagaaaaaaccattttcagagcaagcactgcacgtgaaaggagtatggtgtcataacagaatcacaagtcatagctggagaatttacaatattgtatgtgcgagtgtatatttaatggaatactggaggcccgtgagcaaagaatatgataggatcgaatcagtagaaaaacatctcttgtcctcagagaaattccagataatgttagatatgtctaaggaaaatcaggatgtggtcaatgatcaggaacaatagtcatttacatttggatatgatgaaaaacaaaagtaaaaaagaaaaaaaatgaacagaaagaagagcctaagatctaagagagatgatgttcctcaagggatgagatgaaggagctagcttggatgtgatacctggaggactgatttatttttcactcttgggtttttttttttttttgagatggagtccggctctctcacccaggctggagtgcagtggcatgatctcggctcactgcaacctccacctccggggttcagccttctgcctcagcctcccatatagctgggactacaggcatgtgccaccacgcctgagtaatctttgtattcttagtagagatggggtttcaccacgttggccagggtggtctcaaactcctgacctcaagcaaattcacctgccctggattcccaaagtgttgggattacaggcgtgagccactgcacgtggccgaggactgacactttgagttgtgactcaaaggtcgttgaagtacatctcagaagatttggaccattacatagtaggacatcttgcggcagagactgaacaattgaaaagactaaattcaggggttgtagttttacttgcaaaattgacgtacagttgacgttaatcacccagaatgcagaaaaacagcaaaggaatcctaaatggggatcattcataacacatcgcttttgatccatgtttaattgggtgccaccaacctcagcattagctttcattttaattagtgacatggaagagcaagagaacatatcttgagaacagtgctatattaaggaaagctctgcaagaaatcaaaataagattctactagaaaacctgctaaggagtgcccgggggtaggtggggaagtatggaaaggcaagaaccgaagtctagctaggcagtgtcaggagacacctggaaagtggtagtcagctagaggaaattgccacaaaattagatggaaattttcagtgttgagggatctaaaaaagaccaatgtgattcagtccagtgcatagatgcagaactcatactgcaaatgtccaaattgtccttcctgtcttttcttgtcaaacttgagcctttgccatttattcattcttcctgcagttatgttcttggattaattcattcaaatgcttatttatttattagggatctacatttcgaggttggcattgaacattatataaaaagtacaaggccgggcacagtggctcattaatcccagcactttgggaggctgaggcaggtggattgccagagctcaggagcaacatggtaaaaccttatctctacaaaaaaaaaaaaaaaaaaaaaaaaaaagaataaagaaaaattagccaggcatagtggtgtacacctacagtcccagatacttaggaggctgagatgggaggatcatttgagcctgggaagtcaaggctgcagtgagtcatgatcattccaccatactccagcctgggtgacaaagcaagaccctgtctcaataaaataaagaaataaaaataaaaagtacaaaacccaacatctgccctctcttagtccatttgtgatgcttccactcatgaccaaaaggggagcctctgtttgcagagatcacattgtctgagaggatgcaagagtgttgaagaggtgccaggctctttttaacaaccagttctcatgggaactaataaagtgagaactcattcacccctaagggagagcattcatcccattcatgagggatccaccagcctccataactcaaacacctcccattaggccccttcaactttggggatcaaatttcaacatgagatttggaggggacaaatatccaaaccatagcatgcactgccaaagagatatctctttagtggaaacagtacaaacctttgggtatgatttgagtatgggatgatccaggaatatttaatttagtattgaatttgcaagtagttgaggctatcattactcatttataattttgttagatgtgatcagagagtgcaatctctaaaattcttacttttaaatttcgcttaaagattggtttacaaagtttttcttagaataaaatacacaatcagtattgcatagatattcatggacatttatctattctgtattctatgcacatacatacgcacacatatatattgggtttgttgattgtattattcatttcttctcagtctttattttttaaggttgttcacttctgagcaaagtataacaaagtctcccatatcattgtatttttatctttttctccctgcgttcctaagaatttgtttcacaggtttttagttatgatcacaccttctctataagttatgtctttaacattaccagatgacctcttcattctgtttagtgtctgttaactttttaaaaatattatctctcttgatttacatttgtttgcatctgtcaggtatgccttatcattcattttcaatgtttttgtattaatacaggttgagtatccctaatctgaaaatccaaaatgaaatgttcccaaatctgaaactttttgagcaccaacatgatgctcaaaggtcatgctcatggaagcatttcagattttggatttttggattagggatgctcaactggtagctatgtactgcaaatattctaaaatccaaaaaaaaaaaaaaatctgaaacctgaaacacctctggtcccaagcattttggataacagttactcaacctgtaatgagcgtgtttattagaaactacatacatatatatcggccgggtgcggtggctcatgcctgtaatcccaacactttgggaggctaaggcaggcggatcacctgaggtcaggagttcgagaccagcctggccaatatggtgaaaccctgtctctactaaaaatgcaaaagttagctgggtgtggtgacgcatgcatatagtcccagctactcagagctgaggcagaattgcttgaacccaggaggcagaggttgcagtgagccgagatcatgccgctgcactccagcctgggtgacagagcaaaactgtctcaaaaaaaaaaaaaaaaaaaaaaagaaactacatacaaaaaacttggctttgctttttcagcctaattcgttaagtctgtttttaatgggaaattccgtccactagcatttagtgtaacaactgatggacttaattatattcctccatcttaatttgacagcaagtactgtatgtctattcttcttctctcttaaatgtggctcatgctatttaaatgcgaaacaatggcttgagtttaggtcttgacaagctgtatctgaaatgacagtggttgctccaagtgaaaatgactgttagacaattggagataaaataggactggaccctatgccaggaaacaagactagacagatacatgttggagggatcagctctattagtcacagttcttcagaatatcagagccaatagcagaattcctttttctttgggggacctcagtctttgcttctaaggtcttcaactgattaaatgaggtctactcacattatggtgggccatctgccttactccaagtctactgatttaaatgctaatcacacctaaaaaatacctttacagcaacatctacactggtgtttgaccgaacaactgggcaccataacctggccaagttgaaacatgaaattaaccatccccctctgcaccaacagttgacagaatgtgaatggataatttctaaaaacaagtaacaactacaatcaaacacagagccaaagatcaagggtttagcattagagaattaccacagttggggtccatgtttcattaaagaatccaagcattcttatcttttggtgatacttgtagtgtggtcttgacttacgaaatgtatatgtgttgttttctacctttttcatgtttgacagtttttctttagaccagaacttcggattgcagctatttcttaagagttgctatttcattagccttatcaacatcctagagatctgtttgccctggggttttgagggctaagccctgagttgtaatgcattaactctgttctgtgcagtccttctaggactaaatacagcctgcagctaaatacatactgcttctccaaggctgctgctgtgctgatgtttctgtctgaactaccccagactccagtaccgtctgttaactccgtatctcggaggatctgcagaaggtccgcgttgaccctttgcaatccagtatgcactttcaggctcatctactaaataaatcctttcagcatggcttcgtttagttaggctcttagtatcccaattatgagcaattttattaaactaggagtatcagtgcctggtagttaagtacaggtgttttgggtttaaatctcgggtcagcctgagttcaaatctcagctccaacacttaatagccatgtaaacttactgtaattacctaacctctctaaagctcaatttctccatttgtaaaatgggaataatgattgttcttacatcatactattgctgtgaggcttaaatgagataagggttggttatttgaatgataaaaaaattgatattttgcttgaaagaaagtattccttttctacctgacaacttccaattcatatttcttttctcttttcttttccattctttttctttttctttttttcgacggcgttttgctcttgttgcccaggctggagtgcaatgggcagtctcggctcactggaatctccgcctcccagattcaagcaattgtcctgcctcagcctcccaagtagttgggaataaaggcatgtgccaccacactcagctaatttttttgtatttagtaggtttcaccatgttgggcaggctggtctcaaactcctggcctcaggtgatccaccctactcagcctcccaaagtgcttggattataggcgtgagccactgcgctaggctcatgtttcttaagaaacaaaaattcaggccataaatagttaagtctaacctctttccccagctgtttgtgttcttttatctttgtgagctttttcagtgaggagtttttttttttgttttttttttgaggcatgttcttactcagttgcccaagctggaattcaggggtgcaaacatagctcactgcagcctcaaccttctgggctcaggcgttcctctcacctcaacctcccaagtagctgggactagaggcacacaccagcacgccgggctaatttttgcactgtttgtagagacggggtattgctatgttgcccaagctggtctcaaactcctgggctcaaaagatcctgctacctcagcctcccaaagtgctaggattacaggcatgagccactgctcctggcccgttttctacctctgctataaaacaggtttgttgaagcgaattcaagacagagagtcttatttgctctccaagtcaatcataggtacccatgatgttgctaaatttagaaaaaatagctcatctacatgcatttattgagctctgatttgattagtatgatgctaaggttgccatcaggcaaatcacaatgtcattaaggcttagtgagatgtttttctcattcagggatggtaggaaaaatcgtcactggactggccacctctaatcaactcttggcatttctgcccagccttcgtgtgttgtccttattgctgggatccttgttgccaaacactttcccagctctaagttgttcaagatctctctgtcttgatcataataatgtcaatgctggttacaaatttttctcttgggtttacctctgcctgtccactgaggaaacggttaatggagttgctttcccatctgaattctttctggactctctccatttgcctttacattctgactcttctcgctctcttttccaagcctgaattcaataagcaaaagctgagatactgtaatttcctaaataacccaaagggaagatctggcataatttataaccactctgactgctgaatcaacttgcacttgctcttctctctaatggaactttgaagaataactgtaattgaatagtgcctccaccccatcttcagatttgactgaatcaagcctagatctggttatatctggtttttgtttgtttcatgttgtgtttgtgccccactgagtataaagcccaagtgtgggcttcatctggatgtattttcatctcacagagacattaattgaatctctgacaatagtcttgcctccgaggagtgctccaactctggctgcggtattaaaccaaggtagttcttggttgccttcaaaggtaacctcccatctgttgacagtgaactacggcaatgcaacgcttacagaatcattggaggagaggatccaaagcgtttacaattccctgctatgcaaagagtcattctgagtttttttaacctatgattgctctctgtaaatacctgggtgcacccagcaaggtgtagaggttaatgtttgctctctgacctttgaagacagatgcactgaatatgttgcagtttgcaatgggatccgtggcaagttaacagcagactgctccttcagctactgctgtttccaaaactctgcagtgtcacatcttgctcgcggctgcctcctcagaagtgcttctcagcttccattcagctccctgctgagttcctctgaagaactttgtactgtggcatatgacagcgacctgataacattatgataaactcctatgggtttgaactcagtcctattcaaattttctggtgcctagtggtcagcagtcttagacctggggagtaagaggtgtgtctgcagtgaatttagaggtgagaagaaagagggctggactcagatattgagtatcttagagcctacggaccatttcccaaagcctagaatagatttcagcgtaattctggtaatttacataaactaggatagacatgcaaaatatctggatatgttaggaaggagttaaaaagttctccacaccttttcctaccacctctgcagccatagaagccgaggggaaatgcacacacacacacacatacacactctggcagggaacctgttttgcaagttttgctggtaaaaagttctaggaagggggctggtggagaacagagtggaaaagaagtatcaattgaaggtttttcaagacctgagttttcaaggtaactttatcctgcagagagagacacgcatggccgctgtaggtttttcttccaccaattaagtgcattgttagacagggaggggcagattaacgaacgcctataattttgatcattgttttttgcaaaacagctcaggctttgaaaatgaagccatcgttcccggctaagtttctgccaacagcacaaattatactgtgcagagatccaaagcccctaagaaggtttcattaatgaacaatttcagacgattgtttaagtcttcgcctgacaggtaatgttggcatgtcggcaggtggggttagggtttccatggagatttatgatgtcatgcttgaaagagcatgtcaagacagccgatttaacaagtagctactcaaaaagtcctataggctacaagtaggttttatgcaaatgacgagagtttcactgggaaaaactgcaaaagaaaacagcccagacatggaggggggttttacctgacagctccgaaggaagaccctggagtccgttccagacaaaaacttccagaagaattagattttctgctttaactgccgcctcacctgtggagctctgggtacaggtaaatatgcggggtttttttcttccaagtttttgccaaaaattatttggaaacatttcgctctgtttctcggcattgttctcttggcaggaagaagtgaatcaataagcccagctttcccatagcaatgttcgtgctaaagggctgtttttaagggcttttttttttttttttattgaatgaactgagatttttgaatagagctgaaaacaagcgatgcattgtgcgttctgctgattgtgcccggtgaatactgctataaaagtgccacagataagggttagatggacaatctgaaaattgagatgctccatgtatttcttatttattcccagatgtgtgtgtgtgtgtgtgtgtgtttgtgtgtgtgtgtgtgtgtgttcttttactcttacgacaaacctgaaattgagactatgggtagttttgtattttcacattgtaaaaatgccaaaaataaaatccatggaatgttgcagaaataatctttgaatcaggtttatgaacattgcacttttttaaaagtatgtatctgatgcttttctcaccgaggcatttttcccagactagaaaaaaacagtcctgatagagacatccagtttttgagcttttagggaagcaggatttctaaattccaagaagatagataaagacttcttggaggaaggtggggtgtgggtgataaaggtagtttttaaagcatggtttaaaagaaaatactggtcacttgggagtatgagggttttttttgtttgcttcggctgccagtgaggataagtaaacagtcttgccagccatttggatgtgatagcaatcactggatgcggctgtggatctgtgagttagctgaaaggggttagttcagaggcatcagttgccctgtgagtagttagttccaccaagcttaaaaagaacacaaagaaagcctattgtttcttccacacagtgcatggcagcgtgtgaggttaaagcggagttcagaatcatcgaaagatacctgtgaaatgggaatttggacttttgaaactaaaactacttaggaataagtggataggctttcaaaatgttttaagaactgcctcatgtgtgagaatgagacctcctgaaattttgcagttagataatgtggattaatgccagaactcacattcatattaaattgttaccacagttattgcaaaacagtgagtgacaaagaactgtgcctccaacatcggaagttctgggcgttgagttctggcttcaccacttagtggctgtataactagaggaaagtaaattcatgtccttaggcctcagtcatcatgtccataaaatgggatgccagtagctagctgtgttgtgaggattaaataacaaaacagacgtagcacagttctaagcattcatgttccaaatgttaatgattgtttttattgactgctgaaatggcattggatatttagaaagtgtttttatattctttacttcctcttatcattacaagtaatgactagcagtcaagtaaggctagtagtctttttttttttaaaaaaaaaagacagggtctcactctgccacctaggctgaagtgcagtggcgcgatcttggctcactgcaacctctgcctcccggctaaagcaatcctcccacctcagcctcctgactactggtgcatgccactgtgccaggctaattttttgtatttttggtagagatggggtttcaccatgatgcccaggctggtctcaaactcctgggctcaagtgatctacccaccttggcctcccgaaatgctgggattacaggcttgagccactgcacccggccttggctagcagtctatttccactttacagatgcagaaactgtggctcagagagttactgggaaatacgacataataaactatcctatactgcctgcactttttctcattttaggaggcatagaaaaaaaatgaatgtgttattgaaataactcccagcagcagcaatgattctgtaaagtaattaaaatacaaaatgttaagtatgccaaaggagccagggtatttatatttttatattaattatgcttttgccacttttttctagacaggctacagaagtgatattaatttactttttactggtacctactgataggagctccagtactgcacagacttaaaattttaaattctacctgcctgaaatttttcttggccatacaagtagagtcggattttaatgttacaggtattttcggagtgagaacccaagtcaccaaggggctgtggttgctacagggtgcagaaggagcctaggagtcgaatatactgtcctttattccttctgtattctagacgttggcacttcctcccttgcctctatcccagacagaaacacagcccataattatatcctacatccattgtatgtaagagacaaatatgtttttcattgtgctatttttagccacagtgtttctagctggggaaaacactctcttcattccagggttttcttaacaatttttccagtttttccatgtcagactattcagaattattcaggttccacactcctgggagaaggctcttaatgaagtattgagtaggctcatcgagggggattctagagggattttggcatctgagctgctgagcctgaactcattctatgacagatgatgtctgtggtcccatgaattaggctgcattgaggactctcattcccagcactgtttgggggcactgggaaaaggttgagttaccttatcccaagggtagatctataaggagaaaagcaaatatttatttatttgttttaaatttctgcttttatttttagatataggaggtacatgtataggattgttgcatgggtatactggatccagataatgagcatagtacccaataggtagttttttaacccacatcccacctccatccccactctagtagtccccagtgtattttgttcccatgtttacatccatgtgtgctccatgtttagcccccacttgtaagtgagaacatgtggtattgggttttctatttctgcattaatttgctaggaaaatggtattcagctccatccatgttgctgccaaagaaatgatttcattcttttttatggctttatagaattccatggtgaacatgtaccacattttctttatccagtccaccattgacggacacctaggttgattccatgtctttgtggatagcacggtgatgaacatagaagtgcatgtgtcttctcggtataatgatctatattcccttgggtatatacccaataatggcattactgagtcaaatggtagttctgttttaagctctttgagaaatctccacactgccttccacggtggctgaactaatttcactcccaccagcaatgtataagcactccctttcctccacagcctcaccagcatgttattttttgactttttaataacaaccattctgaccggtgtgagatggtatctcattgtggttttgatttgcatatctctgatgattagtgacgtggagcattttttcatatgtttgttggcttcttgtatgtcttcttttcagaattgtctgtttatgtcttttgtccactttttaatggggttgttttttgcttgttgatttaagttctttacatattctggacattagacctttgttggatgcattctttgtgaatattttctcccattctgtaggttgtttgctctgttgatggtttcttttggtgtacagaagctcttcagtttaattaggtcccacttgacaatttttttattgttgcaattgaaagcaaatatttatttcattcaaagttttagtttcaaatatgaatcacaaagctgcaattttagggtagaaaagagttttgaactcaaacatggtgccaaaactccaaataggttttgagtcactgatgaaatgtttcttaaattttattttattttcttttagattcagggggtacatgtgcatgtttgtttcatgggtacattgcctactggtggggactgggcttctagtgcacccattattcaactagtgaacatcataacccataggtaatttttcaaccctcacccccttcccaccctccctccttttgcagtccccagggtccattatttccatctttatgttcatatataccaattgtttaactcccgcttaataagtgagaatatgcagtatttgttttttttgtttctgagctagttcacttaggataatggcctccagctccaaccatgttactacaaaagacgtgtttcattcttttttatggctgtgtagaatattcacatatatacaggaatatatatatatatatacacatctatgaatgtgtagaatattcatatgtatgaatacatacgaatgaatatatatgtgtgtttgtgtgtatatataggactatatatacacatctatgaatgtatacaatattcatatatatgaatatataagaatgaatatatatgagtttgtgtatgtatatatacatatagatcctgttttagaagcccagtgaagctttttattacacttaattgtcgtagcgttcagagattatctttgatcaataagtagcgatcgcattgagcagagcactttacacctagtgggttttagcaaaggcttgtaaatcagatgggctgcgtgcagtgactgaagaagtctcctgcctggattcggatcctgccttcattacttgctcgtagcacaggctttccactgaagagcatatgaagttttgttcatattccaaataaaatagagcatctgaatttccaatgcctcttgataaaggaattagtggtctttaagtattacattattctctttgaatgtcatttttggaattttcacagaaatgatttcttcagaaagaaaggcactgaaaatttaactggaagttcctctcggctggctaccggggaggtagagagcagagagttctcctgggtgggagggatttctagaagctctttacagctgaggcccttttcatcgctatttattaatttgacttgatcagaagcaatccagttttgaaggtgtagtttctaaaatctctttatttcaaagaaagtcatcctgaagaatggtgtcatcccagatgaccttgctttttctcttcagatgtctggccacagaagggatcagcaggtagaatgggaaggctgttttcatccttgggcattaattgggcttccctcttttctttctttcttttttttttttttttttttttgagacatgtcttactctgtcacccaggcgggagtgcagtggcgagatgtccgcttattgcaacctccgcctcccggattcaagtgattctcctgcctcagcctcccgagtagctgagattataggcatgtgctaccatgccctgctaatttttctaattttagtagagacagggttttgccgtgttacccaggctgatctcgaactcccggcctcaagtgatccgcctgcctcatcctctcaaagtgctgggatgacagacatgagccagtgcttccggccagcttatcctaacggcaggaagctttgatacttttacttcctgaccacagacttagtaggcagcaggaacagtcttcaacttcctggttgtataattacaagagccaatgtgaaatattatgcatttggagaagcccttctctagagctcttatagaaaaggaatgtacagccaagtttatgggaagcatgaggatggtgagtccaaagtcaaggtaggtgatagcattggtggccccttgcagcaccgggagtctatatggcggtctaacttcgcaccccctatttgtcacttcatagcactcttcactttcactccgtttcacttgctcatgattaagcaacaaacgtggtaatggtgtttcctactctgagtttcactagatttagtaaacgcacatgatcatgctggtcccgtcgaagtgacgataggagtcctcggagctgtggtctccgccctggctggttgcacctgctctgtgctctgctcagatcatacaagatggagagagcagagaccccatcagagagaggcttctgttggctgcagtgtgacactgtagacttgccagaaagggctctctttggacctactacttgccactcagaagcaaatgggctgcagcctcatacgtttttggagtgaataagagaactaagattctgatggacccttggtgattttctctcttcaatattatgaatgttcatgaatgcccctcagaaggtcacagggatgtcagatctcattttctccccttccccttccccttccttttcctttccgagacaaggtctctctttatcactcaggctggagtgtagtggtacaatcatgtctcactgcagcctcaacctcccgggctcaagcaatcctcctgcctctgtctcccaagtagctgggactgcaggcatgtaccatcacaccaactaattttttttttttttcttttaggtagagccagggtctcactttgttacttaggctggtctcagactcctgggctcaaacaatcctcccactttagtctccccaaaagtttagatcaaaggtgtcaaccactgcacctggccaggtctcattttcatagcagtcactggtagtaaggtaaatgtgctgcagataatcgtttggcctgtgttttggagggacctttttgttttttaattgtctctttgaattttgcacaaagaagggttgcacgggctccgttcatctttaacttattatttgcatccttttttatgataagttttaagactactgaagaaagcagctccggtaaagagcctcacaaaggccaattttcaatttctcccttgtgggctgtgtgtgtgtttatgacggtcagaagaagacagactctcatttaaaactattctctcttcaaagcaattataaagtggccccatcatagataaacttgaccccttttaattgctggttagattgcttcttttttctctccctgttgtgaacaggactgcagtgaccatccttgtatctgtgcatgtgggaacgaatctgaaggacaaatttctagaatgtcaagttggattgctagttttggaaggtattgcccaaactttttctcaaaaacactcagtttattctgtcgatatgaatgttgcaggggatattatggtacgttcagagaatacagttcactacagtgatgccaatgtgtgaaatacacttgacatgtgggtaggaacacataaccaagttatatttagtaaacaatctaccgagcagtagagttaatatgatcccatttattattttattttctaacaattactagtgatactttagtttggttcttgcttttctaaactgttaaccgtgaacatgtaactatttaaaacttatgctgggtttgctgggtcatgtctgtaatcccatcttggaagccaaggcaggaggatcagttgaggccaggagtttgagaccagcctggccaacatggcgaaacccgatctctactaaaaatataaaaattagctgcacacggtggtgcgcatctgcaattccagctacttaggaggctgaggcaggagaatcactggaacccgatggcggaggctgcagtgaacggagatcacaccactgcactccagcctaggtgacagagcaaggctctgtctcaaaaaaaaaaacaaccatatattattcattaaatgcatgttcatgcttacttaaccaacagtatggccctttggcttagtctcatagtctatctgacccttattttcttttcttttttttttttttcaaatgcccctttcattatgaaactcttttttaacttttaatttaagttcaggggtatgtgtgcagatttgttacataggtaaacttgtgtcatggggctttgttgtacagattgtttcatcacccaggtattattttattttcattttagttttttaaatttctttttagaggcggggtctcactgtgttttgcccaggctggtctcgaactcctcctggtctcaagcaatcctctcgcctctgcctccccaagtgttgggattataggcatgagctactgcactcagcccaccatttgttttaaaaagggtggatcctatttgtataaaaagccatgtgcattttctgtgtacttgtctacacattaatttccaggctgggcgtggtggctcacgcttgtaatcccagcactttgggaggccaaggggaggcagatcatgaggttaggagatcgaaaccatcctggctaacacggtgaaaccccgtctctactaaaaatacaaaaacaaaattagcagggtgttgtggcgggcgcctgtagtcccagctactcaggaggctgaggcaggagaatggcatgaacccgggaggtggagcttgcagtgagctgagattgcgccactgccctccagcctggacaacagagtgaggctccgtcttaaaggaaaaaaatttctggaatgatgtccaataaatcagagagagggactagaagactaatgaggacagaagcttttattcttaacacctatattttgctaccatttatattgtcatcatatgcatataacattttaacatttaaaaactagtttaaacagaaatggttgccctggaatgtggcctgtgttctttcaagggaggccagcagtttctacagtggctgagatggtaccttcatctcacacacctacgcaggagtgcatttgtgctttgatgtggttgtcccttgaagaaggaagcagttctctttttcttttttcccttttccattataggatcagtcacttcttggggcattagtagtctcatttccagtggcatcttcccttggcaaaaggaatcccagataggacctcatctttctaaacaaatgctgttttgggtcctaaccatcccatgtttgctttgaatatgtttaagttgcctggaattatcaacaaaagaattaaatttattgtaggtcagggcatcttttgactcattgtataaaacattcactttaaatgtataccgaaatgtcctttaggccgggcgcagtggctcatgcctgtaatcccagcactttgggaggccaaggcaggtggatcacctgaggtcaggagttcaagaccagcctggccaacatggtgaaatcccgtctctactaaaaatataaaaattagccgggcatggtggcgggtgcctgtaatcccagctactaggggggctgagacaggagaatcgcttgaacttgggaggcggaggttgcagtgagccgagatcactccactgccctccagcctgggcaacaaagcaagactccatctcaaaaaaaaaaaaaaaaaaaaaaaaaaatgtccctcatacctaaaccttacctcttgctaatttgctgagggttcattttagataaaaggtgtttaggttttcatattatgtttgtaactgtatagctatgattcagtttcctaaatgaaaaaagaaactgttttaatgtacagactatttagatttgaaaagactgtgagagctttttcttttatagcaagacaagtcaagaatagaaggcacactgcgagagggatgtcttttgaaagaaaagaaacactactttttatattctcaaatcactgaagaaagctttagacataatttcaaacactagctcctgtttaattcagatgcacagaatgcattaaaaccacgagtgtagtggacgtgatttatacattctcttagcacaaatcagtacctatcttcactgtaattagacttttcttcctttctccttctcaaaagctacttttgaaaccttatgttttccctggacatattttctgtacttcataaaatagctcagttctgcaactaactgcaaatatttgcaaaagggaacaaatgtaaaataaacgtcccctaatgcagtgtttggtgaagaaacatatgtctgacattagttggttaacctgaaaaatagtaagaaacaactctacttaggggaaagggggtagaattgagcccgtactgtgcaaatcaagagaaagctataatttacgcaatttttattaaagagaatacaagtgctgtaggcttggggtggtgctaggtcatatttaagcctaattgagctttttctatatcattagaaaaatgggccaagtttcctatattatagggtaaatacaacattttcttcctgcaaatattaaataccactggctttttaagacgtaaacatccaaatctcaaatgtctttattcatgccaatgcaatacaataaaaatattccccatatacacttaaatcactgcaagtaagccttagaatccccacaagtattattacttactatatctcagaaactttcacacacattatttcaaatatagttctcccaaaaaaaccctgcggagagatacctgtaaaccaaggctgagactagcctagacagttcgttctttagacaacaggagtggagatttgaacccagctattgtgactcaagcaagcctagggcatgtttctgagatctctaaggtgtgcgctgtgaaaccggtggctcattttatgggttggatttccaaacacgactatcacaatcatgccaggaatcaatgactgacttcttgcctccgtggcctgaagttctcctctgcacctcctacctttttgccatttcagtgatgcaccaaagggtggagttgaagaacatcagttttgctgctgcttgttggcaatactctcaaaaaggcgtggggagggagaggtgtaactcacccctgaagtcaagcctggagattacttgtcaggaatgtcaaaagcatttgttaagcaaccttcttcctggcattttaagaagaaagccgcatacatagatcaaatcccttccttcagaaacctgtactctctgaacagagccttggaattcagcctagagaaagaatacttggtggttcatagaacttggttcacaaaagagtgcttgctgcccacgcattttgcacaatgactcccaaacacacagaatgcacattggcaacaattttacgcgtgtttccaaaagtgctgactggaattgaagggacacatttggcactttttttttttgaaatggggtctctctctgtcacccaggctggagtgcagtggcgcaatctcggctcactgcaacctccacctcccaggttcaagcgattctcctgcttcagcctctggagtaactgggactacatgtgcctgccaccacgccttgctaattttttttttttttgtattgttaatagagacggagtttcgccatgatggccaagctggtctcaaactcctgacctcaagtgatctgcccaccccccgcccctcggcctcacaaagtgctgggattacaggcgtgagccactgtgcctggccacatttgtcaactttcattggtcaatgattgatgcaagccagaataagaatagattgggccgggtgcagtggctcacacctgtaatcccagcacttaaggaggtcgagagagcagattgcttgagaccagcaatctgagatcagcctgagcaacacaggaagaccctgtcttcacagaaaaatgaaaaaaattaggccaggtgctatggctcacacctgtaatcacagcactttgggaggctgaggtgggtggatcacctgaggtcaggggtttgagaccagcctgggcaacatgatgaaacctgtgtctactaaaaatacaaaaaatagctgggtgtggtggtgcacccctgtaatcctagctactcaggaggctgaggcatgagaatcacttgaacccaggaggcggaggttgcagtgagccgagatcacaccactgcactccagcctgggcgacagagtgagactatgtctcaaaaaaattaaattaaaattaaaattgagcctgatgtggtggcacatgcctgtagttccagctatgcaggaagttaagatgggaggatcccttgagcttgggagatcaaggctgcagtgagctgtgattgtaactactgcattctagcctaagaaacagaaagagacactgtctcaaaaaaaaaaaaaaaaaaaaaacaagaaaaaaaaagaaagaaaaaaacagatcagaggccctggcctggggtcagtttctccagaaaggcctgcacaatggagttttcatgtaaaaaatttcttacatcctgattttaaaaaatcagatgatcaggaaacattgagttccgattcctttgttacaacctccactaaagctaagtaacagctgctgtattaagatggggctccccctctccatcccacacctgcctcccttacatgcctaactcctgttgtaaatagggaccctaatctgatgtttttgtagtccctttcctaggggcactgtggggaggtggaaggaatttcacctttgttgttggacagacttagatttgagaactggttctactacttactgtttgtgtggtctgggacaagtcacttggtccaagtaagcttctgcatctgttaaaaaaaaaaaaaaaaaaaaaaaaggggcggggagctaagaattcctgcccagcaagttggtttgcagatcagaggcagtgtgtgagaagtacttaacccagcacctggcatatagtagatgttcaggacatcgtagcaggaataagggagacatctcacaaaacattttgtgagaaaggatcagtttctatctagtcaatgtcttaaacattcataggttgttcatggtgggagctgctcgaggaatcatcctagttttatggaggaggaatctgaagctggaggaattgtctccttcaagattacttagttaaaggcaaacaggttcatagccagtggctcttcaccaacccacaaaaaggcctcagattataattttgaagattaagtatatgaaagtgctatttgagtgattaagtgtaagcatcagatcattttgaactggtgagatggctcacacctggaattccagcactttgggaggcccaagagggaggattgtttgagcccaggagttcaagaccaacctgggcaacattgtgagagcctgtccctacaaaaaataaaaaaaaattagccaggcatgctggcacacacctgtggtcctagctactctagaagccgaggccaaaggattgcttgaggccagaaggttgagcctgaaatgagctctgattgcgccactgtgccacaagctgggcgacagcaagacactgtgtccaaaaaagaaagataattttgattagcacaaagatgggacagctacatgtgatcagatttggaaaaaaaaaataaccattcattcattcattcatttactcggcactgattgagtctagtttggacaggtattgccctagtctctgggatgacagcgagaggcaaaacacagacactcactgcctgcatagagctcagaatgtaatggtgggaaggcagaggaggaaacagatatacagataattttagatggagatacctgccatgaaggaagtagaggaaggccaggtgcagtggctcatgcttgtaatcccagcactttcccagcactttgggaggctgaggcagaaagatcgattgagcccgggagtttgagaccagcctgggtaatatagcgagaccccgcctctacaaataattaaaaaaaaaaaaaagaaataggattacctgaaaaggagccagtcttgcaaacagccgggcaaagagtgagcaagagttttttgggaagaggtgcacacagcaagtgctgagacccagaggaaggaaggggcttgtctgctgaaggacccaggtgccctgggagaggtagccagaggcgcttagtaagcttcaatcaggattttaatcttaatatagtgctgagggttttaagcagaagagtgatagaagagagttagcttttgtgcaagcactattattcatggaagtcccctttcgatggggtagtggggactcctcactaagctgtccttctatctctgtggctgtctcagagaagcactgtggaactccagggtgctacgtagctcaccacggtgacccccaatgcaggccacttacagaagcttgaagatctgtgatttgctcacccaggctcccatgccgagtgttcttgtcattaactcaaaagccaaatgctggtatttctgttcttacttgcttgattgtttgtttaccagttctcaacatcttcagtgtccacttggttactaaaatgtttactccttagcccagtgtgtaggcatgtgcctgtaatcccagctactcaggaggctgaggcagaagaatctcttgaacctgggaggtagagattgaagtgagccaagattgtgccactgcaatccagcctgggcaacacagcgggactctgtctccaaagaaaaaaaaaaaagaaaaggaaagaaaaaattatccaggcatagtggtactcacctgtagtcccagctgctcgggaggttgaagcgggaggatcacctgagcccaggaggttgaggctgcagtgagccatgatcaggccactgcactccagcctgggtgacagagtgagactctgtctcaaaaagaatataaaaataataaaaataaaataaaatgtttcctcttgatcacaaaaaaaaggatatagttctatgcaatcatgtctgaaacaggatacgtgtgtcatgcatccctgagttcgggttacctcaatgacatgaccatttacctaatctttgctttttcatctgctctcaattgaaaagaaagaaaccattaattatattgaaagatgctgacttgtaagcttctcccctctcctggctcaggtcagttgctcagaatgcacccagcaaagattggctgaacaaagacagggagatgttgtgagtcccactgatgcccttaacaccgggcattgttcaacttggggtcatttgtgaaaatgatgggaatgcaacttcctcactttacagatgagaaaacagcctcagagaaatgctgggatatgggatatgagttggtctcatagcctgtgagtgccagagccagctcgaatccaagtttctgactcacagtgactcttatccagcaggacgtattcttcagaggccatgtgttgaaaacagttaggtgggttgggggctgcaggccataccattaggaaatggggggcatgtcctctgggtggttcctaagcatttggatgttacagccctgcctttctttattctgttgttctagaagctccaacctggtatgcttttaaggcagatatggccacaaatgaagcacattcacatgactgcactgcctttctggatgaaacaatttgaccaaacactggtgttgagacagttggtgatttgggctttgccacgtggtgggaatgacacaataaatatattttgatatgaattaggtaaagatctgtctctaaccttgggctatatgtgaacattaactgcccattggatactggggaactataaatgtctccgtccaactctgttcaactctaatttttttttttttttgagacggagtcttactctgtcacccaggctggagtgcaatgacgtaatcttggctcacagcaacctctgcctcctgggttcaagtgattctcctgcctcagcctcccaagtagctgggattacaggagcccgccaccatgcccagctaatttttgtattttttagtagacacagggtttcaccatgttggccaggctggtctcgaactcctgacctcaagccatccacctccctcggcttcccagagtgctgggattacaggcatgagccatgacacccggcctgtaattttctttaaagactgccactgggtggaacccactgggcccagtgagaactacggaaaagagacccattcttgccctcattgttagtgtccacatccggatttacctaaaccccacccaggtggcatttgcatagtaatgaaaaaccggtattttctagctgtgaatcacacttcaaatcctgagcggctgactgtcaggggtgcgtcaggcctgcttgctgggagaatggacgagctggttgtggagcgggcgggtcccgccacccgtgggctcagcactggactgctcccagaacattaaaggtctggctgatgttccatgccacatctggacatgaagacccatgtctgcccttctgtagaagggccaaagaagaaaggaggcatcacatgtttctgctgtggggggcccttccgagcagcagacaggagcaaggtacaggagtggcctgattctggggtttccctgccccccctggggtccctaaactgctgtgtgatatgtttctaactatctggacagctcacccaagagtcagttgttcccagtcgcttcttgctgaggataagccaaaagagggccgggggccaatctggtttctttcaagtgaaattatgcttctcaagcagagaatgattgcccacagcagttaaaccttgtttaatggtaattaaattgcttttcttcactttgaaaaatctcttaattttctgtacaaaggcaggaagcatttttctttgattctacaggatgtttctaagtatggtgtaatcagttcatcttaccttgccgggctctgaaagaatgagtgtgtgggatcagatttagaaatgcctcaaaggttagaaagccgagtgctgccgattaactcaagctcagatgaccaaaaaaaaaaaaaaaaaaaaaaagctgcttttcccctcacttctccctctggttctgcctcagtactttgcttaggagtttctaaaagcaggcacagttgcctgcggggctggtgtgtgtcaccttcgcaaagtgcagatgaggtctggcatgtcccatcttgttcctgcctgactacaactctgcacacagacagtgttgatctggcttggagcccatagtggcaatccttggagtggaggcagcagagatctcagttcttcctagtgcttgagaagttaactaactgtctttcccatgaggaaaatgttttgagactgtagaagcagagaagagacttcgccaaagcccatagaaaataaaaagcaaaccctcaagcatgaaaatccctggccctggagtaagtgcaggtgataaggcttgctatctgatgcctcattccatgtctctggcttcccattgcctaaattaagatgtcctgaaagaaaccttgggaaaaaaaaagcacagtccccacatttgaagtagaaatagaattaaggagaaattgtgattttcctgaaggaacagaaccaacactggttttcaaaagccttagttttacattttagtagaaactgttagcagtaggaggatttgctttgtgtgtgtgtgtgtctgtctgctttgccttattttggttctgaccataccactgctatctcagtcttagaggctgattttgtggcccagagtgtttcgttcagatatctttgtgttgaggtgatattgagccagcagccaaagaaatgcatggccaagatatggaatatctggtcaacagagaataacaacaaagtgggacgcatcataaggtcataggtcagtgaaaacagctgctagccatttatatgcaggagagaaagaaggcccagggagttggaaagactgaaggtattttggactgagcagagcaaagggatttggggacatataaatgtatgaaacaagatggtcaggaaaacaatttttttcaaaggtagcatgaatagagtgaggtaaggaaacccatggccatggtactggtggcctaatgggaaaaggcagtgtaatgacttctacatggagacttcagttctgcccctcgtactgttgaagaatattctgtccagagaggctcttcagtttctacctggttttctaatggctttaaaaaactttggtgtattgggggaatggaaacaaagatatttactagagaagtgtttggcaaaaagtgccaagcttattcctgagaaaggatggaacggcgtggggggtggagggagggttggaaccatactccaaattcccctgaggcccacacgtgttcaccagacatctgtggggagcccggatgagatgtggggcccttcccctttctcattttcttttttacttttagatcctggatcaaaatgagtccttgattccctcatcccatcccaggacccttttttagttgcattaccacctagtgaagtctaccaagtcttgatttgagaatcaaaacaaactcagatcaaagtcaacctcagggaatcagagaacacagaagctgaaagatgtatccagccttccctaaatggcagatgaggacactgaggccaggaagctcaggtgacttatccaggagcgtgccagtacttagccaaagatctggaactgggactgatgcttcctgaaaacagattcctgcctggagtgcatgaccctgcttgagaaagtgcagagggacagtgacaaggcgggataacgtagcagtcccagcgacttgggcacccatcctgatgcttcccctaggccccagtgttttattttctggtaaggccagacctgagtcaggtcctgcctcctaactcctttctcttccttcagtgggcaacaaagatggccacagaagcagagaggggttcctcccaggtacatatttaccagtacttgtaccttgcgcttttaaaaactctttagccagggatagtggtgcatacctataatcccagctacttgggaggctgaggtgggaggatcacttgagcccaagaggtcaaggctgccgtgagccgtgattatatcattgcattccagcctgggtggcagaatgagaccctgtcccctcaacctaactctgatgaggactatattacaagtgttatataccagattctggatggagaagggaaagtgattgtagacaagagaatattatacttggttgctgtgttctccaaacccaaacgcatagatacacacagacccacagacacacacacacagacatgagcgggacatatttgaaatcctcactggttttgaaaatctgaggctaatagttggaggaagtgaggggtgactgtgagagaacaaatgtgtaacagatacaccctgagaatcagggctcataaataaggagtagagtctattgcacctaagccttactactagcctaagccttcatactagagcaaaaccgtgggcagacagcacacaaaagcagcccctgtcactcaggggcttacttcttttttttttttttttctttttttgagacggagtctcgctctgtcacccaggctggagtgcagtggcgcgatctcggctcattgcaagctccacctcccgggttcacgccattctcctgcctcaccctctcaagtagctggcactacaggcgcccgccaccaagcccggctaattttttgtattttttagtagagacggggtttcaccgtgttagccaggatggtctcgatctcctgacctcgtgatccgcccgcctgggcctcccaaagtgctgggattacaggcgtgagccaccgcgcccggccggcttacatcttaatgagcccacagctgcctgttgacctggtgtcatcacgagggtgatcactatttccagcaagctctttgtccctcaaagcccagggatcaggggcagcccgtggaagacgagccactggttccagcgaggcacaaggagagaggttaagctgcttctaccctgttcaactgtgatgagattccagcgaaaatcagcattgagggcctcaggtgtttgcagggggctctggtatgttagaaaaactagagggaggggtctgcctttgtgtctgtttgtgagcgtgtctactcaagtaggaaaggggagcacagatttttacaaaatagatgtgggcggtttcttgtagtcttgcctaactgaaaccatgtttgccagagattacttggaattaccctaataggtgctttgtcaaaatacttggtgctggccagatgtggttcatatacctgtaacttcagtgctttgggaggctgagacaggaggattgcttgcggccaggagtgcaaaaccagcctaggcaacatagtgagaccctgtctttacaaaaacaacaacaaaattacctggctgtggtggtatgtgcttgtggtccccactactccagaggctaaggtgggaggattgcttaagccctggtggttgcagatgcgatgagctatgattgcatcactgcagtccagccagggcaacagagcaaaatcttgtgtctaaaaaagaaagcaatacttgacggtgaaagcgagtcctgctcaggggtcccttctggaaagtcctggagcctggaactgaactccgtgattcccctgtgccttccccctgggagcctgagcccccttgaaggtgacagacacgggggaacctgtgtcctgtgggatcactcctctcagtccttctctaccacatagagaaagggatggatggcaaagtaaagccaacaaacctccacttccttcctcctccccactgccagagtggagattcttctttattctgtggaactggattctgaaatgccaaaccattccatctgttgtgttttggcacaagtgctcaaaagagctcaggtgtctccctttgcaatttccccatggcttaaaattcagtcctggagatctgtctcttgtaggaaatggaggggctttccttatgcttgtttttctctgtaaagaagcataaaggtttaagttttcgttgggagggcctaaattaggaaggaaagattatttaaatcaaagcactctcattgtagagtcataagcttggattttgtgtgcatgccatgctagctcaaaaaacaaagttgagagtcagagctctttgaaggatgaggaaggggacccgggaatgagtggctctgcttcaggaagcatgttttaatgtgtgttcctaaaaaagcctctggaaaagtggtttaggaagcttctgggctaggagagacaccatgaaaaacaaaacacaaagtatgtgagtcagttatgatcaattgtgccataatcgacatttcagttgtatagtagttacactatgaaaagcacagacatatttaaaaagacaattttgaggccaggcatggtggctcatgcctgtaatcctagcactttgggaggctgagtcagaaggatcaattgagtccagaagctcgagacgatcctgggcaactttgtgagacctcatctctacaaaaaaaaaaaaaaaaaaaaagccaagtatgctggcacatcccagctccttgggaagctgaggcgggaggatcacttgagcccaggagttcgaggctgcagtgagctatgattgagccactgccctccagcctgggcaacagaatgagatcatctcttaaaaaaaaaaggagaaagataattttgagattcaacatagcccactaacagcttcatttagacatcataccttttgtctagacttgacagaatttgttaaatactggaaagttgtattttttatcttgtttcccctgttctgtctgtgaatagagacgtttgttctttacctagtttataggactgtcatgaggaaaggtgacataataatgggttcacagtattggaagggggaggacaaaatgcctgtttacaagagacccagttacagagctatgtgaagtaaatactgaatgtcaattctaggtaacgatcctcaatgtcacaggtacttcacgtattaatacctctttgccattatacatatgtccttctccaaatgatggctctttgctgtaaaagtttgtcttctaagctggttgtgtggaatttggcccctaccttccacattgtcttataggagtgcatttaggccaggtgtggtggctcatgactctaattacagcactctgggaggctgaggcaggtggattacttgaggtcaggcgtttgagaccagcctggccaacatggtgaaaccccttttctacaaaaatacaaaaattagctggacctagtggtgggcgtctgtaatctcagctacttgggaggctgaggcaggagaatccttgaacctgggaggcagaggctacagtgagccgagattgcaccactgcactccagactgggtggtagagcaagactctgtctcagacaaaaaaaaaaaaaaagcatttaatctggtgctgagctgacctcttgtactctgattttttcattgtttagattggaaataggtcctgagttctaattctgtatttgggacttggtgactgcttctatcccagtctttgatggtttagacagtggaaccctccatgggggcatgtgggtgatcctcttgtcggggaaaaaagagggtgagtgactagggggtgggctaccgtaaccaggactctgaggataggtgcagggtcactgatgactgggaagagttgtaggtcctgccaccatctattttgcatgggaaggacatttgcctgagctaagccatgggaaaaatctaaatttagatacctgagctctccacagcaactaagccaagacacagtagacagaatgttttggcctttcagaatcagtattttacatacaaggactcgatttcacagaaaacccttctcaatgcttatgtgtatatgaaaagaaagtttgacctgcaggaatcattgtaatgtatcagatccatatcacagctcaattattcccaaggattcagggaggaaaagccaacaaaaacaaaaaaaggaataaaggaattgggttgttatggaagagaaagctaaaggggatttatttgaggtctggaaggctacgacgggttgcattcagatgtcatccacatgtccacagagaaccgcacaaggacttcaaggtgaaatagtggctgatcaagtcctaggagtctgagcaatcaaacattggcatgtgttaccaattaagtagagaggtggctgctgttttagaggcttgatgattgtctgtctttaagagtcaatattggccgggcgtggtggctcacacctgtaatcccagcactttgggaggccgaggtgggtggatcacaaggtcaggagatagagaccatcctggctaatacggtgaaactccgtgtctactaaaaatacaaaaaattagccgggcgaggtggcgggcaactgtaatcccagcttttcgggaggctgaagcaggagaatggcgtgaacccaggaggcggagcttgcagtgagcccagatcacacaactgcactccagcctgggtgacagcgagactccgtctcaaagaaaaaaaaaaaaaaaaagagtcaatatttgtgggagtctcaatttaaggtgctaggtaaattgggagttccatctgaggtttctttcaagataaaatgccttataaaagtactgtaagtccacctggccaacatggcgaaacctcatctctgctaaatatacaaaaaaattagctgggcacaatggtggctcatacctgtaatgccagctacttgggaggctgaggtgggaggattctgtgaatctgggaggtggaggctgcagtgagccagtatcgcaccactgcactccagtctgggtaacagcaagaccctgtctcaaaaaaaaaaaaaaaagagaaaagtattgtaagtcacttcagtattagggatgggggccaaagtccactcacgtataaaaatatccctcagaggaagacttctatgtgtgtctcatgcaaccactttatgctgtctctgaggttgttcattccagttttcctgcttttctgttccagacttgggctgataccagagagtgtggattgcctgcagggcttcatgcgcatttctctgtgtatttaaatactcacggaagattagcaactatgcataaactttccagttgtacttccttaataatgattactgctactctttgttggtagctaagggaagcgtctgcatggaggtggcttagaattgacaatgtgcaaaattctgggtcgtttcatgggggctgggggaaggcttggaaataaaggcttgggtcattcccttgtgtttagctcttgcaggaaactcttgcaacaccatgctgttgtgttatcatctgcctgggtttcgtccccaggacagaacggcatgaatgatgtctttagtgtctcacagaaggaacactgggttcttgagtgcctgccatctctgtctcatcttgactccaaggacattttaacctctcaatgccttgttttgcagccaaaggtatattatctgtctcccatatgcgttctgggagattaaccactaagcattttgctttttaggtgtgaggcgctgtttccttctaagaccagtattgtttctgactaactttatccagttgagtggggttgtgtctctatttcatgttacgagatgcctctaacatttttattatgaaaataatttttgtgtccattgaaaaggtttgggaggagtatttaagttttgtaggataattatagatactctatcagtcatacattctatcttttttatttttttttgagacagaatctcgctctgtcaacccaggctggagtgcagtggtgcgatcttggctcactgcaacccctgcctcccaggttcaagtgattcccctgccttagcctcccgaggagctgggactacaggcacgtgccaccacaccaagctattttttgtattttttagtagagatggggtttcgccacgttggccaggctggtatcgaattcctgtcctcaggtgatccgcccacctcggcctcccaaagtgctgggattacaggtgtgagccaccgctcccagcccatcacacactctaaatccatacaacgagtacagcgggacttttctttctgtgttttgtggcaaataagttggtagaaatattatcaaataaaggccaaaactgtgttcagagacctggaagttcattcttttcctggttttgttgtatgtctgagacatgcagagggacagacaaaaagatgcatttaaaaaagagctgccagggaacacataccaaaatggaaatttgggaaggggatggacaagatgagacaaagcagacagacacagattttctcaggtcaacaaagttgtgtcagactagtaagaccagctttagagtttaaaaaaaaagaagaggaaaaagaaaagaaaaaatacacacacaaacagaggtgcacagaacattccaggaaaccattgaactgtgagtgataacgtgtttccttctattccttcaaagatttgttttagaggatagctgggtaagaacttgtgctgaaaaaacaatgcaagggatttgtaaagaaacagggaaatgaatgatctgacaggccgtttgttaccaccaacatttttcttaatttaacctgaacttacttgctcttgtggtggtcggtcggtctttctctctctctctctctctctctctctctctctctctcattctctctttctctctctctctccctttctccctttctctctttctctgtctctctttctctctttctttcttgtctcattctgttgccctggctagagtacaatggcacaatcctagctcactgcagcctcaacttctgggctcaggtgatcctcccacctcaacctcctgagtagctgggactacaagtgtgtgccactacccaccacaccctgctaaatttttgttgttgttgttttgaggagaccaggttttaccatgttacccaggctggtctcgaactcctgggctcaagcaatccgcccaccttggccacccaaagtgatgagtgctaagattacaggcatgagcctctgtgcccagcttggatatttcaaagacattagccatggccttcatgtttatctggacttgagggcttcatatctttgaccatagatgatgcttaagttggtctttcacgtggtttcagatccacagacattttgattaggtcaaataacaatcgtcttcataatgccaccatgtatgtatgtagtcctttggagactattttgacatcatttataactgacaacactgtgactttcatcctcctcttagctcacatgccttaatcccacatgtactgccctgtagagaaatattcctccttcctcttggcttgctttcttagctttgtctctatcccaggacaataactgaacaaaggctcttcattcttggtgcaactcagagttggaagagtcaagggtgaaggggcattgggcagccggccatagctgtcttcttcctctcttaatgtctttgtctctcccatcttcatgtggacattttctctctccttcttctctttttcctcccctcgctgaaaaaaataggattactgttttgaaccgggcattatgctagatgatagatgtacaggggtcagcaagatgggcaaggtttccatcttcatgtatattaaagtttggagggaataaaacattaaaataaatagttacaagggtggtgagtagtaagaaaagataaggaatgcttagcaagggggactgaaatagtgtagaggtgggatgaggagtcagcgaagtctgagtaagtaaattcagagagaaacaaaagaactacactctagatttccctttaaaggaaaggaaggggaaagaaataaaattccaaagagaaaagggcagaaagatactttgttttatacagaacactggaggccccagtgtaatcaacatcaaatttgtgtatctgcaaaggctgatcttttttttttttttttgagacggagtctcaccctgtcgcccaggttggagtgcagtggtgcaatcttagctcactgcaacctctgcctcccgggttcaagcaattctcctgcctcagcctcctgagtagctaggattacagacatgcactaccacacctggctaatttttgtatttttagtagagacagggtttcaccatgttgaccaggctggtctccagctcctgacctcaggtgatccgccagcctcagcctcccaaagttctgcaattacaggcgtgagccaccatgctcgacctaaagactgatcattttttatcagttgtccaaagacttcatcttttctccttccctgataccattgcattcagccatggtgctgagaggtgaagccagctggacttcctgggtagaatggggacttggagagcttttctgtcttataagaggattgtaaaacacaccaatcagcactctagttaggaatgtaaaacgcaccaatcagcgctctgtagctagcaagaggatggtaaaatgcaccaattagtgctctgtaaaacacaccaatcagcgctctgtaaaatgcactaatcagcactctgtaaaacgcaccaatcagcaggagtctaaaagtagccagttgtggaggattaaaaaaagggcattctgataggacagaaatcgaatttgggaggggacaaataagggaataaatgctggccaccccagccagtagtggcaacccgctcggtccccttccacgatgtggaagctttgtcctttgcttttcgcaataaatccttgctactgctcacgctttgggtcggtgccatctttaaaagctgtaacactcaggactgcgaaggtccgcagcttcattcttgaagtcagcgagaccacgaacccaccagaaggaaccagacacagtgccacctacccacatcttcccctatggctagatggcaggaatccacaaacacctgccaagatagtattgtgatcatgttaccagctataattggaggtgaggagtttggagtagaaatttgtctgtttttataataacgaggttgaattatttatagctttgtgtctttcctcttctccataagtataattaattttattaggcatctattcctaagagccaggaattcacatagctgctgggaagatgaagacttataaagaccacttgtggtctctcaaggagtctgttggcagagactggcatacataaaacaaatggaataaatattctatcaggaatatgggtaaggtcttacagaaacccagaagaggaaagagttctcccaaggtaagggaacctagaaaaagttacaaaacggaaagagctatccatctatctgtatctgtatctataactatatatctacatctatacctatatctgtagagatgggatcttgccatgttgcccacgctagtcttgaactcctggcctcaaatgatcttcctttctcagcctcccaaagagctgggattacaggcatgagccaccatgcctggccccaagaagggatatttgagttgatcctaagagaatgatagactgctgataaagctaaatagacttttttagagtgttccattatttttgtattttgtagttaatgcttaatatgagtaatcatgctttagaaagagaaagcaccaatcaaaacaagcctattttcttttcacctaggcatagtacttggtatgagttggcctagaaacaactgcatattctactcacactgctgcatggtttgcctaagagtactccatagatggactattgaaatttgggtgtgggttaaattttcataaatcaaatttcatttcccattatcttacacctaattaaagagataatgtgccttctgatgaccctgtaattggcagttgtaactggccctttaactttgtttccctgcgctgcagctcctgtctccagcagttagttcatcatctgtacactaacagtaagctacgcgggcaggcactattttaaaaaacacacacaaagctgtctgtgaatggcaaaggaatcagagcaagtcattactctctagttcatttggctagaaaggtcaggtcgcctatattgacttttcatgaaaactaggcgaactagtagttttcatgcacaatatgtcaacaacctgttatatttgaaattctttttaaattaggtgggtgaatggtgtaaaacttcactatattttctccctgcctgttaattgacttgctaatctcctgccaatatatgtccattttaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgaggtatcatctcacaccagttagaatggcaatcattaaaaagtcaggaaacaacaggtgctggagaggatgtggagaaataggaacacttttacactgttggtgggactgtaaactagttcaaccattgtggaagtcagcgtggagattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcatatatacaccatggaatactatgcagccataaaaaatgatgagttcatgtcctttgtagggacatggatgaaattggaaatcatcattctcagtaaactatcgcaaggacaaaaaaccaaacaccgcatattctcactcataggtgggaattgaacaatgagatcacatggacacaggaaggggaatatcacactctggggactgtggtggggtggggggaggggggaaggatagcattgggagatatacctaatgctagatgacgagttagtgggtgcagcgcaccagcatggcacatgtatacatatgtaactaacctgcacaatgtgcacatgtaccctaaaagttaaagtataattaaaaaaaaaaaaaaaaaaaaaaaggattgtggcctggcgcagtggttcacacttgtaatctcaacagtttgggagaccgaggtgagaagatcactggaggccaggagtttgagaccaccctgggcaacagagcaagatcctttctctacaaaaaagtaaaacatatgaggcggcctgttggcacacatttgtagtcctagctactcgggaggctgaggtggaaggatggcttgagccctggagtttgaggctgctgtgagccatgaccgtgccactgtactccagcttgggcaacagagtgattccctgacttaaaaaacaaaaagattgctttaaacattcatcaaaaaacagagcaaattacactttggcagaaacatgaaggctaatacttgaatccaagcacccattccctctgggcttaccacactgaaggcaaaatgagtggggttggtttttctcctcaagaaatgttgttctgggacagtgagtcattggtttttgttcttgcaacccttcatcatctaacaggtttggttaactcaagaagttctaggaaatgttcaaacactgcagatatttatcaaggggcatttttaggagtagcagagtgtcaagaactcaaattgacatctagtggcaacacttctaaagattggggccccgtactatatacaatgctaaatttccaatgctgtgattggaaaagactatgagaaggcctctagtctcttcccactaccatcatctgcagcaggcccacaccacccaaatcaacacaggtatggaagaatcgccccctgccacaggagtgggcagtaagcgttagaacacagattgccgagttctggttctcagtccacccaagtctggtctgtttccctaactgtagaaggaaggtgttagaaatggaaaatccttaatatattctttgattttttcaaaacagaataattgatttttatcatctttcttagtatacctttcacgttctgcacaattattctagattcaaactgaagattgtggttcatgtcaagagtcagtttggtcactgaacactgtctcatccagctgtgggacactcatatgagcttggtcataggtggctcatcttcccccacttactgggtttccataatgccattctcttgggctgttagataaaatatttacaacccatccctccatcatcatcaaagcaatttatttgcacaaactccactgtcactaaatcacatgaatgcatccatctttcttattttcatctttttgaaaattagccagcatgaaaaataacagcaatcgattaagctattgcattgtgaagagtagcttagatttctttctttctttttttcaccctgttgcccaggctggagtgcagtggtgcgatttcagctcactgcaacctctgcctcccaggttcaagagattctcctgcctcagccgcctaagtaactgagattacgggcgcctgcctccacacccagctaatttttgttttattttttttagtagttatggggtttcaccatgttacccaggctggtctcgaactcctgacctcaagtaatccacctgccttggcctcccaaggtgatgggatcataggcatgagccactgcacccagccagatttctttcttttgatgatatttgggagtaactgtggaatgtgtccccccacctatatcatacagcaatatttttttgatctacaaagcacaccatatacttcactatttattctgctgaggggaaatgggtgagactgccagatttctatgagaattacagggttttcaagtcattatggagaaaatgattgaggttcagtgtcattggaaaaagcatattcttaatttgtctataatttttcctttaattggtagtttggctccattttcaaagtacttttgaagctttcttttccaatttggcatcaaagttatttttctaagtgccattcaatttgggacttattttctattttgattgacataaaatatgtcattctgaaaggaaaaatatcaacacagtttttgagtaagaaactcagtaacattgaacttagtaatcacctccctaggagtgaaatttcatggtcatatatattgaaaaaacctcacaatataaccaacatgctatctgaatcttgattgagattccacatcataagtgctaatttcagttctgactataaccaatttgttagtttatacttactctttactaaaggaaagaagagtaggaataggatggtgcggtggctcacacctgtaattctagcactttgggaggccgaggtgggtagatcacatgaacccaggagttcaagaccagcgtgggcaacgtggcaaaaccccatctctgcaaaaaattataataattagccaggcgtggtggcatgtacttgtagtcccaggtactggagaggctgaggtggaaggatcacctgagcctggggaggttgaggctgcagtgtgtcgagattgtgccactgcacttcagcctgggtgacagagtgagaccctgtcttaaaaaaaaaaaagagtgagaataatgaaactgtgcacacgcaggccttttaataaactttccccctgtacgcagcccattctagctatatatatttcttggtcccagcctcttcaaataaaaattgttttattcaaaagtatgacctagccttatacaagataagatagcccacttaaaagtggcataaaaggccacttttatgcatctccattttaggttggttacaagaggcacagagagaccaaagcccatgggatgctcgtgagagtaggaaattgggtgggaagggtggactcgggagacaacctgacatctctctacttgaagcctagcaataaggttcaaaggttcctcatgccttgttttcccttctctctacatgattaagatcccattcctgtaacagatagcaatgtgtttatgcagtaaaattagataagggagattactagggaagtcactactcagttagggatgtcagtggtgctcactgcaggtccaggttagtaataagaactctggactagtagctaggagtgcttgaatctagattagttctactttctaactcgatgtgtgacattttttccacttaatttttttggccttggttatcttattggaaaaaatattcaagttgcacaaataactaaatgatgcctgagttttcattcagttctaaaacttctcaactgagcaatctgttgttgaaaggagagtacgagttctaaaagctactctagggagctctgcattcaccaagccgctccatcattgttgggaagaaaatactaaggttgactcattgtcaaagccacattctactcaaactcaatgtacataactcgaattctagccacattccagccaaattgagatagctgttcaaatagtcatggatttatttaataactgacttcgaaattctttacttctttcaaggtggcattaacaagtatttcggaatttcaacagagatcggttttcacgtgctcttcaatgatccctgtgaaataaatcatattcaagggtttttttccccttatgagttattcgcctgaaggaagaattcttcatttctttttcttttaaatgcatgttggaataaagtcttctttgaaaagtcttaatgaaaagagcaaacgtggaatagcatccaccccagttctttctctggtccttgcactctgagaatgaagtcttagacagcagaatgtcaggggactctcattgcgtaaaagtctgtgcccttctgcgccttggacagttatggacagaagcctttaagaagaagaaaattaaaactagttaattttttagttaattttagcaacactacatatatgagagagagaaaagatggcattttctgaatgaatgagatgcctctgcattttgcccaactcattggagactcaggatagagaaaagggagaaattatgtttagaggctgataaatttccctatggttactatcaagagatcagactcttattaacatttgcaaagtgtgagcagagaagagcatttgaacaataagcatagattaagtactcctctttccttcattcccttttctctagtcatattctcagacagtccaggctaagtattaatgatcttctttgaagttaaacatacccttgctactttcattacattattatttttatgttcttccttttggagtactcaaggtaaatgacatggcagaatctgtcccagtccagtgagggtgtcacataagaggcccttggcttacctctatgcataactggcccacgtcacatctttaattagaagtccaagttattggctggacgccatggctcatgcctgtaatccaagcactttgggaggccaaggtgggtggatcacctgaggtcaggagttcgagaccagcctggccaacatagtgaaaccctgtctctactaaaaatgcaaatatcagccgggtgtggtggcacatgcctgtaatcacagctactcgggaggcttgaggctggagaatcgcctgagcacacgagatggaggttgcagtgagccgagatcgtgccactgtgttctagcctgggcgacagaacaagactctgtctcaaaaaaaaaaaaaaagtccaagttactgttgcagggattgggacatcttgcctttctcaagttgagcaatattcccaaatataaaaatgtaggatcttagtccaatcagagcagatatttggtgtagggcattttctaatgtagtaccaataaattagacgcatacctcaaccaaaaaacagcccatatccagtaagtaataaggcaatgatttacatttcacatattaccagagtaatgactaatagcatacatgtataaactgaaaagtgactgatgcttattttcagatgggtccaaatttattggataattatggagaataatgtatgttttctgagagttggtagtaagaaaatattgccattgctggccaggcacaatggctcacacctataatcccagcattttgggagacttgaggtcaggagttcatgaccagccacctcagcctcccaagtaactagaactactggtgcatgccaccaagtccagctaatttttttttttttttgagacggaatattgctctgtcacccagattggctgtgttctccattctaagtccagtggttagaaattgtcaagttctcacatctgcaaaaaaagtaaaaaagatgaacctgctacatctaaatatactttgttgtcttcctacaagtcctattttacatacttatggcatttttactgcagtttgaaaatacagtcaattcttgttattcacagtattgatgttctataaacttgccctaaatactgcattagtgagtcctgaatttattagttaatactgaatttcctaggggaaatacagggttaggttcctgtgagtctttggttacctttttatcaaccaatcaacaaaaatccttattttacctgtgtttttgtttgaagacaccttttaaaatatatattattgattcattagcattgaactaagcttatctaatgcacttattttttgtgtaaggtgtatcacagccttcttgagcctaggaatgccaaatagtacttccacaccatacttaagggccatttcattttatttcttatttttaaaatttattctcttttcttatttaaagaaaaaatttgtagatgccgggtctcgccctcttgaccaggctggagtgcagtgacacaatcacaactcactggagcctcaaactcctgggctcaagtgatcttcccacctcagcctcccaaatatctgggactacaggcacacgccaccatgcccagctaattttttaattttatttttttgtagaggcagggtctggctatgtttttgaggtcttaattccccaatgaacatgactagtatattccaggctggtcttgaactcctgtcacaaagcaattctcttgccttagcctcccaaagtgctgggatttcaggcatgagccactgcacctggcttggaccattttaaatagtgaagtcactcacacacacatacacgcatgcaggtgcacacacagacacaaaaagacacaaaaatgcgaaacttgtggcactaaaaagactgtggaaagggtgcttccttacagtatgaaaactgaaacaaaaaagcagagtgttgtttagttagacgccacctgggaacgtgcttgttgggaaactccagttgtccactgtcctgccatgtctatgatgactgcaaacatttgggagtattaatttgagggtcacaaacagattttaggtgatgggcatatttacaaatacagaatctgctagtaatgaggactgactgtataatgctttagtagtctcaagtatgttttttttctcattaagcctttgcttaagatgcaggcaagattgatgctgttggtttggtgcaaaagtaattgcagtgcttcccatttaaaagtaatggcacacactgcaattacttttgctccaacttaatacttggctttattgacttttagcatcagtgcagtttggttaatgataaaattttccaaagcagtgtctcatctgcaggagcaaactatagcaagggccctggccatcagttctcccttctggtcctgatattcctttttaaactgtctttccatacccctccctccagtgggcttggcgatgttgcattaaatagcaaagagaaggaaactcctccccagtcctcactgaccatttctttttccactcagtcctgctcagaatgtagaagagaagttgaatttaattcataaattcagcagcttgaggactgtcagttttgtcgttatttagtgaaatagtaattgaattgggctacaaggtcattggaatctgctgtttcatttcatatcattttacgtgttattattctaataagaatacaaatggagtttgatgccatttgctgatcatccatcttattgatgccattgaacagaacgcagaaacacaaagggatttataaggcatttcagttttgatgtcctttgaaaaatgaaagtcttttcagaaatgcaaaagacaaaatgacttagaattccatctcgttctgcccggtttgagggcatcccttcctattccttagatagctgttaataagagtcctgaggaaaactgggtttgaatttaaaaacaaaaaatttttaagagacagggtctcgctttgtcacccaggctggagtgcagtggcacaatcatagcccctgtaaccttgaagtcctggactcaagtgatgctcccacctcagcctccctagtagctggaactactggcacatgccatcaagtccagctttttttttttttttttctgagatggaatctcactttgtcaccgaggccgtagtgcagtggcgcgatctcggctcacagcaacctctgtctctcaagttcaagtgattgtcctgcctcagcctcctgagtagctgggactacaagcatgtgctactacgcccagctaatttttgtatttttagtagagacagggtttcaccatattggccaggctggtctggaactcctgaccttgtgatccgtccgcctcagcctctcaaagtgctgggattacaggcatgagccaccacacccagccaagtccagctaattaaaaaaaaaataaaaatcgtagagatggggtctccccgtgttgcccaagctggtgtcaaattcctgacctcaagcaatcctcccacctcggcctcccaaagctctatgattatagatgtgagctgccatgcctggccttaaatttttcaaaagcttttaaaccaatcttaaaatgttttatcctcttagaatcatgtccctagttttatagcttggaaattcttgctcttttcaaattgctctttaactctggcctgattggaaggtggcagcttttcaaatacaggtcatggcagcgctcaacctggattcctcagttgcagaagactgcttttgctagactgctgaatttacttccaacttttcagatgtttctgaggttgaccctggtgtggttcccactcaaagtggagcaagcaggtgggtggcaggtctcttcttagcggcttcctagagggaagcctcgtgagtgggatgggggacaggttgccctgggggagcccaggaatggggagacaaggccacctgctatgcagatgatatagtttggctgtgtacccacccacttctcatcttgaattgtagttcccataatccccacatgttgtgggaggaacctggtgggaggtaattgaatcatgggggcggttttccccatgctattttcataatagtgagtgagttctcatgaaagctgatggttttataaggggctttccctttcactgggcactcattcttctccttgctgctgccatgtgaagaaggacgtgtttgcttccccttcaaccatgattgtaagtttcctgaggcctccccagccctgcagaactgtgagtcaattaaacctctttcctttataaattacccaatctcaggtttgtcctaatcgcagcatgagaatggcctaatacagtaggttttcctgagtcctctctctgactcaccctctgacgggcaaaagacagtggcagcactgccagcaatcagctgggaacttctcccctgtgatagaaagcagtgcttgctggcttccctttgtgatgcttttggacagcagctctatggacctatgccttttgtcctttgaggacggacgcacagtctgtgcagctcgaggacgccgtcatgggtgagatgctgtggagtgtgatgacgccacctcttaggctgtgtgtgaaagtagcgaggagaggcagggtctgcatgagccactttggagcaggccaaaacactgtggagaagcacattacagccacagtggcggtgtaaagggtcagactgaccactggcttctggaaagtcttcatttctgaaagactgtcaggtagaagatggatgagagttactctgtgaggccggaaacctagaactcagaccattgtgtgcagaccagggagaggcagtgtttggagtgagataagcaggaattttgaaattacacagacccggttttgaatttactcatgagctgtgtggcttagagaaagctgtttaatcccactgaccttcatctgtgaagtgtccaaaaataatacagagcttgcagagttgtgtggataagggataatctatcgaaagcatgtggcaagtggcagacacaatgtgggcactaggcaagtggcaagtcccttgtattgagtcttatttgtctattcagtgaatatttggataccaactctgctgttctgggcatgatgttagccactggggagacagaaggaatgaaagagatgagtaacctaatgtgtgctgtctagtggggactgcaaataaagtgggtgttaccactagcgtgctctacagtgttatgctagagagaaatttacttcctttggccactcacttccttgtttttaaataagaactgagttaaagttgctaactgtgaagactgagtaatttgaatctgctgttggtgtactcagattacttttttttttttttttcttggagacagagtctcactctgttgctcaggctggagtgcagcggcccaatctcagctcactgcaacctctgcctcccaggctcaagcgattctcatgcctcagcctcctgagtagctgggattacagtcacgggccaccactaatttttgtatttatagtagagacagggtttgccaggctggtcttgaactcccaacctcaggtgatccgcacatcttggcctcccaaagtactgggattgcaggcataagccaccacacccagctcagattactgtttactcaaattaatggggatgattgaggatgaaacagtgcagggattccccattgttttgttttcttctttgcatttctagtgtctgtttttttttttgttggtggtggtggtgtttttgtttgtttgtttttttttttaaaaaaagatctgcagaggctattgtgtcctttgcataacccaagtccagtagcatccttgacttcaaagtctgttggcattgatggcatctgactcagtcataactatctttaatacatcattataaaatctacaatattgctcaagtgaagatattatcatgtaactgggagatattactaattaatgagtatgtggaaaattttccctagaaaatgaagtgtttgtgaaagggactgaaggatttttgcagaagagtctatgagaaagttattataaaccaaagggttatgaattctgcatatgaaacataaatagctattaaatattttatttcaatcaaaaagtgtaatgaaattagagcttctcattatgaatctgggatttatatggaaacttataaaactaaaaggtaatacattcaaaatagaagcacagatttaccaattaactggagttaaaactttttacttctctttacagtgacaggagaaaaatacatcctaaatatgttattatggtaaaaaaataatattgctagtggacagaaaaaatagtcgttaagagggtacaagttcatctgatagttgcaactaacattctaagggggttctctaagtttagtgtttgattttcttaaaaaccgatttgaaaattcatggtgcatggaactcagtgaaggctcctctgttgaagaaataactctctgaaataaaatgaacatataggccctttatcttttttaatgggatggcgtgcttaggcccatgaggatcggtttggtagaggttgatgttcttcctttatccttaatcattgatgcctctctagaaaagaaatgctcatgtcttttaggtggaaccataggatattggtgattacgtatgtcaaaaacagtcaaatatctgcagtttcatgtcattcatgctaatgaattctaaattggatgaagaccttgactcaccagatttggcaaggaataggggtccgtattttaaggacaaaaggctagaagcctgtttgcaaaactctaacaaacatttttgcttttctaagatttctgaaataatctggagtacacacaggtgaataatgtaagtgaaggaaagtgaaagggtgctataaagtaaaatgaaaagatgctgaatttcagcactaatttgaatatacctagattctagattgaaaatgaccttttccgcacaggtaaataaaatgtttccataaaggaataaacctggccgggcgtggtgactcatgcctgtaatcccagcactttgggaggcggaggcgggtggattgcgaggtcaggagatcgagaccatcctggctaacatggtgaaaccccatctctactaaaaaacaaaaaattagccaagcatggtcacaggcgcctgtagtcccagctactcaggaggctgaagcaggagaatgcagtgaacctgggaggcggagcttgcagtgagcagagattgcgccactgcactccagcctgggcaacagagcgagactccgtctcaaaaaaaaaaaaaaaaagaataaacctaattatacttcttcaacttaagatggacatttctctacctaagaatataaaattatcaaatactctagagaaagttgggtttatattcaaatagcacaatatcaacacatgtgaaggtcagtattccatagatggggatgttgatagctaatttcaaatcagtgtgttttgtttattaaagctagactgctgataggcaatatttgctagaaaataatgtaatttttaaaactttgatgtgtatttaaaataaagttttcattttagaacagtttgagatttacagaaaaattgtgaagatagcacagagctcccacatacaatgtatgcagtctactctagtattagcatcttacatcaatatggtacatttgttatgattaatgaaccaatattaacacagttattatctaaagttcatattcatttttttgccatcgtttttacctatgtgtgatgtaagtaatcattccatttcagtatacatgaattacaagatcagaattgttaacccatgccctgtgggaaagaactttatcaattagggtacagtgtgtttggacagtttcttttgtcttttgtcttacagaaatagtttgtttccaacattaattaggtcagcatcttctccccatcacctttccacatacacttaccctcagtgagactgtttcatatatttatgatacagttagattgcttggtaagatctgttccttaggctcttggctatgacagtttctcagactctccttgtttttaatgaccttgacaatttggaggagtactggtgagttattttgtagaatctccttcaattgagacttgtctgatgattttatcatgagtagactagggttaatatgtttttggaaggaagatcacagaaatgaaaagccattctcattatatcattatatcatatcaagagtaacaataatcggccgggctcggtggctcacgcctgtaatcccagcactttgggagaccaagacaggcagatcatgaggtcagatcgagaccagcatggctaacacggtgaaatcccatctctactaaaaatacaaaaaattagccaggtgtggtggcgggtgcctgtagtcccagctactcaggaggctgaggcaggagaatggtgtgaacccaggaggcggagcttgcagtgagcggagatcacaccactgcactccagcctgggtgacagagcgagactccatctcaacaacaacaaaaaaagtaccaataatctggccaggcatggtggcttatgcctataatcccagtactttgggaggctaaggcaggaggagctcttgaagccaagggttcaagaccagcctgggcaacatagagacctcacctctacaaaatttttttttcaaaaaagaatactaataatctatatgatttattgctataaatattagctttcatcacgaggctgaggagtctttttcaggtttctccactgtaaggtcacacacacccccacctcttttctatgttgtcttctttggaaagaagtcactacgtgttatccacacttgaggagtgtgctatgttccccctccttcagggtggagaatctgcataaattatttggaattctctgcataagaaatttgtgtttatttatccccctgtgtttatttattcaatcattcgtttataacagtatagactcatggatatttattttcactttgggtttgaatccagtattacttgattgttgctgacattcatccagctttggccactgggagccctttcagttgacccctgtgttcctttgatataccctcttcccctcttctttgtggtttgtgggttctttgttttttgttgttgttttgtggctcttctttatggcactgaaagatactccaggctcatcttctacatttcctgccacaatcctaaaatcaaccatctctctaaggagttctaaaccaagatgtgttctttgctactgaggtgttgcttctttttttttttttttttttttttttttcagacggagtttcattcttgttgcccaggctggagtgcaatggcgcaatctcggctcactgcaacctccgccttccaggttcaagcaattctcctgccttagcctcccgagtaactgggattacagacgtgttccatgatgcctggataattttgtatttttagtagagacggggtttctccatgttggtctggctggtcttgaactcccaacctcaggtgatccacccacctcgtcctcccaaagtgctgggattacaggcatgagccaccgcaaccagcctgaggtgttgctacttttagggcctttgactgatagagcaaagaaatatatgtgtggatactaaaccatgcatagacacatatctatatttccttctttcttttgcctttcccagaatgtcatataattagaattgtacaatatgtagccttttcagagtggcttcttccacttggcaatatgcatttaagattcgtccatgtctttttgttgcttaagaacttttcattgcttcataagaaactgacaaactggctgggatggtggcttacgcctgtaatcccagcactttgggaggccaaggtgagcagatcacttgaggtcaggagttcaggaacagcctggtcaacatggcaaaatcccatgtctactaaaaattcaaaaattagccagaagtggtggtgtatgcctgtagtcccagctactcaggaggccgagcatgagaatcacttgaacacaggaggtggaggttgcagtgagccaatgttgtgccaccgcacttcagcctgaggaacaaagcgacactccatctcaaaaaaataattaaaaaaagaaaagaaactgatgaactgtcctctaaatttgctgtaccatttttgcatttccattatcaatgaatgagagttcctgttgctctgcatcctggtcagcatttgatattatcattttctggattttagtcattatagtagtgtgtagtagtatcacattgttgttttaatttgcaattccttaataacaaatgatattgagcatctcttcttttcttttcctttattttttttttatgtttttgagacggagtctcactctgtcacccaggctggagtgcattggtgcgatctcagctcactgcagcctccacctcctgggttcaagcaattctcctgcctcagcctcccgagtagcaggaactataggcacaggtgaccacacctggctaatttttgtattttcaatagagacagggtttcagcatgttggccaggctggtctccatctcctgacttcgagatccacccactttggcctcctaaagtgctgggattataggtgtgagctaccgtacccagctgagcatcttttcttttttaaaagaaattttaattttagattcagggggtacatgtgcagatttgttacaagggtatactgtatgatgctgaggtttgggcttctataaaacctgtcacccagatagtgaacacagcactcaataggaagtttttcagtctttgttcctctccctcccactcttcccccttttggagtccccagtgtctgttgttcccatatttatgtccgtgtgtttattagctcctacttacaagtaagaacatatgatatctgattttatttctgtgctaattcacttaggataatggcctccagctgcatccatgttgctgcaaaggacacgattttggttttttaaaaatgactgcgtagtattccatggtgtaaatgtaccacattttctctatccattccaccactgatgggcccctaggttgattccatgtctttgctgagttctgtgtctttgtcaatagtgttgcaataaacatacaagtgcaggtgtctttttggtagaatgatttattttcttttgggtatatacccaataaggagattgctaggtcaaatggtaattctgtttttagttctttatgaaatctccaaactgctttccacagggactgaactaatttccaatccgaccaacagtatatgagtgttcccttttttccacagcttcgccaacttgttactttttggctttttagtaataaccattctgactggtgtgagatggtttctcattgtggttttgatttgcatttaatgatcaatgatgattagctttttttcatatgcttgttggccttacgtatgtattcttttgagaagtgtctgttgacgtcttttgcttactttttaatggggtggttttattcttgttgaattgtttaagtttcttatagatactggatattagttcttgttagaggcatagtttgcaaatattttctctcattctgtaggttgttcagcctgttgatagtatcttttgctgtgcagaagctcttcagtttaattaggttctacttgtcaatttttgcctttgttgcaattgcttttgaagacttaatcataaactctttgcctaggccaatgtctgaggggtattccctcggttttcttctaggatttttatagtgtgaggtcttacatttaagtctttaatccatcttggggtaatttttgtatatggtgataagtagagatccagtttcattcctccgcttatggctagccagtttccccagcagggagtcctttccccatggcttagtcttattgactttgttgaagatcagttggttgttgctgtgtggctttatttgtgggtttatttcttattctgttggtctatgtgtctatttttgtaccagcaccatgctattttggttactgtagccttgtagtatagtttgaagtcaggtaatatgtttgttctttttgtttaaggttactttagctattcatgctcttttgtggttccagaattttagaatactttttcttctaattctatgaaaaatgacattcacaatttgataggaatagtgttgaatctttagattgctttgggcagtatggacattttaataatattgattcttccaatccatgagcatggaatgtttttccatttgcttgtgttgtccatgatttctttcagcagtgttttatagttcccttacagagatctttcacctctttggttagatatattaatatttctgggtattttattatcgtgtgtgtgtgtggctattgttaatgaaatagcattcttcatttggctctcagcttgaatgttgttgctatatagaaatgctactgatttttgtatgttgatttcatatcctgaagccttagtgaagttgtttatcaggtctaggagccttttggcaaagtctaggtttttctaagtgtagaattgtgtatcttttcatatgtttatatgcatctgtttgtgttctttggtgaggtggttgttcagatcttttgcccatttttttaattggttttttaaaaattgaattttaagagttctttgtataactttacttatttttcacacccaaattttctaagtattttgagagaccttaaatgtgatcatcaacttcttaacttcatagattttaaaagttagttcagaataaagtttacccttcctcattaatacacttaataatgcttagttttaacaaattatatacatacacacacacacacgcatatatatatatacacacacacacacacatacacatacacacacacatacacacaatcactccttaaatgtgcaagaccgggacttgactttgagaaatttcaattcaggaaggaaaattcaatgggaggtattattatagatttaatttgatgggaaacgaggcagaaaatttcaaggacattatcccctttatattctcttcatcctttgctgattctggctttaaaagacttcagaagtcttccagagacatttatgcattttctgaaggaatggtaaaaatcctaattctgggtaactttgttttactccaaactcttggtgctaagattctgttccgtagtttctcaccaaagcattctgtccccttcagatagtcaaacatatgacaaacaaaaatacccacaccctctttcctttcctacctggtgctaattggaaagggtacctggtcagcgcatttatttcactttcagtcatgggggagtctaattatgtttgatttaaccaaataatacaaaattcctcagttcttgcttatggatttggacttcaaagcatcttgcctttacctctcagaagctgttctcacttgttttttgttttgttttgttttgtttttgagatggagtcttgctctgtcgcccaggctggagtgcagttggtgtgatctcggctcactgcaacctccacctcctgggttgaagcaattctcttgcctcagcctcccaagtaactgggattacaggcatgcgccacacgccgagctaattttttgtatttctagtagagacagggtttcaccatgttggtcaggctggtcttgaactcctgacctcaagtgatccacccgcctcggcctcccaaagtgctggggttacgggcgtgagccaccgtgcttggccatctcacttgttttgaatcaggatgcctaggtcagtgagagcctgtgtgagccaaaaacagccacgttcatctttgaaaaaacttaggccgacaaatcaagtttttaattacaggaaataatcaccaactactggagatgcaattaaaggcatttttctctgagagtagcttgtttgtcttttatatttttccccaaagctcattataaaaaatactatgttctttcatacttacagtctcaactctatcacttcctgctgtgagtatggaaatgaattttgttgaaatcaaagaaattagttaataagattttttttagcctgttagtagaagtggcttaacgtttataaagaatatttgctttgctcataatttaactgaatgagacatctgacctctgctgtctatcaaattcattaccgctttctgggacccatgaactgccttacattgtactagttgagaactgatgaaataaaaccataactcgattcatcaaactgtttagaattcaaatgttgagacatatctcacttaataacatgagggtattttgtttttctttttaaattgttcactctggcctttagtagccaccagggagacatgtgagtttggaagggcatctcaggtcaatcctaaaagcctgcagaagaactgagctggcagaatataatcctgcaggttgaaacttagccagcctttgaaattattttcatcgggaaagtactacaggattttttaaaatgacatagtagacaccctactcagaagcctactccctaatttttttttctagttactcatttgccaagatgacttgtttatttgaaagttgttgtgatggaagttggattatgtatattatgattgcttttcttcctgtgtattattttcatttgaaaatgtcaaagtatctcaccattttcctattttatagactagtaaactgagttatatgattttggtgaatttaagcttccagggctagatctccatttagctttctcttctactatttagcgcagtccatacaaagctagctgcaccagagagcattttatctgaatcctattcttgttcaccatgccttcagcaagcacattttacagagcgtccacacgccggccaatagaactgcaggtgtgagcagttccattaacctgtcctcaagccttagtgggagagatggcacagaattgctatataggatgtgaatgctcactcaagggacagagcatacaaggagaccagagaaacagaccatgggaacactagagggaacaaaaggataagaggcagtttgggtcagggaaggctgaggcttgaagagtgagttggagtttgccagacacagaagagacccttggaagcaaagagatcatggtatgtcctgtgcagagtttaatgagcacagcgtgtgtaggggacatgcttggacatgagacagctggggctgaatcaatgaagtacctggttaagatgtttggacttaatcctgtaggcactgggaagcaactaaaaggtaaatagggaagtgacatatcaaatttgcactttaggcaagtccaatgagaagggtttgagttccatcttatgaaaagctgcttctagatgccctgcaatttatacagctgccatatattaatctcctactgtgtgcctgggcatgcccatacatgtttttctttactttttacgcttttttctctactggctcttaacctgcctcatcctatgccaagtttataaacatatttcaatttaatattataaataaaataataatacaaagccattaagatgaagagattgccattgctgttgcattcagcaactgggagtccctgcaaatttgggaagagctggttcagtggagggcacgggcactggggtggtgactgattgagaggtaaggaaggggaagtgggaatatagatgctccttctggaaggtggactgtgaaaggaaggagttaaccagtgaaggctataagatgtgtgggccctacagaggcctgagaggagagaccctgaaggcatggaaacagttggtgggtggatttgcttttaataggggaaagaggaggagaaggtggaggaggagggatggaaatattttttccactgccaatgatggaagatcgcagttggggctgaattgtcctcatggaggaggaggaggaggaggaagttgtagaaggtttactgcttgccatcgaattttccaacaaagatcttccactgaaaatgagagaagaggttgatgaggaaggagactggaagagaagggacaagcttgagagagtttccgtgtgggaaggagaggggaatgttgagaaggattgtcactagggccctggcaagggtagggacctctagtaggtagtctcagtaatgaccagcaacacagtgtgggaacaggaaaggatgctgggaccccctgggattgagattgggctgtgtgggggtggtaggagggaaggtaagtggtcagaggagctgaaggctttgagaaaagtatgggcaagtgctagatcatggcacccagtctttttaatagtaggctgaaagaagatacagatggtcaaagatttggggattgtgggagccaacaggttgttatcaaaagcgaagagaatagagttgaagatttcagatgtagagcaacagttccgagtgatactaagctccaaggtatggcagttcgtgtgcagaggctaggcaagagtcctaggagataaggaggccgaaaaacctggagaccaaagaaccaggaggtcaaagaatctggaggtgccaagccttgtcctaagggccctgaaaccctcagggtgatggcaaaaattggagggaagagagagtggaagtagaactcccaaatcttcaatgaacagtgggctcattatctgcataagagtgaggattcatgggaaatgtgctccccagaagaaagcttcttacttgcattaaaaatattaagagtaactctgaaaacatgattttaatcacaatttctctcagtggattttagggttttggaaaaggccacaagtgccctaaagtagaagtctattgagataatgaaagtttactgaaaattgtatctgcaaacattacctgtcattcatctctcaggtgaggttgtatgagtgtaaaaaaaaaaaagttctttcttttttgctaactttcaccttatcacaataatgcaacaggaagagagtttcaacaaagcataatataaacagatgtctctcttttttttttttttcagacggagtcttgctctgtcacccaggctggagtgtagtggtgtgatctcggctcactgcgacctccacccccagattcaagcgattctcctgcctcagcctcccaagtagctggggttacaggtgcccaccaccatgcctggctaatttttgtaattttagtgagacagggtttcaccatgttggctaggctggtctcaaactcctgacctcaggtgctccacctgcctcggcctcccaaagtgctgggattacaggcatgatccaccgtgcctggccatgaagtctctcttaagaccttttattgtgtggggcagggggttgtttaaaatacatccagtgggaatggcaaattgtgccctcttttcaaagtttgtttttcctccatcatctatatttgagttgttctgtgtgaataagttttggaatgcttcctccttcttgttgaccacagtggttgttgacatagacagaggttgttgggataggaagagatccctgaggttgtcttgtggacaacaaagacccacgataacttttcttcccatataagcatgggctatcctagagcccagtcccctgtgggatatgaccaacaattatcttagaaaatttcactcaatcggctgggcatggtggctcacgcctgtagtcccagcactttgagaggctgaggcgggcggatcacctgaggtcaggaattccagaccagcctggccaacatggtaaaaccctgtctccactaaaaatacaaaaaagtagccaggcatggtggcaggtgcctgaaatcccagctattagggtggctgaagcaagagaatcacttgaacctgggaggcggaggttctagtgagtcaagatcgcaccattgcactccagcttgggcaacaagagtgacactccatctcagaaaaagaaaacttcactcaatcatttcacttctacctctcccagtcctctttggagcgtgaggacacttgtaaggcagtctgtggggacagtaacttataggttgtgtcctgtccggtagtgggctttcatcagaagtatgcttttggtcacactacaccatttttttataccaccatagagttgacaaacagcattcacccatttcattttgctttactactccgatgtggagaaaaaaaaaatctaaggattacatttctcttgcagattttttagatcaatagctattatttaaatacagggaatcctgaaagtctaagactaaaaaatttgggttccttttgtatatgttaaattctcccatatacacatgggtctgtaaataaaaataaataggtggcccctacccttgcagttgcatagagaaactagaccctgaaataaaatggaacaacattggaggatttttgtttagtggattaaaaattcaataatacttgaaaactttgtccagctcttcaacagagatatttggatgagttttctggcttttctaatcaggaaaggcttgttggagaattaaaggagatatgattgaggaaataaaacacaatacaagatttttctggatttattatgaataaaaagggaccccagaggattaagtggatgtagtttgcagttgaggttaagtggtcatggcagtttaccgtggacattgtttaactgatggaaaactccaaaagactgaccaaggaattgaagtagaccaatttggaccaataacttggagctcagaattaaccactgtatttctctattccaaatacccattcctcttccctggaacctcaggctggccacacaaactttcttgaaaattcttggggttctgcctttacaggaaggccatttgcctcactcatcagaagtattagaggtttattctgcacaaccatgaagaggttaaagagaagggtagggaggccatgagggttcttacattccatcttgagtcaaccatctcctgttaccctctgaaaagtggcagaatttgtcccagacttttttttgttgcacttcatatctactatggaattacatttatagctaatgcattaactctaaaaatggagaaacccattgctctgctgttttcatggtaaggaaaaactgctgagtcatgattgacatgggctgtttcaagagtttccacggaatgaaggtaaacgcttaggatatcgcagcctgagtgagaggcactgcaaagtgtggccgctacttgaagttcttcatggtgagtggagagggaatcctgagcgcatcctggattagaaaaaaaaaagaagaaaggtggcctgaaatatgatctgagtatatctggaaatacgcagacatctagtacttcacttgcagcactctgtgaaccagaaggccaatttctacatgctacaagctgcacttcaagatgcacccaaaatgcatgctcgggaagttgttttttgtttttgttttgttttgtttctgagacagactctccctctgtcgcccagccaggagtacagtggcgtaatcttggctggctgcaacctctgcctcctgggttcaagcagttattttgcctcagcctcccgagtagctgggattataggcatgtgccaccatgcccggctaattttgttgttgttgttgtttgttttgtttgtttttgtttttagtagagacaggatttcaccacattggccagcctggtcttgaactcctgacctcaagtgatctgccagcgtcggcctcccaaagtgctgggattacaggcgtgagccaccgcgcctggctgggaagtcttttttaatggcaataaccaaatgaactctcttgaccttgctgcctctgcaggcactgccccgccccggcccttccactctagaggaaagcacctggcatttagcatctttacacacaggaaacaacagatatgctcagggacttttcctctagcttgtaaccagggatggctgttgggcttggcagccgtcaggctgagagtgactcagcttaaaaggtttcattgttgatatctgccctgagcattcccctttggacttggagttccaggatgtcttgtgtctgtgcttcagcatctgaagccccttgttgcctgttcttaaggtagactgcattatcaacggtgtcttaaattaatagcttctctctactgactattcacttgtcacagctgacatgaaggttctcagtcctgagtgcctattaatgaagctcacagatagagtgcagaaaccctttgcaagatctgttttgccagcttgctggtgtcctggcatgaaggtctccgaccgacgtctttgaaatagttcctggccgggtgcggtggctcacgcctggaatcccagcactttgggaggccaaggcgggcggatcacgaggtcaggagatggagaccatcctggctaagacggggaaacaccgtctctaataaaaatagaaaaaatagccgggcgtggtggcaggcgcctgtagtcccagctactggggaggctgaggcgaatggcatgaacctgggaggcggagcttgcagtgagccgagatagcgccactgcactccagcctgggtgacagagcgagactccgtctcaaaaaaaaaaaaaaaaaaaaaaaaaagaaatagttcctttccacgtggagtggactggccaccttggggctctacatttgcctgcttggttcaggcagttctgtcccatttcatgtacatttcactcttttcccctactagcttctcacagtttaaattatcgatgtgattgcctacccagacatctaattctttcaacaggtagtggtttacagactccagtttctttatgatcatcaagacagggattgaacaactggcaccttccctgtctgtccattgaggggcatgtgtttgatgtgtgtggatgctactttcattaggcaagttaatggcagttagctacgttcacactgaggaggaaatagaccaccgtgtatgcatttagtaaacaccagcgtagtcagtggatctgtttccttaacagaacatggttctgctccactgtacacttcaaccaactgcttcagagcaagctttttccttagaaaagttttcatttaattaggatttagaaaggaacgtggaaactttaagatctccatttagtcttctgcatacttcagagacttctgatgtctcctacagggacaggaaaggagtcaggggtctgaaactctaggacctgaaaggcaagtgcaattcggtcactgtccacattgccagggtgtcaaatcacacataccctgcctgaaagtctgggaattggagaatttaaaatgacaatattttctactgtggaataccttgcattctcccactctgtaaactactattctggaggcggcccctctcactatatttcaaaaccagatgcttttctctggaaatactagaaatgtctctcttctgggctgacctaaaaccaacatagtattgggcattgaagtaaggagaaatatggtcagtgaggctaagacctcctcttctgagaatgaaaaatgactgagtattttgtgttaggtgggacactatttgttaatagagaacttatatcttaagtctcttaaaataattatagcatctcttagttatttccagcataatccaggagtgagcattccaagaacatcatcttacaacttttaattaatatatctttctctaacccttaaagaaatgctggtaactgcttgtcagatgaggaaaagatggatcattattcaagtaagatccaatatgggaaactcagatataaatagttcagcattttcgtttcttatcaaagatttatgactgtgtctactttaggatttatttcttctggactatttcaggagccccttcactggtctttcagcctcaatttcctttcctccgcccctttgtttgtttctcccactgctctgaggacagttgtcataaagctcagttctagacttcttgatttgtgtcccgggtgcttccccagttgttctcaggccaatttctcaggcccctgtttcaccattttatccacacctccaacaggcattccctcctggtggaacttctccctcttcatctgagggtgaagggtctctttgttgacactggtccctctgccgggcatcctctcccttctatacctccctattgctaccaatccttccttcactaagaaatcaacctaaatgccaccttcttcatcccagacatgctaccactcctgagccaggagtaattaattctttgacctgttgtatcgctcttatggcacatggctcttctgtttgatttggaaaaacgtatatctccttatgcaaattgtaagttctttgaaggcagggtccatgtttaattattttattctttaatgtgccttagtacttaaaatgtcctctgctggccagcagtaagggtgtcacctgtgagcttgctcaaaaagcagactgtcagcccccatctcagatatgtgggatcagaattcacattttttttcttttttctttttggagacaggggcccactctgttgcccaggctggagtgcagtggcacaatcattgctcactgcagccttgacctcctgggctcaagcgatcttctcccctcagcctcctgaatagttggccttacaggtgcacatcatcaaacccagttaatttttaagtttttttgtagagaggtgtctccatgttgccaaggctggttggtctcaaactcctggcctctcaagcagtcctcccgcctaggctttccaaagtgctggaattacaggagtgaatcactatgcccggccaggatccacattttaacaaggggtctccaggtgattccaatgcagctgagttgggagttctggctttgtacattgcacagaaccttgtataaagcagagactccctggatagctattgaacaactaatgaataaatcacattaaaagctgagtttcttctcattgacttagagggaggttacctcataattactcaaacatagaaaacgtaacccaacatgtaccattttcctatgaccattttgagtcttaaaaacgtggaaacccttttcttcttttaaaatcttggatttgttatttcagatcacctttgatagtttttctttctttcattttttgtgtaccctcactgggtagtgtttggccttcgcgaagaaggatagagagaaagcttgctaattggggctaaatacagattatgtgcaaaaaaagaaattgctagcatctaaaaataagcactctacacgtgtatagttttataatcttatcagctgtgatcttcaggaccaagtacgtggcaactacaggaggatggtctctgtcgctgtcaaaagctgagtattccaactctcacttacttgataccaaccacagaaggacatgagactgtaatacactgggattttcaaaatgcaaaagaatttgatattaaaggcttgttagctgtctaggaataaaacaagaatggggagaaacatataaagtaaggaagattatctctctacagctaaaaccaggcaaaaggaccacccactatggcatattgtgaaaattttgggggctacttttgtttgtcacaataattggagcagttggttgaagggtacaatgcagcagggccatgttctgttaaggaaacagatccactgactacatttgtgtttaataattgcatgcttagtggtctgtttctcctcagtgtgacgtaagtaactaccatgagtttgcctaatggaagtagcatccacacacatccagcacatgccccttgatggacagacagggaaggtgccagttgctcagtccccatctcaatgatcataaagaaactggagtctttagactgggtgcagtgtctcatgcctgtaatcccagcactttgggaggccaaggcaggcggatcacctgaggtcaggtcaggagttcaagatcatactggccaagatggtaaaaccccatctctactaaaaatataaaaattagctgggtgtagtggcccatgcctgtaatccaagctactcaggaggctgaggcaggagaatcacttgaagctgggaggtggaggttgcagtgagctgagatcatgccactgcattccagcctgggcaacagaacaagactctgtctcaaaaaataaaaaatttaaaaatttaaagaaagaaactggagtctttaaatgactgcctgttaaaagaagcagatgtctgagtagacaatcacatcaaggattttaactgagagaagctagtaggggaacaaagtgaaaggtacatgaaataggacaaaggccagggatactagataccttgcaaggcataggatagtctcatactgtgaagaattgtcacttgaggccgtgactttagaacatctggcctgacattttggtggtgaaaaagtgtttttattaatagactctaaaaatatttttatataaacaaaaattaaatatatgctaaatttttcaggaatgcaattaccatttcaattgagaggatactgtcctttgttttgtttagaactttactatacagtaatgtctctgctcatatcagtctgcatgtgtaactattgaattcacactgattctacttagaggtagctcctgatgtcattgtacctgagcatttgtatattgaaatgttccttatttgtttagaaattttttttttctcatttatataataggatattgtattgatttttttaaatctatgtgactaagcaagttttaaaataagtatatctcaggatataaaaagaggccttgggtctgatgggtttgagaattactggcatggacagcctcattagttcctgtcttaagacagaggataataaaagttaaaggctcagacttaatcaaagggttagaaataggagtagcgagccgggcgcagtggctcacgtctatcattccagcactttgggaggccgaagtgggcggatcacctgaggtcaggagtttgagaccagcctggtcaacatggcaaaacctcttctctactaaatatacaaaaattagccgggcatggtagtacctgcttatagtctcagctactcaggaggctgaggcaggagaatcacttgaacttggaaggcggaggccatggtgagccaagatcgcaccactgcactccagcctgggcgacagaggaagactccatctcaaaaagaaaaaataaataaataaaataaaataaatagtaagagcatatcccacaggaaaagaagctgagagacaatcttggagggaattcatgtatggggcaacttgtcagaatgaacagagcttgggctcaggaattaatgcactgagtttggtgctcttctcttcaactttcagaattcaactatcctgaattctggcttctgggggtcccggcagggtcagaatgaatattagagataatgaccttaaaacacctagcacagagttgcaaaaaatgttacaaattgtaaatactgtatataataacgctaatgtcatctggctcttcaaaatggaaaatgatgaagctatcttactggcttttagagaagttgaccgagttttctacaattgctcatggctagattttggggccaggctctaaaatccaggttctttagattattttgagcctaacaaccaacttaggtttgacctgacttgaatcactctcttcctctaaaattccctgtactcttggctttgtccatacagaacctgtacatcaaattacaccaaatatcacaatcctgtagctttctcatggcaacgtaagtgcctttgatatgtgagttttttcctttttttctggaaacagggtcttgctctgttgcccaggctctgatcgtagctcactgcagccttgacctccctggctcaaacagtcctcccacctcagcctcccaagtagctgagaccataggtgtgcaccaccacgcctggctaattttttaatttttttgtagagacagaatctccctatgttgctcaggctggtttgaaactcctgagttaatgtgatcttctcaccttggcctcccaaagtactgggattacaggcatgagccactgactcaatctagttttttccttttcagtagtcacttttacgcttatgagtaaactacaattttatgaagcctgtggatgctggagtgatacttacagccctggtgtgtcctctgtgggttcagcctgccctgtgaactaatgaaatttaaccagtgtggtgcctccctcccatttagacttctctctctgaccaaactgcctctgttttccttccctttagacccccagaagctgtgcatgctccatgtccagcaataacttttctcctagattctttactgcttgttcgattccagatgcaagagatatagcttcacccgtgcttcctatcttcctgtgatttctctgctaccgcagagggtagtcaccaacctttagctcaaacactgatgccgaggctacgtacagagagatgctttaccagttactcaccttcctcactgggcatctgcagagactcctagagaaatgtttgtaagacaacatgagttataaattttgcattcaaaatcttttaaattggtaacaaaatgaatccctgtcccacagtgtgaagagatcactgcttagtcagtttccttttgggagaattatttccaatttttttaagttaaatgctagttattagaaaagtgaccacatggccacctgagtctgttcagatcttttggaccattttccttctcctcttctgcacacctcgatttgcttgtcacaggtgttccagagattccttctgttcttgtctttggcaggatcatcttgaattgagtagtataaatatatcctgcctctgtttctactatgaaagcccctctctctgcatttcctgcatggtttccttacgctgttctgtgcattttgggtggcgtctgcattcttttattatttttttgagatggagtctcattgtatcacccaagctggagtgcagtggcacgatctcgactcactacagcctccacctcctgggttcaagcaattctcctgcctcagcctcctgagtagctgggactagaggcatgcaccaccacacctggctaattttgtatttttagtagagatggggtttcaccatgttggccaggctggtctcaaacccctcacctgaagtgaattcgcctgtttgtttgtttattgagacaagagtctcactctgttgcccaggctggagtgcagtggtgttatcttggctcactgcaacctctgccttccgggttcaagcaattctcatgcctctgccttccgaatagctgggattacaggcaccagccaccacgcccggctgatttttgtatttttagtaggcacagggtttcaccatgttggccaagcctgtcttgaactcctgacctcaagtgatccacccgcctcagcctcccaaagtgctgggattacaggtgtgagcccccgcaactggccaggtctgcattcctaatgctacttttgagcccggcaatctcagacaataaaattcagtgcagctggggcagataagtgcccccctgctctcacatttctctttagtcttggcatcttcaagttagaaccaggtcattatttttgtatcaatgacatttcattatgccataaatactgaggtgttaaaaacaccaaaaaagccctaaaaatgcctagaaaattatccgaagcatttactattaaggctgataaactttttcttctcttttcaaatataaattgattataaagcatattgagtgacttcaagctgaaggttttcagtatctggaaaactgaaatttaattgcagccttcatgtcaccacagtgccaggtgcagcatagtgctcagggccccacgcaccttctaacttccattcccaaacaggtcttccctcctctccattccccaaaccccaaccatctccacctgctgacactgtagcttcatccccagatcacttcagctgaaagtggttttcctttttctggattccaagaaggactttgcttgcaaaaaatgtttatttacttatttttttttaaaggcaacagaagttccacaattaatcttttcttgtaagtagactttattttttagaacgggttggccaggcgcagtggctcatgcctaaaatcccagcactttgggaggctgaggcaggcagatcacctgaggtcaggagttcgagaccagcctggtcaatgtggtgaaaccctgtatctacgaaaaatacaaaaattagctgagcgtggtggcgcccgcctataatcccagctacttgggaggctgaggcaggagaatcacttgaaccggggaggcggaggctgcagtgagccgagatcacgccactgcacttcagcctgggcgacagattaagactccatctcaaagaaaagaaaagactgagagacagcaaacgagacatagggtttatcaggggaacttacttacagggatggtccagtggtggcaggttggacaggagaaccactaccatttgtaaaaagcatacagtttatatagcattttcacttagcaccctccacctagcaacctccatttaacccaaaacaaagggacttgatcccctgtatgacctgcatttcaagagacaggccaggggtttggatgtccatcatgggtaaggagtgaatccctgggttggccactcctggattccttagctcagaactctgaatgcacattcttcttgatcatagtgtcattctcagggcatgcctaggttaagttattgctgtcaggtgcatctctatacacttcctaatgtgttgctcttttatgagtgaattacctttaatttggccttatgttttctatgtctatgttgtgcttctcttttattcttatttattcagtgtatatttcttaagggcatattaggcactgctgtgtaggtctggaaaaacagggaacacacaaagtacctgccttattagtgccaggatttcagagaaaacaggcaggtgacagacaaaccaatagatggcatgcagtataagtgctatgaaaaaaaaataagacagtgtaagggaaatcgacacaggagaccttaaagagaaggccttctggatgaaaggacactttgagcagacaccagggagcagtgagggaggaggtggccatgtggatatctgtctagtggaagagcccagaaggcagaggaaacaacacaagttagacagttaagaccaaggccttaggtggggtggcaggatggctacatgggactgagggaccatatgggggtgggacatagtcaaggtcaaggtcatgtagggtcttaacaggctgtagtaaaggcttgaatttttactctgagtaagagggaaaatcattggctttttatttttctagaaatagggtcttgctctgtcacccaggctggagtgcagtggctcaatcatagttcactgcagccgcaaactcctgggctccagcgatcctcccatctcagccttcctagtagctgggactgcaggtgcacaccaccaagcccagttaatttttaaattttttttttagagacaggatcttgctgtgatgcccaggctggtttcaaactcctggcctcaagcgatcctcctgcctcgatctccctaagtgctaggattacaggcatgagccaccacacctggcctccattggagggttttaaagacttatatacttagttaaagcagtctgtagggggataaggcaagcctggaagcagggagacccgtgaggaggctcctggacaacgtagggacaacaggccatgactagggtggtggccatgagaggtgagaattaatcagatcccagttcacagagttgatgggatttactactggtctgactgggaaggactgtaaagaaaagcagggagtcaagaatgattagaaacaaggtttgtgccctcggcaactggaggaggattcctgatgtcatttacagagaatggggaggggatctgaggtgggattaagcttgaggaacaaactcaagttgggttttggacagactacattcgaagttcctgttggacgttgaaggctgttggctgtgagtctgccttccaaatccctgagtccttgaattcaaggtcgtgtgttggccgtctttgtattaggacatctaactcttgtgtttgacttaatgggattcaaatttgcacgtgtgtggttttctgaatgtggcctacagtttcacttggatcttcatattctttttcatcataatctgtaaaagcagaaaaaaagaccattggaaagaaatgctgtatgaaactttctgaaaatggatagaaccagaaatgatgctgacaggagttttagaaatgaaaaatagagagtattcagaccaaatataagtaaattagcataaatcagcattctctgatttccacgcctacttacccaagttggttgactcaacagctgctaagactacagctgtgtgaatcctccacatttttttttttttttgcatggaaaagtgtttcagtttgtcattgcttcatcatttcgaattccatattaggttacctttttttttttttttttgcctgaccatagtacttaagaaaaatcttgcaactgtccttcattctgttgaaccaactatatcttatgttttcacttgacattttgttttagatctacttggggctttatttaaatttttttaacatttaaaaaaatttttttacttaaataatgaggcagtgtctcattattatccaggctggactgcatggggcattcatagttcctgggctcaagcaatcttcctgtctcagcctccaaagtaactaggactaacagcatgtaccaccacatccaactagtttttttcatttttttatagggacggggtctcgttatgttgcccaggctggtcttgaactcctggcctcaagtgctcctcctacctttaagtgctgagattacaggcatgagccaccagacctgaccttggggttttattatttgccttcgagccccttcagacagttcttcttggaggtttggggaaggcttctgtaaagaaaacttccttacacctgtttgatgatggtaaaaggtccaggtggagaaagacttcctaggcagaaggaaaaggaagtgcaaagctatgtagcctctacaagagcacatgtgtagtttagggtggctgcataggacctgggaagagagctgggtgatgcagggcagatgactggcaggtaatgaaggtacttatgggctatgctaaggagtatggaaaatggggagtattcaaaatttagagcccagggtacagtgatgggattgcattttttgacaaagctactttgactgccatgtaaagaacaaatgggaggtgagggagcctgattagaaggtccttgatgatgcaggcaaaagatgatgaaggtctcaaagttctttgagccttgactggaacacatttagtgtgacgtgtgtttataacataaaattaaatacgaaagcagaaacattggtgatggagaggagagcacaaaattggggagatattgtagccaggttgaaagcttgtactgctcactgcacaacagccagtaagtcaagagacaaggagttagagtaaggaagatgactttatttggagagccagcaaaccaagaagatggtggactggtgtcctaaagaaccatcttaaaagacatgaatctcaagcttctttttatatttgggaaaggggaacaaggagagggttgaggtgacaggtgaccacagacatctgagcattagcaggcgtccgagggtgttacattgaatattgcattgttacttgtgtctatgccctttttatttcctcagtggttagttttgggaagggactattatcatccttgctttaaactgtaaactaaatcccccccatggttatcttggcttatgtgtgggaatgagcaaagatagtcagcttgagcggttagaagcaagatggagttagttagctacgttatgtttctgtaactgttacgtcttacttgtaggattacaacatctacttggatgaatggtgatgtcattctagcatgaggagcaggtgggattaggttgaggttgaatgggaccatagttctgtcaggacgtgtcatctttgtggagcccaggggtcatccattaagcagctgggaatacagttctggggctcagcagagacctcagcctggaagaacatgtttagaagtcatcaacatctcattaggaaagagaaagagatcgcccaggagaggaaatagagcaaggagagaaaatggtcaacaagggaaaccatgctgggattgagtctctgtggtaccaatggtcttactattgacgtcagagttaaaaaagaagagagttatattcaaattctggttgagttagtctcttattaacatttcctgactcaccaactggtaaatgtccaagaaaaatatatctttttgttttatcagaaaatatacatgctatttgatcactcttcaggcattaacaaatggtgtctatgagaacattttaacaaaatgtcctttctactgttaatacccacagcaaccaacttggaaatcagtcatcatagaagatgactgcaggttctggctttcccaaatcaccaataattcacacctttgtacatggttctgtgcatgatctgttcctaatattatgcaacacttgtgaaatctttaggactttaagtaattcatcgttttgccccaaacctagacactactataagaaacccaacaggctactcttaccagcaataggggttcctgaacaatatcacggaacaatgagaaatcctgcactcatgaattctctttacaaccccaggtgctcaagcatggtttttaagggtgactccctggccacctggtaagtctgagtgacttgcgggcagctgtctttctggagcgggagttattctctgaagccatagaaagtgtcagggaaggctggatacacatcacgtatgtgcatgagaagtaatactttcaacagcagcagcatcttccaagtgataaaaataactcagctttagtcagtagcccagaagccaagtgtcccctttcactgcttgttctctgttggtattcttcaaagggacatcgtgtctttcacagtttggaatgtgatgtttctgttctcactgacataactgtcttagtatctgctcctcctcttgtcatatatttggaaggtcttcacctcttgatcacttgcattttacattctacttgtctattgttcattcacacggcaagaaatgacggctacctgccgggcattagttagcaaagctgcttatactctgatttctattgttctcccagtttttagactgtagccgtttaattacaatgcagcagctttcacgtcagtatttctcctgaaggtcttagtttattttattcctccatcacagaaggttccttgaggtcctgtattctgaaaatagatgcatttcttccaaaatactggatagcttttagatttttcaaagttcttggcaagtctacttttggaaaccttgactgacttgcgaatatgatttctccttttttcttagctccgggttgagctccttctcaagagctcttatgttataaagcttgtgttcatgagcagagaaggactgatagtgggtgttattaatcattgaaagatgtggctgtgactgctattatttcctgtgttaagcttcccaccagcaaacctggccaagtgctttggcgctgtggaaacagccttcgtgtacacacttcttgacccttcactcccttcatgcccttcttcccatcaagacttaatgattggctgggcatggtagctcatgcttataatcccagcgctttgggaggtcaaagtggaaggatcacttgaatccaggagtttgagaccagcctggaccacataatgagaccccatctctccaaaaaaaaaaaaaaaaatattagccaggcatagtggcaacatgcctgtagtcccagctacatgagaggctgaggctggaggattgcttgagcgtaagaggtcggggctacattgagccgtgattgtgctactgcacttagccttggtgacagagtgagaccttgtctcaaaaaaaagaaaagaactggaaaagaaaaaagaatggtgttcatctccacccagcatgctagagcaggcatgccattcattgtggaggcaaaactcccgcatagctgccaaaataactgctgagtgctttgcgatggagagaaacaaaggaatgttgggtcactgcccgagtcatggggtctctgcctgagccatagaaagcttttgatttctggagccacattgaatgaactgattatgtttaaaattataaaagaaaaatatagcctaagataattgagtgcaataaaccaatttaacttatttgttcttacgtgtaacaattgttgagtaggtaccatggtacccactctattgctaagctgtggaaggagccttgctttggaattctctcagctcctctttcccatcatttccttagctgtgtcccttttcagcctcctgtgctaactgatagcacatgtgtttcagaatggaacctggaaaaggaatgtgtgcagccctcgtaaggatataccgttccacattccatatgctgttagataatatgctggctagaccgtcaacagttaccccaggaagggggaatttggattggaaagaaatcaaaggaattggaggtaacataatggactgcagttaaacagtaatagggtggtctggacaactggacgaaggccagtttctaaattgcaggcaatcccctctgcccttttagaacaaggcaaggtccactgaatggagaagaaggcaggccatcagccttcttagggtttaattcagacacgggctctgagctttgtcttttgttctctttaaaggaacaaagccattgaatccagccagaaaaacctgtgcgtatccatcataaacatccacaaactcttctttaatctcccttgttattctccctaagaagtaaggctccaacataagttcttggttgcatctgacaagtgtcagctgatgtccatgaccccttcgtttcctgtgtcccttctacttgatgcaatgactggcataacgtatttgttggaatgaatgaatgaatggcattggtggctgggcacagtggctcatgcctctaatcccagcactttgggagtccgaggtggctagatcagttgaggtgaggagtttgagaccagcctggccaacatggtgaaatgctgtctctactaaaatttcaaaaattagctaggcatggtggctaatgcctgtaatcccagctacttgggaggctgaggtcggaggatcacttgaacccaggaggcggaggttgcagtgagctgagatcacaccactgcactgcagcctgggtgacagagcaagactctgtcaaaaaaaaaaaaaaaaaaaggaaggaaggaagggagggagggagggagggaaggagggagagagagaggaagggtgagtgagtggaagaaaacaatgaaatccagttctgagggtaaggagcatgccatcaatatgatgggggatgtgatatggtatgaggatggggtctttcaaactgtattgtgtagaccagtagaccatgacaaataggcgcgcgcacgcgcgcgcgcacacacacacacacacacacacacacacgggcttccatgttcttacaaatgttgcacactatatctgactgtgggatcacagtgtacgtttgtataccaaagtctctgtaaagacctgcaatgaagtgaacccctttaacctttcttttactcagtgttcccctattgtatttgactgtggaaccctctgcgtcatacccttttacatcccagaacccaccgaacacagtttcttcaacattggcagaaatttacaaaatcatcgtagtcttgagtccagctgacctgagtgtgaatcaaggtttaccacatagtgtgtgatcctgagccaaattaagtaacctctggttccctccttcctcatctatatgatgaggataatgtgcatctcctaaaaggagagaatgaaggcagttaatgcaggtaatccatcttgcgtgcacccagcacagggtggctcttccctggttaatttccaccctgatgtgtagaatttccctgcaacactctgctaccacaaagaggggcttcttaggatataacctattgtccttaaactttatgagcagtgcaataattgttatttgcacctgtaaaatgtgaataactggtctttctttttaaaatactttcccaaaggaaaattatggcaaagagatcatgtcctaactagtttctcacgtgttggtgctatcacctcctgagttttggcaacgttatttctctgctttttttcttgactcccctctagttcttctaaattagatattaagcaggagaagtatttttaatatcctggaaatgtgttttattaatctaccaaacaaatggctgtccaacaactccatgaaacaggaagaacggccactagcattcattttgcttttaccaggcaccaggtagcgctgtaaactctttatgtgtgtaattcatttcatcttcacaacaactcgatgaggtaagtgctattatctgcagtttgcagagaaggaaaccgaagctggtggagtaacatgcctaaggccaccctgccaggataagatgaatgaccacgactctgagtgactaaagccttaggaacaaagatgagttgaaaatgggagagccacctggggtagaaccccagagtttttattttcttgcaaagttttagtaaaactttctcagttttcaggaaacaaaagttatatattttagagtttgaaatcacaaattacacaccactcccccatctctagcctctacatttttaagcaagatcaacagaacccagtggagttccatggagttcagggaccttgctccaggtgtgcctctaacactcagtcccttttccaaggcagggcacatataattgaatataggctgggtgtggtgtctcatgcctgtaatcccagcactttaggtggccgaggcacgtggatcacttgagcccaggagttggagaccagcctgggcaacttggtgaaaacccatctctacaaaaaatgcaacaattagccaagtgtggtggtgcacacctgtagtcctagctatttgagaggctgaggttggaggatcacgtgagcctgaagaggttgaggttgcagtgagccaagattgtaccactgcactccaacctgggcaagagagtgagaccctgtctcaaacaaaacaaaacaaagcaaaaaaatgaagattgccaaatatttaaatgtcagttactattaatttaaatgtccatcagggttctccttgaagtcaaaactgctgttttccccaatgccagaactcctaacagtggaccccaggccgtaggaggtgatctagaattgcccctgaattaaaggctttgtgttctgcacacgtgatgcaacctcaggatcggacatgtgttagttcccagcctgtgtcctgtgacaccttggagaacaatcgagactggttgatatttggagggttaagcaaaggacctttcttttgccagctactctgccgtggttgaagtgtcttgagggtggtgaacgggtcctcgctgggcttgtctctgagctgcacacattgacttgacacaggagtcaagtagtaagtattggttgaaggaatcagcgatgtttggctacccattgtgtgctctctaatatttgctagggatatggtgataagggaggaaaaagacccaaggagtaatgaccgagcagctatgtaagtgaatcaatgatgtgaccacattgctttttcttagccgatagttacagctctatgcaactttttctacttattgctggaggtaatcacattccaaccctgaggactgctcccatgctgggcggtactgcagtgacctctgcatttgagctggggtttcttgtatctcacgagggtcaggggcctgtgggaactttttgtcatctggggggacaaaggctttcttgggaaaaaaaagtctcctttttatcctctgcgggtgaaaaagaagtgccgttagaataggaaggggcttcttgtaggcttgaaaagagaaggacttggcaggtggcacctgggctttgttcagcagaactgagagggcaagagtatagctggcttttttgtaagactcatgaactctgtggcccattgatgagatgctctctgctctacaaagtggactttcctcgaggtggaattttattttcctccctgtgctggtgttagattctctggatacataaggtgacccgaggagaagcaggcaatgtcatcacagtttatttgtaggatctgggcttcctccttcagaggaggtgccactcacacccgagatgcctgctctctccctgagcctttcagcacaagggcaggacggagaggagcccagctaacgaggggccagctcaaagtcattcaggaaaaacagatatacacagacatggccggaagcctcaatgtgtttttctactgcaggaaggttaaagtggaacttcatgtcatagatttaaaaaaaaaaaaaaaaaaggctggggccaggcacagtggctcacgcctataatcccagcactttgggaggccaaggcggccgaatcacctgaggtcaggagttcgagatcagcctgggcaagatggtaaaacctcgtctctacgaaaagaaatacaaaaattagctgggcgtggtggcgcatgcctgtaatcccagctgctcgggaggctgaggcaggagaattccttgaacctgggaagcggaggttgcagtgagccaggattgtgccactgcactccagcctggtgacagaatgagactccatttcaaaaccaaacaaaaaaaaggtgggcatggcggctcatgtctgtaatcccaacattttgggaggatgagagggaggattgcttgagtccaggagttcgagaccagcctgggcaatatagtgggaccccatctctacaaaaaaataaaaattagctgggtgtgatggtgcagacctgtggtcccagctactcaggaggctgaggtgggaggatcacttgagactgaggaggtctgggctgcagggagccttgattgtgccactgcaatccagcctaggtgacagcgcacatccttgtctcaaacaaacaaaaccctacatatcttaagaggtattggaaggccttaatacatgccaagcacataggactcaatgagcaattctgtctcaaaaataaataaataatagatatttaagaatacactactattaagaacctcagatatggaagttcatgaaagatacttttatttaataagacatgaagggaaatttagcgtcactgatggtatccttctctctcctcaccgcgatctcttccagttaactgctgaatgcaaatcaacagtagagcgggacgtattttgcagttcagttattgatttttagggagcctgggtgggtacccttatctgtgtctctttgaggacaatgacaggagccctcattgccaacagagataacagtgagattgtatttttatttgttccacaaacactgacgtgacaaagtgctcttactggtaggcttgaggagagtagcctggcgattaaatgttcttatttcgagtgagcagccgggctgtgttcagaagagcccattagcagagcacgggacccatcaacagtccaattaagagcaaagggatgtgactgcggaaatattaatgggctgtgttggtaaagctgcccggggttagcgccagatggagtttttctgtatacagtttgtaggaaactcttgtgtattttcacgcgggatgtccttctgcagagggggatggttttagataatgactgttgtgctttttggggataccacctgcagagatgtgtttattttgagtgtttatagattgcagaaagctggtgaaaccaccttgagagaggtgatcctttgattgaatgtttttttcatccaacaccaaaaaattacaggccatgattggattttggagctgattcttgctttgtaagactgcatggttttggtgaacatccatctggttgttttttttttttttttttttgagtctcactctgtcacccaggctggagtgcagtggtgcaatctcggctcactgcaacttccacctcccgggctcaagtgattctcctgcctcagcctcccgagtagctgggattaccagtgcccaccaccgcgcccagctaatttttgtatttttagtagagatggggtttctctatgttggtcaggttggtcttgaactcctgactgaacatccttcttgaatgatgaagtcaaccttatttacccttgaaagatgacttaatccttaccaagagagcttcaaaaatacctgttattctgtaccttcgtttaaaaaataagtcctattgccttaactcctgtccaatgcctactgtagctctgtttacatattacaaaataaatagaaccaaccacatgtctttgaagtaccagccctgttagtccatggtaagatttctgcctaaaatttaagcatcttgacaacatgcgggagacttaggggcagagaaggaccatttctcagaagaataacccctcagctcagcacagttgtgtcatctgtccaaggtagcactttagcagtttcctaaatgagggagggtattcatgtgtgtatgcatgtatggtgtctgtgtgtgcacacgtgtacatgtgctcacgcatgttataactgtagaaaacaggcaggggagcctgtgatttgccttgtgtttctataaacccccctacagctttaactaatttccatggttgttgatggaggttcagatgtgaaatctaatggtatctgtgatctgcaaaatatacatattggccgggtgcagtggctcacgcctgtaatcccagcactttgggaggccgaggcaggaggatcatgattgtcaggagattgagaccatcctggctaacacagtgaaaccccatctctactaaaaatacaaaaaaaatcagccgggcgtggtggcaggcccctgtagtcccagctactcaggaggctgaggcaggagaatggcgtgaacccaggaggcagagcttgcagtgaactgagatagcgccgctgcactccagcctgggcgacagagcgagactgtctcgaaaaaaaaataataataataaaataataaaataaacccattgttcatctaagaacctacccatgtctttcgggaggctttccatcttatcttgtcttggttcagacagtcttccatgggacccactgataccctggagcatctctggaaggttgaagcggaggacagaggaggcatggaaaaggtgtgcagtaatacataggaagcttccaaagagaagtgggtgcaagacagcacagaaacatgttcagttgcctcagctgctgatgttcaaaatacctgcagaaaatcaacgctgctacacccaaaagaaaaggaagatggaactgggggcctagagtgaattttttcaaaggtaaaaaggagcccaaatttcacagaatgatctcccgcttcagaaagggaaaccctctaagtacactatacacttccctgcctgttttctggagagtgataccgagtgttggcactgtctgcaaggaaggaagtaggactttgactaattgcacaaacagcaattttgtgtttttgaagtgcgaggactcagtcctgtgtccacgaagcctccttcaggaggttacttcttgacatagcccatcaaccggacctcccgttgctaggttctgagccttagggtgctttcaaatgcaatatctaggccaggagtggtggcccacacctgtaatcccagcactttgggaggctgaggcaagaggatggcttgaggcaggaggatcgaagtcaaggctgccgcgagctgtgatcgtgccactgcatgctagcctaggcaacagagcaagaccttgtttcaaaacaaaacaagaaaaaaaaaatatgtgcagaatccactaatggaagtcatcataaatttgttgccagaatgggaatgtatcagtttatacttcctacattttgttttttgtgatgactttaactttggatcattttatcagtgactggatgaaagtttatctttattttatctaatggggggggggaatccaaggagctttttaaagacagccagtataattgattataaagggtagttccctgctaagctgaaaatgctgtcttcgaacactttaggcatctgtttctacctaagagatgcattgtggagcccagtctatagcacctgccactggtcttcaatgtgttcagtatgtatcctgataatatatgaaacatcagggtccgctcacctgcttcaggtgctgtgtgtactccaacaggtattctacaatccgagctgttcatcagttgttaaattactgtgatttgagtcccttcaaagtgagatccattggcagcaggaactgttatatagtattatgtgtgtgtttaagggcagagggatggtgttatctaactgtcctgtcccagtttgcaggcatggaaggagttcctaggatgtgtgactttcaattttaaaactgagaaaggcctggacaaaccaggatgagttgtcaacctgcatgggggcaatggatttggccatgaacttcatcatttcaaagtattaagttgttggcattctgaatgcccctgaacctattttgcatcgtagagtggacttgttccccagtgacccatgtccacccctagtggactcgatcaactcctgacacacccctactaggaacacgaaaatggttgtagaatgtgtttcattgtcctcatccacagatacagacactttggtgactctgtgttctatctgaatgggggctgagactacaggataccccatcccatttctgtcctctgtccttcatccaaggtgtcaccatttgtatctatcaggaaggaggctttgcagctaaaatttaaaataataagaagaatatatttccgagccagagattagatgcctacatatctcttttggcctcagcattctgtggtcttctatggagaaaggctaattttctgaaggctttgaatggaatgaaaactgcctgttcaaatggttctgaggatactgagagacgctcagtgtgtggtctttttatttttagtaatagtgttggaaaaaatcaggttatgtttacgctgagtgtgtggggggcgctggtgagattgtgtagtctagaaaaggctagaattataaattattataaacgttggccatgtggggaaattcttataccaaaaatactgcaatgtatgtcagcctatagattttcatgtagtttcttgtccaaaactgtatatgagagcagaaatgattgattatgttatgttcaatgtatacctaatatctagtgctgatacataaataaacccatcatttgtgacaagggtcttttgtccgcatttaattttattttgttactttttatttatttatttatttttcagccagggtcctgctatgtcgcccaggctggtctcaaatttccggactcaagcgattcccccacctcagcctcctgagtagctgggactggaggtgtgcaccaccacacccagcttaattttatttttatggccaaatatgacacaggtgaaagccattacccagaccttcaaaggagtgtcacgatggggttggcaatgaggacaaggggtgatgaggaaaatacattgctggaaatcaagttgataataggtttggtggaagatctaagaaatgtagtgtggaacctctgaggtagggaaactgggaattcttttctttagaatatacatgtatattggcatgtatgtagaatatgcatgtctggaactccagaatacaatctgggctgcagccatcagtgtacaggttaaaggttcttaggctttctctgttcacggcattcctgtagactaaaagaaacagctaacagctccgtttattaagtagtaaagcccaaacaacttagtaattatttatgacctaacaatttagtggccaattgaaaatacaatcacatcaattcaaaagaaaagatgtattttttcatttttaggtgatggctggttttatgcatcaacgtgcgtagggcatggggcctagatatttggtcaaacccctgactgggtattgctgtgaaggtttgttttttagatgagattaacatttaaataggtaagttttctgggtgcagtggctcatgcctgcaatcccagcactttgggaagcggaggcaggaagatcacttgaggctaggagtttgagaccaccctgggcaatatagcagaacctgtctctaaataattagatagataattagatagagatagattagattagagaggtaggtaggtaggtagatgatagatagatggatagatagatagatggatagatggatgtatagatagatgaataggtaggtagatagatagatagacagatagacagacagacagactgattgagtaaagcagattatcttctatactgtggaaggcctcattcaataagttgaaggccacaagagaaaacagactgaaacaggctgaggtttccttgaggaggagggaattctgcctctagactgtccttgaacttgagctgcagcatcaactctaccttaggtctccatcctgctgaccttcccagcagattgtggatttgccatcccccacaatcatgttagtcagttccttaaaatcatcactctctctctttctggttttctcttgaatacacacgtatacgcacacctccccctctcttatctggagaactccgccttctacaattaccagtgggatgtgtgcacctgttgggcaccgcacaactcccctgaccttggaatcagattggacaacatttcctattccgctttgatttttctgcagtactggcattttaatcccagcaacctctgaaaacctcatgttgcaaaaatgacatcaacaagaagaatgcttatgatctaatgttgaaactgtgaactacctgaagtgaatcattagcccagtgtgtaacaagtattgctgtgtttccctcaaaaagttaaaatatccctcagtgcctctgtgagttcgctgtggcatcccatccaggacacctgggtgcacggtttgggagctgcaggtagagtggcagcagtagtcatgggagtggatgagttcaggtggagggcacaggaggtggagacagcagagaagagcttcacagagaacatctaggagggacagctgaagaagcgctttggggccgggcgtggtggctcacgcctgtaatcccaacactttgggaggccgaggcgggcagatcacctgaggtcaggagttcgagaccagtgtggccaacatggcgaaacaccgtctctactaaaaatacaaaaattagctaggtgtggtggtgcatgtctaatcccagctactcaggaggctgaggcatgagaatcccttgaacccaggaggcagaggttgcagtgagctgaaatcatgccactacactccagcctgggtgacagagcgagacgttgtctcaaaaaaaaaaaaaaaaaaaaaaaaaaaaaaggcaggggatggctttggaaaggagattctaaagggagactagagacacagggaaaaattgatgtactgtctgtgaacagcaaggaaaatatgattacacctaagagatgaaattggcataggcgagaagtcagaaaaataatctatacagcttgcatggttggggagttaggagaggccaaggccacgtgcacgtagagcaagaggtagaagaggcccgggggctagagcgcaccctggtggatagtgtgagaatttcacactggctcaagccttgaagaccaccccaggggtgcgccttagcaacgcacttatgcaagaccccaacaactggcccttgaaaggagcttttcactggtggggtgtggccctgcttgtattcagaaccatagttttaacaagccagcattaaatccacaagtctttgccaaagcactttaagcctcttgacatttattggaattaatttacctgcaaggaagttcatatatctagctttgttaaccctacattcgggaaaatgtttccatgagataactaaaacccgcatgaatgatacaatactgtgacaaaacccaaaggtggcataattagcatataaaactcccaaattttttttgcaattaccatcgtctagtaactggttgtttcattaggtaaaagtggatggaatcagtggaattatatgtatgatatgaaatgctctttggcatctattaaatttttattttgaagaaaaaataaaggacaaggaaagcatcctattccaagactccaaggagattatatttttaattccacaccacagaaaatgcaaacaaatttctaattacacttcatgcatggagatctgtagaggaaaaataaattggtacccatccacccaaaagccacaaatcagacatagaatggctaatcacaaatataacttgtgtgcctgatgctgattactttctccgcagtctgttgtgaacaattaagaatttagatcttgggctgggagtgctgtttttaaagtgtgactcaaaagcataaagttcatttaaatttctcctaatcctggtttgcaatttctattcctttttggttagagtattatttatcttcaggaggcccctattatactataaatattgccttggggcagtgttcatagcaccacagcacctatctatccatttatcagaataatcagcacttcctgttggctgagaaaacactgtcatttttactgtttaaaaacagaacagctttcagtagcaattgccattaattgatttcatggcaggaagacggaaaattctccattttttcattctcataagtcacctaagaacatcttaaaagctacagagaggccgggctcagtggctcatacttgtaatcccagcactttgggaggctgaggcgggcggatcacgaggtcgggagatcgagaccatcctggctaacacagtgaaaccctgtctctactaaaaatacaaaaccaaaattagccgggtgtggtggcaggtgcctgtagtcccagctacttgggaagctgaggcaggagaatggcgtgaacccaggaggtggagcttgcagtgagctgagatcacaccactgcactccagcctgggcaacagagcgagactccatctcaaaaaaaaaacaaaaaaaatgctacagagaaaggggacagctgccatggaaaacagtggggcggttcctcagaaaaaaataaaaatagaattatcatataaccctgcaatttcacttctctgtacccaaaataattgaaagcaggaacttgagatatttgtacatccacgttcatagcagcattattcacaattgccaagggataggctcggcacagtggcttatgcctgtaatcccagcactatgagaggctaaggtgggcataatggatcacgtgaggtcaagagttcgagaccagcctgaccaacataccaaaaccccatctctactaaaaatacaaaacttaactgggcgtagtggtgcatgcctgtaatcccagctactcaggaggcgggagaattgcttgaacccaggaggcagaggttgcagtgagccaagatcgcgccactgcactccagcctgggtaacagagagcaaggcttcatctcaaaggaaaaaaaaggagccaaaggatggacacaacccaggaagaatggataaaatgtgaaggaaattctgacacatgctacaaaatggatgaaccttgaggacattatgctcagtgaactaagccagtcaccaaaaagacaaatagtataggattccacttgtatgaagtacttagggtagtcgaattcagagacagaaagtagaatggtgattgccaggggctgggagaggggagatggggatttactgttcaatgggtgtgcagtttcagttttgcaaggtgaaaagtgttctggagatgggtggtggtgatgatcacataacaacatgaaaatacttagtgccactgaaccggacgctcaaaaatggctaggttggtacattttgtggtgtattttactgacattttattttattttattttattttttgagacagggtctcgctctgtcacccaggctggagtgcggtggcccgatctcggctcactgcaatctccacctcccaggttcacgcgattctcccacctcagcctcctgagtagctgggatcacaggtgcatgctatcacacctgactaattattattattatcatttggcagagatggtgttttaccatgttggccaggctggtcttgaattcctgacctctagtgatccacccgcctcagcctcccaaagtgctgggattacaggtgtgagccaccatgtctggcctgaaatttatttttaaaaaagcaaatctacagaggagtgggctccaccatagaaattcagttccagttagtcagcagtagcggcctgggcagcagcaattctggtctaaggtgcggggtaatctctgaagtagttaaacacaagtggtgtaaccaatgtgtcaggatgggagaactgggcactgggaaagagaaagactagtgttgggaggagcagggaagcaccagcaaggaaaaagaccctgtacatgaacttggctaaggaattgtttcagtgatagaaataccagacactgtaaatggttgtgcacatgggccagagaggtctttaaattacatttgaaacatatacacctactgtgtacccataaaaattaaaaactattttaaaaaataaattccatttgagccactccttcaaaccacccagagtgggtagacgtctttcgtgcctctaagaagccccatctctattctgcgtctcaccttgcagggctgctcatctgaatcctgaagatggtggacacccatctgctaggactgaaatgaataggacagagggaggtgcagagtgaatggaccatactacctgtcatcttggcaacgtgtgattgaataaaacaacttctttagaagtttgatagagtgatttgataatgtaatttacaagtgatcatttctttttattttcattttcagttgttttttatagacaaagtctcactctactggctaccggctaggctagagtgcagtgccacactcgtagctcactacagcctcaagttcctgggctcagcaatcttcccacttcagcctcctgagtagctgggactataggcatgaaccaccatgcccagctaattaaaaaaaaaaaatgtttttgtagagatgagtcttgctatgttgcccagaatggtcttgaactcccgacctcaagtgattctgtcacctcaacctctcagtcttctttttatttgtgtacctggcttcagcccttttgtttcttcaagggcctggacttgttactcctggcccaggagtatgttgttaaacactggattaatggtgtgacctatgcatctatttaatttatacgtatgtacagagagatttttgcgtgccgtcagtggctaaccaaatcaggcaaaccacagttcatttgagtaagtcctcccatgccatgaggcatccctgaaagggatccattctccttttccagagaattttctaggatcagtagcaaggcctggtgtccctactcatgctctttattgaatacaattcattttgagtgacctttacttctcagtaatagttctttatttgtgaagcgcagtttgcaaacagcctaatcggcttctggcttctggttactagtattccacctgctttgtaatgccattgtaaaaaccagctgggtaggaaggaagaagatattgattgaatgtttttcactggaagaaaaatttgtgtagcaatgagactgccctagattcaaatggaatttgaagacaatgcccatgttttctcttcgtgtgtgtgtgtgtgtgtgtgtgtgtgtgtgtgtgtgtgtgtgtttgactaacttagggtggttttttttcgtatttcttcttagtacctgagagttaatgtatcctagttaattaatgatagtatgtttctaaaaatcaaaggaagaataataagtataataaaatgttataaagttaagcataagatcttaggctaaggaaccactgtaaatacacctgtaatcccagcaatttgggaggccaaggtgggaggattgcttgaggtcatgagtttgagaccagcctgggcagtatagcgagacctcatctctacaaaaaaaaatttaaattagctaaacatggtaacatgtgcctgtagtcccagctaccacggaggctgagacaggaggattgcttgagcccaggaggtaaaggctgcattaagccgtgatcacaccactgcactccagcctggacaacagagtgagaccctgtctcaaaaaacaacagcaacaggccgggcactgtggctcacgcctgtaatcccagcacttcgggaggccaaggtgggtggatcgcttgaggtcaggagtttaagaccagcctgtccaacatggtgaaaccctgactccactaaaaatacaaaaattagccaggcatggtggcatgctcctgtaatcctagctactgaggaggctaaggcaggagaattgcttgaacccaggaggcagaggttgcagtgagccaagatcctgtcactgcgctccatcctgggcaacagagcaagacttcatatcaaaacaaacaaacaaacaaacatacaaaacaaaacccacagcaacaaagaaactatggataaattgacccagggtgagagtattagtaaggactcttggatttttccccctagactatggctcattagttattttatagtcctgctttttcagggatctttgtattatatcttagaccctgttttgttttgtttaaaaatgtgatgttaatacttgtctgtgggctggtcttgtcaagtcttgcaaacttgtactgctgttgtgctgatttcttggataggagcccgaggttatcatgtttccctaacaatgctcaatcttgcccctattcagcgactgactgtttagaaaagcctggccttcttgggttgcccatgaacttgaccccttagatactggcagtgaagagcttgagttaaaaaaggagttgaaaaaaagtgtaagcaggtgactctcaaagtgccggtcagttgccaccttctctacttgaaataatcctagaaactctcacttctacttctcaaagaacaatccatagtcacccagaaacaagcactatatatacacaaaaactcgggtttctgacttgtcttcattccttcaacatgtccttgttacaaaagtgtgggacagtgatttgcaagttctttgacagtagtggttatactggggattttcttctatctttcaggtatggaactcagctctttgatttcaaggagggaaactcaagcaggctgcagcagttcaatgctctgcaggcgtcagttcctggcattatggagaaactcagaattattagggggaattatggaagcaggatgaaatgagaaagaagggtgtgtatggcccctgagcgggcacctaagagtaagagtgagaaggtcatcttggttccagcctgtcaacccacagatgaggtccagagagagtatagagctagcaagcaaggtctcagatagttaaggcagctctgccaccagcaccttttcaaatgccttttgcaccaccttctgaatagattgtcttaaacttctcagacatgactaattacaagtggccggttgatcctataataaccgatttgtctggtctggctataagattagagaaaattatgctcttaatgcagagtgtggaaaaacagaatggtatgtaatggggtggaagtttggctttgcatgtggatctgtctggacatgtatgaaatgtacatacatttcagaggggcaataaggggaagaaaataaagaaataatttgccattttctctcctaagttcaatttcagaattcagcaggaagctcctctctctaaatgaatacttcaatgactttgtaagaaaaattagataatttagagagttacattattttcatatttataatgctgtgagtaacactgaaatgagccccagcaaaggccttaagttttaggtataccagttaacaggacctgccccgctaaggcctggttggagtgatgtttccatcactccaggaccgtctaaaagaaagcaacactataaaggccttgcatatttgggaaagtaaaagaactttacttcatttccagtttttacttcgttgtgtttttcatcaagctcgttcattattactacggtatctctattgatactgttagataagttgtaaaagttcccataggctaccattttaatcattgtctctcctagaattgtttatttcatgcaagatgttgatattaacaccttatagaaaaaaaagacttaaatcataaaacttccatttgcttccttgtccccctcaccctggaagaatgaaaaaaaaacttgctattttttttaaagtcgatggcaaaatactttggtttagctcatgaaacataaatatttgtggtagcctagttggagaataaatgacaaaagcgcttttataaaatagctgttgtagttatataattcatttttttccagtatgctttaacatttcttgaatctaaaggtgtgaaaggcatggttatcaaaagcaaatagatgtgaatactgctgttattaaatgtcatgcttttcaatttgtcagtcatatattatctgaaaaataaaatggatttttctgttattatttttttcttttattttctcaactgggctgtccacaaaaggtttgtggcattcttgtttttccagtgaaaaatggaactttaattgcctttggatactttcataattatataaattaatactgacccccaaaacccttacatataggaaaggtacaactggaaataggatggcattttaatgataattagggaaacgaatgatatgaaattacttatgatttgtaaatgatgcttaataatttaagcagagagaggtggtaaattgttgtctacattgagagtgttttatgcataccttttggttatgcataacttttggttttccttttgtttaattattgcttcttagtgttttcaaaacacagcacaaaatatttgagtatgatttgttttctgaaagataagatgtaaagtgcaaactcattagatttatattagaatggatgcaagcttgctgcagtcttctaaattggtattgcttatcctttgttgagaactagtttgggtatggtcagtgttttggaaagccatttcatgagcactgccttcacaaggtaagatgccaaatacagacgtttcagaaatataagttcattgggttaccatcactatgatacccagcccaattatgttatctaagtgaaatgtttaagaatgtctcctaaaacatggctacctatttgactttaatgtgtttttgctgttttattaattgatgtaaagtcccctataagtataaatttaagggaatttctcattgagtgctatgtgcctgacatgtattaatgtctcttcaatactctttgacatatgtagttttttgtttgtttgtttttgagacagggtcttgttctgttgcccaggctagagtgcagtggaacaatcatagctcactgcagcctcaaactcctgggttgaagcgatcctcccacctcagcctcccaagtaggtgcacgccaccatgcctggctaatttttgtatttttgtagagatggagtctccctatgttgctccagctggtctcaaacttctggactcaagggatcctctcaccttggcctcccaaagtgctgggattagaggtgtgagccactagttttatttttatttccattttactgacaagaaaatggagacacagaggatttaagtagcctgactgtgatcacagctaacaaatggcagagccaagattcaaactctagttctagagagcattatcattaacccattttctccaggcccgggattctgggtctgatgttctgggtcacctcctatatgcagtcatgcttcaccctatcccagaggctaaatattcatgtcatctctgtgtctgaccttgtaactccctgattgggacccaggctgaactactcagcagtgaaactcttatgaaacaccaggggtttggtctaggtcctgctgcttacctaacaggaagccaatcactgagacaacaagtattgccggggaagaaagctttattcaggtgctgcagccaaggagatgggagatcagtctcaaattcatctccctgtctgactaaaattagggggttatgtagcagggaagaaatgtaactatgtgtgagaaaacaggaattagggagaggtaagggaggggagttggtcaacaggaagcagggggtcaatgaggcatcatcatgggtgaggggtctgacaatttattgtttagatgcagtgatctggtgagtgtcagcttcttgatgctaactgggaggcctgatggtttcctgagaaaagaactcagataagtcaaatgtaaccatctcaagttttaagactggggcgatcagtttttatgtttttttttttcaaaagaaaccataaacattggctctatggaacaagtgagtcagtttaaaaacaactttattaacagagttgatgatgtattttttatttactaggaataaatgatcaattgatatattgttttcaaattttcaggactgggttctttcctcctctcctttttataaccgcaaaatatcctcacaaacaatgtaattaatataaattttatctcatactttttgagatacatttacttttctgtttatagcttgtcttagtttgattctatgcactgagctgaacaccatacctactaccattctgctggaatcccagttttattaagtgaatttgcaacacatgatatggaatcactgtccttcagcatgtgtcttcccaattttcataactgatgacataactttatagggttcgccagtagcattgttatgatttataccatatcacatttgtagtatattgcatagtataaacatatgctgtttatatacatagtatataagtagcacatagcatatactatatacatagtatataaatagtataaatatatagtatataaatagtataaatatatactatgtaattagtatataattatactggagtgtatatatatactataaatatatacatagtttatatttatacatagtacataaatggtgtatatacatagtatataaatagtgtacctagtatataaatagtataaatatatgctatttatatacatagtatataaatagtacaaatataaataagtttataaatatattttttaaacagaagtataaatatgtatactatattatacatagtgtaaatatatacaatatacttgctgctcagtggaaaataagaattatttgcttatacttaattaatacaaaatcttttctagagtaaaatcattataaattcccctttcttcagagccaaaggagaaaaataaattgtcttcaaatataagtgcatcactcattgcatgatccaccctttacagacctaaaggggcaatgtacgctctcctggagtatgtcaatgggaagttgagcatgaatagccctgcatttagtaaatcagaagttatttaactactcggaacctagatgttcctatgtgttagataggaatgaaaatacccatctttccaggtttactcacatttaaatatgatcgtgtaatgtacttagtacagtgcctggctgccttctagtgtcggcactcaataaggagtagttatcattggttcttcgtagactgccattgggaacttgagcaggtttggagaagtggccattagcaaagaaatcataatggaaagaggctaggaatatacacaaagccagcactgtcttatggggttgcctaaaatataggaaattatggaaaatggaggcaagaaaatctctattcttgacttagaacttgcttaacttgtctaatgcataatttacctaaggattcaaaagtgtgggttgcttaagaataagcagaaacggctgggcgtggtggctcacacctgtaatcccagcactttgggaggccgaggcaggttgatcacctgaggtcaggagttggagaccagcctggccaacatggtgaaatcctgtttctactaaaaatacaaaaattagccaggcgtggtggcgtgcacctgtaatcccagctactcagaaggctgaggcaggagaatcacttgaacccaggaggcagaggttgcagtaagccaagcccacaccactgcactccagcctaggtaactagagtgaaactccatctcaaaaaaaaaaaaaaaaagaataggtagaaacttgaaaagcaaggctatgttaccctttggacattttttgtttgtttgtttgccatttaagaggacgtaaaaggagatcattagacagaaagtttgtaagttttggaagtaaaattttagagcaaaaggaacctttgcaagcacttttgatatagatctgtcattccagagaatccatacataggcttccagaacatctaactaagccatagaccttggaggtatcaggggtcttgctgccctcttctgccttatagaatcaaataaattcatagagaaacagtaggggcattttttatttttgagacagggtctagctctgtcacccaggctacagcacagtggtgtgatcatggctcactgtaacctcctcctaccaagctcaagcaatcctcccacctcagcccccaagtagctgggactacaggtgcatgccaccacaccaggctaattttttaattttttgtagagatgggtttttccatgttgctcaggctgttcttgaactcttgggctcaagcaatctgcccaccttggcctcctaaagtactgggattatatgtgtgagccactgtgcccagccaggacattttatttttatcttatatatatttttttatttttattttttgagacagggtctcactgtgttgcccaggctggagtgcattggcatgatcacagctcactgcagccttgaacttctgaacccaagtaatcctcccacctcggtctcccaggtagctgggaccacaggcaagcaccatcactcctggctaattttttattttttgtagagacagggtctccctgtgttgcctaggctggacttgaactcctggcctccagcagtgctcccacctcagcctccctaagtactaagattacaggcatgagccaccatgcccggccagtgaggacattttaaagaaggaagcagaagaatcaactagactgattgccctctccaaaattaaatattgcaaaggcaggagttggataagcatttggtcatgaaagatgttaggatgccttagaatcttcgaaggctaaaaagcagcagcattaatgaagttgaatgtatgaaagcagatttcaggtgttgaagaggaagcagctatcaatgcagagattaaatagacgaagtcacaagaatctagcagtagtaattatgacttaatgaaattccagttaacgaagcaatgaggtagagaaggtaggagaaaacccatcaggatgaacaaagcgtggcttgaatagctgggtggccaataagaatgctgcaatgaagcgaagagcatggcagagggccaaggaggagaaaggacaaacagcagcttcaagccaggaaagctcaggcaggaaatgagaagcaaatttcaaaacacctcaagggaaacattctttaaatacatctgaaagaacaggacagggaaatgtcgtttctattaggtagaggagggagttggttttatttatttatttggagagggagttttgctcttgttgcccaggctggagtgcaatggcgcgatctcagctcactgtaacctctgcctcccgggttcaagcaattctcctgcctcagcctcctgagtagctgggattacaggcgcgtgccaccatgcccagctgatgttttgcatttttagtagagacggggtttcaccatgttggccaggctggtcttgcactcctaacctcaggtgatccacattccttggcctcccaaagtgctaggattacaggtgtgagtcacggcacgtgatatcagtagtcaggttgtctgttttcttttccatgcaaagcaaaacttctttgtttcaagagtctggtaatatttactggaagttgggagagtaagagaaatgaggagaagagctgacaaaaggccgttatagcagactttggattaaaatctgtagacacccatgtcctgcctatcaggggtactgaaatatttctttagaatgattgcctcatggaacacccagcgtagagagaatatagaactagaaaaggtgcgagatgtcatttgtatgtaacaggaggtgaagaatggccttgaaatgacaaatctgaaggcttttatgacctggaagaaaatttgggatgggttggggtagcaggtgtcatcacaacatcaatttggaaatggcttgtaagctgtaaggtagcaggtattagcaatgtggttttaaaaagagcaactcctgtcagactaatgcatcctctctcggtgacagagtagatggaggaaaagtgaaagatgtaacctagattgattttaggagagttgctaatgcgtatccataagtcacacctgtgggaccagaaagaaatgattactttttgctgtacagctcttggaggggctgcctcattggagcacatgtaaagtgtgtttaattaggaattaaatggtcatagtggactgggtaaagagggtcatattaagaaatgttctaaagtgatcattaatagatccagtgctcattcaaaatgttccataacctgcaagatggcaggaaacacagaaaatggccaggtcggtggcaggggtaggagggaaggaggaatttaggatcagaggttaaaatgattatgattatttagaggcacagtcagaaataatgtagtagaaggtcacgtgaaaggtagaagggcagggcagagtatgtactgttttgtgtgtgtgtgttattttttgagactaagtcttgctctgtcacccaggctggagcggggtggtgtgatctcggctcactgcaacctctgcctcccaggttcaagcaattctcctgcctcagtctcctccctagtagctgggattacaaacgcccaccaccacagccagctaatttttgtatttttagtaaaaacggggtctcgccatattggacaggctggtcttgaactcctgacctcaagtgatctgcccacctcagcctcccaaagtgctgggattacaggcatgagccaccacagggtacttactgttttatgggtaaggattatgatgatgaatggttgcctagaaggcctacatgctgagtttatctgggagtgacatttattcctcaaagcgtatctttttcataatttcaatttttatttgggattcagggggtatgtgtgcaggtttgttgcctgggcatatttcatgatgccaagatttgggtatgagatcccatcactcaggtagtgagctaaaagcagtataaaatgggtttctttcttagccctgtaagttggttctttcttgaccaactaccctctaaggagagttaagagaagatcttgtaggtataaagctaaaaatcaataggctggcctacaaggtcaagtaacaaagcacgttgttttaagctcagggtcttaggcttagtggagcagggatctggtctgatccctacaagtaaaagaatgattagagacattgaaaaagccataaagatggttaaaaggttggggaaaataaggcttccaggccaaacaaaacttgaattcagtgtggaaaaatgttgagagataagttattaatgttaagtatgcaaagaactcctaaaagcacatggatgtcagctgttctatatttcttttgctgaccaactaagagggcaaattcttaactgaatgaagcatttgccctacatcaacttggaatagatttaaaagaagagagtatgactattactaaacatggagataagttagtgggggagggtatgtgtctccttctaagagatctttaaaattatgagcaattgtggctggaggatacatacatgttatacatttataaaatatttgagtttggactcaaagtagaaaatgaagatgagcccttttgtctctttcaactatgcatcaagattagtattagttttggatgacttagtctattgcaagaaagttttcactaggggttgggcatggcggagcatgcctatagttccagctacttgggaggccaaggcaggaggattgcttaagcccaggatttcagatctaacctgggcaatatagtgagaccctgtgtcttagaaaagaaaaaaagatgaaggaaggaaggaaagatggaggggtggaggagggagggaaggatggaaggaaggaaggaaggaaggaaggaaggaaggaaggaaggaaggaacttacttgaattggcattttccttttcctatcacaactatgccttcagctttcttctaattaccatctaagtccttataataaggacttataaatccttacatctaagtgccttacagtagtgtatataaattcttactgtatttgctcacctaacagtcttcttggtgcctctcagctctgtgaatgaaccatgtctaccctgctcactcaccattgtaactctacttccaacagtgtttggcacatagtcataatatctgcaaaatgaatgatggatgttggaagaagtacagcacagaaggttgcaggcttagaaggttgtcatttatagaatgatttgtggaggctggaatatcactaagaagtatttcccgatctttttcatattgttgaagttgtactcctggaaatatgtgtcatttgaattaaagaacttcctctgtaagcatcttctttttaaatgcaaatggaatccacacaaaaactcatacatgaatgtttacagcatcactattaatagttgccaaaaagtagaaacaacccaaatgtccatcaactgatgagctaatacacacaatgagatctatctaaacaatgatactaatacatgctacaacatggagtaatcctaaaaacattacgctatgggaaaaaagccagccagaggaccacctgttacatgattccatgtatatgaaatgtcccaaataggcaaacccataaagatagagaaactacactagtggtttcttagagctggggaggttaggaggagatggggaataactgctaatgggcaaggagggtttttttttttttttgagacggagtcttgctctgtcacccaggctgggagtgcagtggcacaatctcagctcactgcaacctccgtctccctggttcaagcagttctcctgccttagcctccctagtagccgagattacaggcaggtaccaccacacccggctaatgggtatggagttttattatgggatgaaaaagatgatctaaaattatctgccatgatggcacgagcctgtgaatatgctaaaaaccactagattgtgtactttattttatttaattttatcttattttatttatttatttatttatttatttatttatttatttattggagatggagtctcgttctgtcgcccaggctggagtgcagtggcaagatcatagctcactgcaacctctgactcctgggctcaagcaatcctcctgcttcagcctctcaggtacctgggactacaggcatgtgccaccacacccagccactgtaaaaaaattttgtagacataagaggtctcctaatgttgcccaggctagtctcaaactcctgggctcaagcagtcctcccacctggaacttccaaggtactgggattataggcgtcagccactgcactcagttgaattgtgcacttgaaatgggtacatttggctgagcgcagtggctcaggccaggcacagtggctcacgcctgtaatcccagcactttgggaggccaaggcaggcaaatcacctgaggtcaggtgttcgagaccagcctggccaacatggtgaaaccctgtctctactaaaaatacaaacaattagctgggtgtagtggcaggtgcctgtaatcccagctactcaggagggtgaggcaggagaatctcgtgaacatggggaggtggaagttgcatgacccgagaccgggccattgcactccagcctgggcaacaagagcaaaaccccatctctaattaattaattacttacctaattaatttatggggcacttggcatcaaggagatttctctagcaagaaaaagagcacaaagaacacgtatggtagacaacacaaaattcaaaatttttcctactttttagttttgccttttgctaagtgtgcttaacaattacacttgagaaataccttttctacaacataagcactgtagagtgttgctgttttcccttagaatgtgtgcaaactcctcatcttgcactcagtatgttaggtctgaagtgtggatgtctgtgtgtgtcctgcccttcacgatgtgaacctgagcactatgatgccattctgttcagcattgtgtctgtgtttattatcccagaacccatggtaggaggaccacagatatttgctgagctatctatactttgatataaaggatataaagacctggggagattttctttcaagaaagagggcagactctattatgagcttaacagagttgcctgcttagaatatggttttttaaaaagttaatactcaaattattttcaacaacagtgccaagatcattccattgggaaaggaaaatcttttcaacaattgctgttgggaaaaccagatatccacatgcaaaaaaataaatctgaacgcttaccttatgccgtatacaaaaattaattcaaaatggatcaaacatctaaatataagagctaaaactataaaatgcttggaagaaaatgcagggcaaaagtttcatgacattgaatttggcaatgattttatagatatgacaacaaaacacaggcgacaaaagaaaaaatagataaattggacctcatcaaaatttaaaacttttatgcgtcaaaggacactaacaacagtgtgaaaaggcaactcacactgtgagattaaatatttgcaaatcgtacacctgataagggatttacattcagaaggtatttttaaactcctttaattcaactgtaacaagtttttaaaacccaatttaaaaattaggtctaagacttgaatagatatttctccaaagatgtacaaatgtccattaagcacatgaaaagatggttaatatcactagccattagagaaatgcaaatgcaaactacagttagatacatatcacaccccatcctaatgagtatgaaggagtatctcattgtagccctgaaagggttctgggaagttgatgctgtgcccacattatgtcttctgtgagctatggcttatattgggttggtctgcccatgcgcatcacacttcatgagaatatgacagatcgcattttcttaatctgcagacttaaatgtttttttgtttgctttgtttttgttttgtgtggtttttttcttttcttttcttttcttttcttttcttttcttttcttttcttttcttttcttttcttttttttttttgagacgagtctcatactgtcgcccaggctggagtacagtggcgcaatctccactcactgcaaactctgcctcctgggttcaagtgattttcctgcctcagcctcctgagtagctgggattacaggtgcctgccaccatgcccggctaattttttgtatttttagtagagacaaggtttcactatgttggccaggcaggtcttgaactcctgactgcgtgatctacccgccttggcctcccaaaatgctgggattccaggcatgagccaccgcgcccggcccgtaaacatttttatgtttgcctttctcctagtcattttgccagtttcagcagtacatgggacattgtaatctctcaaagtgttttctaaatttaacttgaatctgtaatctagaaagcaaccaacaaatggccaatgcagcatgagtctcaatgtcccaccagcctcactcaattccccttgaatctttttgtcaccagaagttctgagtagtttatgtcccaatgtggatgattttctaggttctgccaatgcagaggattattctaggttatacaggttattctaaagaggcccgagacagctatccttttctgagtcctaaggttgaacccatacatatatctatgcaggtgcatcctctggtgtctgaagtgcagcttcttaacatcccattatgggggatcagaatcttaagcaatcttcttagccctagacccccagtcctgaaggttgatatgcaagtggcctgaaaaaaaatgacattggctgccccttgcttctgaaggacttacagatactctctaagtcctatagcatgtgcacaagtcagaaagcacctcatgaaattattcatgcattcaagctggactgaatttaatccttcaaagagagacagctgtcaacttcttaagaagctgagcatgttttacagttttgaccttgatactcaagaaatgtctgtgtctgacctaaaacttgtttgaaataggttttcttttcacataatgtaaacgtatttgctttttcctcattctagaagcaaaacatgttccttttcaaatattgtcaatttgaggcattttaagattatttcctttatttgttttttttgtgggctaggaaatctagacagaattgattattattatatggataacttttaagaaagaataatttcatcttaacagaatcatgttgaaactatcttatagaaggatatatagaaaaatataaaccaagattcatttcagaaataaattccatttacatggagaaggaaaatttcgagtcaaagtgacttacattgaaatcctggtttatgcatgaactagcaagtttttgaagcttgatttcctgatctgtaaaactgaagattccatatttttctcagtgttactatgtggattgaataaaatattacatgtgaaagaacctgataggtttctggtatacatagtagctcccccaaaaatgatctcccccgttctcacactattttccttatctctaattaacctcgttttgttttttaaatatccctttttggatgtctctttagtagcacagaaaatatgtttctattgggttgtaatcattacaattcagtcattgagtatatacatatatttcccttttgggcattgtcacccaatttttggctattcaaatagatcttcattaatagttcattagttattacttaatttcaatataaagaaaattatacttctgagtggaaggaaatcccatgtcacctcttgtaaagaatttactttcttagtatcaaagtaacatgtttgaagctcagaatcaatattacatggacctattgaattactaggttcagaagccagtaagttcaagggtgaggtgataatcaggaattttggtgtttgtcaaatatccactgtgagccaggaactagagcaggtgttgtacgtgtgtttccacacttaatttcacaactctctattaggtatcattatcactgttttacaagagaggaaataagggctgcagaggttggttaactcaatgaggatagcacattaagaaagttctgggccaatgttgcacccaggtctctctgagacttttattattatccaccatttaattgcatttagggaccatgattatgaggagacatcttttacaatgaagaactttagtgtccccccaaagccaatgttagtctgtctcccaaaacagattctccccttttctttgactctgtcttctctcctactcttccttgcttgtcagaataacaggttcattgttgagagtgggttagtaaatacagcgaattccaaggatttagagtgttgcgaagtcaggaaagaagacctgctgcaggctgtgtggttctgtggggaaggaaaaggatgtctaaccatccaactgggacctgatctcttggccatttgggactgggtaggagaatggctagactgacagccctgtgatttggcccttttcctttggaggggtgtgaatctgatgctgtaacaatttctgccttctgttggtggtatggcttggccgtgtccccacccaaatctcattttgaattgtagctcccacagttcccatgtgtcgtgggaagaacccggtgtgagataattgaatcatgggggcagcttctcccatacagttctcctagtagtgaataggtctcacgagatctgatggtctgataaagggttaaccctttcacttgcctctccttctctcttgcctgctgccacgtaagccatgcctttcaccttccaccatgattgtgaggcctccccaaccacttggaagtatgagtccattaaacctttttttctttagaaattacccagtcttggtatgtctttatcagcagcgtgaaaacaaactaatacagccggttaatatccctgcagttccctccacccgcatctcttccctccacccacatctcttccctccctcctctgtagcatccatcacaggactaaagccagacaaggctccgctggcacaagcagagcaattcattgtgaagtttactcctgagagttttcttctgctttaaactgccacagaaagaaccgtctagacagctacctcatgtaattgactgccccacgtttaatagaatgatcttttcttctgagatgtcaacctcataaggaatcataaagttcacttggaaattattttcaagtgagcagaaatgcctcagcatttgatccagttttctagtggatgggaatattctttgaatgtgtgtgagcacgtgcacgcttgtaaatgtgtctgacacatgttatgcgccgatagttctccgtcatgtaatcctgagaaatgcgaattttttctctctgattgctttgctttccttccctatagatactgtgttgtactcaataggctgccaagtccatatggattagatctgcttgttatccttttacttctcctgtcaaaataaccatcacagtgcaaaaggaaaaccaagaaatgcattctccccgggctgaagttggactcagtgcccagcttgcaaatgaactcttcttattttctttctttctagaggcattccacagtggtatatgataggattcccttttccatgtcttctatgtacaggcaaagtcgtgattaaatccttcattgggatggaaatcagtaggtcagttggaagattgtcaagccaagatgattctttctcttccggtcctaaaaaaaaaaagacctcatgaattgtttttatttaaattggatgttttgttaatctctatctggagttgaattctccttttgcctttcttttcattggagacttgatgttcatttcattatttctacttgtagatacgtatagtatctcctctatttgagcccaacattccttggaaaattttatgaagttgaatcagggaaacgaagtgtatttccttttatactctgcgtcatagccaaagactcctttaatacttactttaatgaactgaggttgtaatttagatttcttcagtgtagcttttagagcaaagagcatgaaactggttttcaggagatctagaatttcccactggctttccaactgctaactaatagccttagacaagccattgaacttttattagttccaatctcttaaatgtaggagttgaagtgggtggtttcaaagattcctttcagcttccaaattctggaactctggaaaaaaaaaaaagatagccacatagacttggaatatcgtcatgtgttcctaaagtatcatcttttataataattgatgttgtttgaaaagagtgttgatatacagatcttggacaaataattaaaatttaaggaagtctaccagactgtccttgctagcatgaaattatgcctgaaggcatagcactgtggcctttgcagccagagggcttgttttagaagtacagtacactgtacacgtcctagtcactggggagctctgtgtacaaatacacacaaggccatggtcacagagagcaacagtcacaaacataaattcagatgtgtgaacaagacaattgagaaacaaatcattgtcatttaagcttaaacttttaaatcagagagacctacctcacatacttgtccaatttagtagaagactgtgacaacagagaaaatggcagctgacagcagaaacaggactgatttttttaattaaaaatttcaaattaaatgtaatatatgtacatggaaaaacttcatacgttaagctgtgcacacaatcacaaagttaaaagcttctaccttcaattctcaatcctcctttctaaaattaaccattgttattcattttttgttagatcctttcctcaaatggcatatgcatatcccagtagatagatgcatggcttatgtgaacatttataaaaattataataatctacagttactctgtatgtcgcttctccacttagtgatgcatcttcaaggtacttcacattagctcatgcagatacaactcaattttttttttttttttttttttttgaaacagagtctcactctgtcgcccaggctggagtacagtggcgcaatctcggctcactgcaacctccgcctcccaggttcaagcgatcctcctgcctcagcttccagagtagctgggactacagatgcatgccaccacatccggctgattttttatttttagtagagacagggtttcaccatcttggccaggctggtctcgaactcctaacctcggggatccgccgacctctgcctccaaaagtgctgggattacaggcgtgagccactgcacccggccgactcagtttttaatgattacattgtttaccatcatatgaattatcatttactaaatcagttccctatgctaatttaaatgattatttttctagtttctgtctttctctaactgcaactcctgcatttccatctttatccaatttcttacgaaggcaaagctgcactggatggtctgttcatatatctgggtatttttttccacaggataactttctaaaggtagaattgattgttcaaaatgtttacaaatcttaccagaaatgttagacctatttggatatatataatattctgcaacatataagaatgctagttgatagttgctatcctgtatattaactttttaaaagttttgctaacccaatgagtaaaaaaagctcattgttttgatttacatttttataatcattgacgttagagtatattttcctatattagttagtcaattttgtgtttgtgcgaagctccagtttgtgtttttacccatttttaattggatgatgaggtttttggggggtatttttagaccacttcataaattaaggaattaactttcacactttatgcaaatatttctccagttgttaaagtttgcatgtatttttcccatagaaatttaaaattttcatgcaatcaacctcagaaatctttcctctcatatttctgcctctggaattgtatttttagaaagaacttccctgtcctaatattacatattaagcattgtttgtgttctatactagtgctcttagagtttagcttccttacgttgtaatatttgatccttctacagtttattttgaggcaaggagtttgatagagatctagctttctttcttttgccaagtggctagtcaacagtaccactaccacgaactgaataattaatcttttcccttgttgatttgaaatgccactttgtgagatccaaatttctgcctgtgtttgggtctgtttctgaactctatgtttcattccattgagctgtttttccgtctccaattctacgatgtttgagtgactatatttttagttatgggccatgcagggggaagatttgcaaaattggttgctcagttcactgttttgaaactgcttaatgaagaggcctctttgtttccattttctctattaacaccagaattagtgttcacgatgacattgtatcatccaaaaagaattaattttgcccttataataagcttaacaagattgaatataaacaaaattttaaataaataagataatgttaaaaatagcatctagaaggatatttttaaatgtcttatctggaaatctcacttctgggacagcgttcaataaatctactgtacctactcacacacacatttgtagacaatcagacagaaaactgttcgtatttcttgcgctttgtcttttagaatgtggcacatcgaatagagttaccagttgccctgatctgactgatttcgtataaatgtctttgctttggcaacagttgagacctattccttctctgaggtaaatcttcttgcagagcaggaagttgaggttttggggtagagtccaagagtcagttctgaccttattattggggaatgtggaaacctaaagccttccatgagttaataatgtgcacagtgaaggatttttttccctcctgaactgattgggtattttctaaaagaggatgagcttttaataacaggaatgtaacttttaattttaaacagatctgtgcttaaacatggtcagggaatagcccctgctcaaaaatctccttatttgtacatgttattgttcaagggagagaccttcctatttatatggcgagaaaataaatgagatttctttctatctgtcttccatatgtttaatggtaggaatgtgtcttggatcttgaattaaaacagactgtggattcagttagttgatacaattaagaactgttcttatctcagaatcaactctgcagactatctcagagaatccaatatcaaccatccaggtggctaatccatcatcaactgaatgggcaatttggttgcttctgttcaattgaacaaagaggcataggcactcgttagttccacaccccagtcagagaagcaacatgggtgtgtgacaaaaggggtatatagtctgttctttggcttcagatatgaaaaagcttttttcaatccaactaattcaagacaccaagcatagtgatttcttcactgacagttagcattgaaaatgaacttcattttcctcctaacacacacaaaaaagggggtggtagaagccacggcagatcatggcagatggcacttagggacagctgtagtgcttggcttgagttcccctccgcatggagcacagagctgcccacttcgtaggaatacggcaatatttatctacgcataggagtcattccaaataaaaagggtaacagaaagaaattgcagcctactgctgtgagcctatccaaagggtatccatacatagcccaacatttgaggtaagggcatggtttaagatctcaaggaatcaaaacattatggaaacactaacgggaccattagaataaatgaatgaacctaagatcttcagtccgacttgattgagtgcagatccagtcccctttggagagagttgttaagataagacttaactgtgactaaatatacaggcaaggaattgcctctgcaacacaaataagaagcttagaataatttgccatttgaactttccttatatagttagatactttgtagagaaacctaggctaggagttggtgattttttttgggtgggggggtcgcttttttccccctttctcattttattcatttgactatcggcaactttacgattttttaaattgtagtaaaatacacataacgtaaaattaccatcttaaccattttaaagcgtacagttccgtggtgttaagtatattcacattgttatgcaaccaatcttcagaactttttcatcttgtaaaactgaaactctatccattcaacaacagctctccatccccgccatcctcccagcccctggcaaccaccattctactttctgtctctgtgagcttgactattctagacaactcgtttaggtaaaatcataaacctactgaaagtgtttgggtttttctatgtgactggtttatttcacttagcacaatgtcctcaaggttcacgtatgtggcagcatgtgtcagaatttcctttttaaggcttaataatattctggccgggcaccgtggctcacacctgtaatcccagcactttgggaggccgaggtgtgggcggatcaccaggtccggagatcgagaccatcctggctaacacagtgaaacactgtctctactaaaaaacaaaatacaaaaatatttgctgggcatggtggcgggcacctgcagtcccagctacttgggaggctgaggcaggagaatggcatgaacccaggaggcggagcttgcagtgagccgagatcgtgccactgcactccagcctgggggacagagcgagactccgtctcaaaaaataataataataatatttctttgtatgtctatacattttgtttattcattcatctgtcaaaggacatttggtattttgggttttgttggcccttttttttttttttttttttggaggcagagtcttgctctgtcaccaggctgaagtgcagtggtgtgatctcagctcactgcaacctccgcctcctgcattcaagcgattcttgtgcctcagcctcccaagtagctgggaccaccaggtgtgcaccaccacacccggctaatttttgtattttagtggagttggggttttgccatgttggccaggctggtctcgaactcctgacctcaagtgatcctcccaccttggcctcccaaagtgctgggacaacaggcatgagccactgcaaccagccaggttttgttggcttttaatcaagataatatgcaaacactacttttgtccatctgatgatgtctcaacaaagccattttagaatctgaagatacttcctcattaaattgttactattgttaataaccgagtgttggcttagtgagtgttaaggtatataagagtagtccaaataaatggcatagaaataaatgacagtgattaatcactcactagtctgatacctcatagcttccttacttcaagtttaggcaggtgcaggagtcatgaaaaaaagccaaaagataaaggtcgcaaccacttggtgaggaatgtttgctttcttgaaatgatagccctctacccagcaccatgaaaagtgtgtttttcgtggtcattttcaggcctctaagcttgaggtgtgggtttatattctgaaggatgcagtgcgtgatctttctcaccaaactctctcaaatactgcactggataaacactcagaggactggaaagtgggactggaaggagccattgagattttttttacatcctcttgtcctggagtactttccttcctctacactttccttacatttctcagagaaaaaaagaaaaactttgtcatttttgtattacaaacgtgccagctttgactacccttgacactaggtaagtgggagattaattgttgggattatacccatggaaaaagccataaggcttacatcacaagttttattttttttaatattttgttttcatagctggggattactctattggcattcagggagagagaatgaaaaaatatactaggataaaaaagggagtactaattaaaactacaaaagcaatgcaaacatacattaaaagatacaacaaattccatgccagtttcgtgaagaaatgctttgaggtttttttccccccagctttattgagtataattgacaaataaaaaatgcatatatttaaggtgtatgacctgacaatttcatatacaaatacattgtgaaatggttaccacaatcaaattcatgaatatatccatcaccacacatggttaccatcctttgagttttaaggtgaattaatggaatgcgtgtcattcatatgcatattcatatgcatgtcatttgcataccattccttgactcaagaaagttgctatatgagtgaaagataattattgatcatatgaacttaagatacaattattctcatctggccaggtgcagtggctcacgcctgtaatcccagcactttgggaggcagaggcaggtagatcacttgaggtcagaagtttgagaccagcctggccaacttggtgaaaccccattactgaaaatacaaaattagctgggcatggtggcacatgcttacttgggaggctgaggcagaatcgcttgaacctgggaggcagaagttgcagtgagccaagatcacaccactgcactctagcctgggtgacagagtgagaccctgtcacaaaaataaaataaaatgaaataattatcctacaagaattaccagtaagtatacttctaaaatagatcttactctagttcattccaatactcacataatacaactatatattaaatggtgaaaatatcattgcagataaattctaaatgaaaataaatcctaatatgtaatccattaggaaataaaattctaaatttaattctacaaattactttgtgattttgataaaatttacctaaagatacagggaagattttaaatttgtttaaaaatgggaagttagtaaaatcttgaggataaagaagaaatgtatacatatcaggcaagcccaccactgcatgttccatagaatcttacagataatggatctcaagaataagcaggctaaattttcacacccatcccccaagtagctgaatcattggggattttcttttggagaaatttagggccctagcaaagagtagatagcgttctgagcaagttactactcccaagggttggcccaagcattcaaaaacagctgggggctgggcacagtggctcctgactataatcccagagttttgggaagccaaggtaggaagatcatttgagaccaggagttcaagattagcctgggcaatatagtgagaatcccatttttctacaaagaaatttaaaattttgcctatagtttcagctagttgggaggctgaagtgggatcacttgagcccaggaggtaaggctgcaatgagccatgatcatgtcatgcctctgcaccccagccagggcaacagaataagaccctgtctcaaaaaaaaaaaaaaaaaaaaagagagattgagatctgagatctcatatttttgtagcaggttacactgagtgttaatggatgcatgatgttaacttactgattttgtttgtgaagaacatataacctggttatttgaaagaaaaaaccatgactaccagaatgaaccaatgtgtaatatagaaacaatccctctggctttgatcccctaacatctgtgtgtcctctggcaagatttttgagtacaggttggagaatgagcaaagcaaaggtatttgttggacaccaactaggcatcagacactgaagttattttagttactcctgaccacaactctgcataagctacagggtggttttcccattttacagacaagaagactgagcctcaatcaggccattgtttggcagacagtacatctaggacagcctgtttccaagcctgtgccctttgcaaaacaccttcttttgcctggccagcttgatggaggctcttataacctgaggctatggtgtgctggtgggattgtaaacattagaaagtacatgccaagaaccgaaagccattaaggaaaatgagtcactttctggatgcattgaacatctttagattatgagagcttcgtgaagaaataaagtacagaaatgatttttcttcttaaaaagaaaggaatatctctctggagtagagattgttggcaagttcatgtataatcatggtcagcagaaaagaaatctaagcagtaatgaaaagcttgtgtactcagaatgcctttaacccagtgagctgaagagcaggcctttgggggaatgacgttggatggaggtggagttgggacaggaatagaatcctggtcctggagggaaagacaggtaaaagaaagtgagaccattaaaagcaggcatgatgcatggttactcttcatccctgggtaaggtggtataaattgcttttgttttgcccccgtcccccaaatcatttttttaaagaaagagaagaaaatatttttgagggaactcattaccttttggcttgaggcatagaagcctcagaagctgaaagcaatgttatatttttatatgctgcagatgcttcctggttttaaaacagtgacctggctccccaacaattacagcatcaacattgagggagaacattcttgtgtatcgtgtaattccaggagcagatgtggggtagcctttacgaaattaggaggaggggaggcagtctggtttagatcgtgaactacccaaaggaaagttacttggcatgacttcgattgtgtgttaagataatttttattgtgttctagttctcagacaatatcatagataacctcttttgcctgggtgcattttgaaaggtctttgtgttgattatctgcttttgatgtgttttcatgatccgttcagactacccaagccataaaacatcagtaattaagaaaaactctccctgtggagaagaatcaagaagattctacttcttttatttaatttttaacatatctaaaggaatgcagtaaactctttttacccattagtaattgactttgaaacaggatatgcctttcctctggagtctacaagtaagtctcgagagaaacttcataaaacagattgatcctaaacttccctcctgcattcatgggagttagctgacaggaaatacacagtgcgaggaagtggtgagtgagagaaaaaaaaaaaacagctaactgataagatcttaattgcaagggtcgttttcatggtggatcatacctaataggtcatgtatttcaacagtttttttggaaaagtgattatgcatcttttttttttattattttctgaggcagagtctcattccgtcaccaaggttggagtgcaagtagtgtgatctcggcttactgcaacctccgcctcctgggttcaagcaattctcatgcctcagcctcccaagtagctggaattacaggcatgcgaccatacgcagagctaatttttgtatttttagtagagttggggtttccccatgttggacaggctggtctaaaactcctgacctcaagtgatccgcccacctcggcctcccaaagtgctgggattacaggtgcaagccaccatgcctggccagtgattatgcgtcttgtaaacgaatttttggggtctaacttttccaaaatttctatctggttttctttcttcccttctaagagtctgtatcttcttccctgccctgggctttattcttttctagagatcctggcagtcattatgaccatgccctttatggcacatccaaggtcagtgttcatgcgtgtcctccctcgttcattccctagtatgggtggatatagctgtgttacatgctgaatcctgctacccactgtgcaatggaggggtcagagtcttgtggaaggagagctggagagccagggagaatacaggacttttcttcaccttgggttgaggcagaactcatgaaaaacaatgaagcaaggaataatttcgttttgcacccgtttttttcgtttatggaccccatttcctgcatcttagcaaaatctctcctcaaaaaaatgttctagattagtagtagtaaattgatctatctgatggggctgctgttggatctctccgagccatgtttgaacttttaataatgaagtccacagtccctgcatagcttaccaagcaactgtggatttgcagggtgcggccagcaggttgctggagcgagatgggctcccagttcccctaacatcactctccaccctccacagtctatccacaagccaccaccctgctgctcacaggtctgaccctcccctgtggttgatgggcaggacaggactctacatatgccggtgtctgttaacacaatggggaacccaccagagatccctcacacaggatcacttttctggctgggctgtttttcctcatctttcatcagtgagtgttggccgtcagcgtggcactcttcacacccaagtgaagcctgcctttcccctctgccacattgcagtctctgctggggtggaaaagaggtcagcaaatgaactcacaatagtgctaagcattggattaagctttcaccattagtcttttcagctgacccaagaattgcattgtgaatggggaggtggggtgactcactgagtaatcctttaaagagtccattggaagccagtcttctttcaaatgtttcacatggaataatcgtgaatatttttgcatggatgtgcaattaattgcaaagtatgtatgtatactttaggtggaaacttaaaaaccttcctttgccattctcataaatgggcttgctgatctgcctattatagattatggtggccaaagcaccacccttctattaaaaagtataatctttttttttgttgttgttaaccaatcaaatgttccatctgtttagactccgctgtctgctctggattttagaacaatgcagtcaaggttattcttgctcagtaatcttgccttgaaaaagtgagttactgttcccagaggcaaaggcactgcttcttgatgacaggcaagtgggatttattagctttgtgaaggaggtgggagggcatcgtgatacttggtaaattatgagaggggctggggagaccatgtcaaaaagaaagggattccttgccagatgttcctaagagttgaattaccatggagaaaataatctgaaaatatgagtgacctcgactttgtcctaaacccccatggcttaaagtgcaagcgaaaggagggaatgtggctttataggggcttgcaggtagatggagggtgggtgggggtggtgtcaggtcagttccttatgggcttccctaagtcagtgctggagagcaaaaagagtgttgaggcctcccgagaacgctagaatgaccccacatccctctacatcagctttagacccacagcagcctcctaggtcttctaggtggaggctgagatagagatgttctatcctgaatatgttcagacaagccaggggcactcatataggtggtgcggtttcctgttttgcaaaggacaggagatagagccacccaagcagatgtcccagatgaaaatggctgtgaaacgacagtgtcaccttaatatccatttggacctcatttatgggaaaagccacctttcccacaccactatattttgtttgttacaatctctgtttgtccttctctttcaaacatatttctcattagatttattccatcgcatattttcagcttgtttctgtgaagttccgacaggaggggtgttccaggaagctccgcggtaccttttattttattttactttatttttgcccttctcctggaagagcacttggtaatcttcttaaatgctttttgaaagccttttaatgacatcactcagtgccccgctgatcactcatgaactgcagttgtacaccagctccaaaagttccatatttatgatgataaacaagagctgtaagatttctaattttgctgaggggctattttccctctctctcttgatgtgactcagtttttcagtgtagggccagaggctgtttgtgtactcagagacgatgttttcaactttttgctcttgatttttccaggcaattagcaaagtctttttagagtggaattgttatgagcatacattctattttaattcattgtaattagagggatgagcattacacttcttcaagaactcctagaagtcaatgttctgatttccaaagatcaaaatcttattttatgagcaaaaaatgtgactagatatgaaaaatgacaatcagtaatattcctccagctggcagagtgtatgaactccacttgtgatttcaaaatcatgctgcagagctgtagctgggttttctgatggtttctccacggattatcttcctcaaatacaatgttaaaaataataacttgtcactgtggccctcagtttggttgtgtttattataaagaagattgaacatatgaactgccaattgatgatggcccatgttcctggtctgtttaagtaacatcaagtcatctttgaatttaagaaatggtagcattctcttatttgattgctattagccctgaaatggaactgtccagaatagtatttgtgaaatggcagagttcccggacccccctcacaggacgtgagacaggggtgtggctagtctatctggccacctagtgagcactcaaaccccttacaggagggggagcatgcagatgggcaggtgcaggagccggggcaagtgcttttggactctggccccacagtagcatctaggggtgggtgcctgcaactctcaaagctgcagtgggcatgttaccatgctcttttagctctgccatctgcacacagcttaagtgttaaccagctcagtgccctcttggtatccaagtccttgtcctgcatccaggaagaatcaggtcacacagacaaactgaaggatggtaaatgcgggggattttattgcctcatcaaggtggctctcagcaggatggagtgggaagatgatcttcccctggagttcagccatcctgaagccaatctcctctctcaccattcctagccaaactcctctcagcattcagatgttccttctcttctctcctctgctcctctgctcttctgctcctctgctcttctgctcatggagcctggggcttggggtttatatgggtacaggatagggaggcatggcagaccaaaaggcaacatttgggcacaaaaacaggaatgcccgttcccatttagggccatgggtttccagacttgagggtggggcttttgccaaggaaccaccctcttctacccagtatttccctgcctcctgtccatgtcatttgtacaagaaaacatttttctcccagtaaagcttatcagttttcacagaataattgtcagcccctaaagtatttttggctgtctccagaggttagtaggtaagaagcttgaagatgaggccagagttcagcattgagctgtcccaggtgacacagactggtgagggcaggcaggttggctgaactcagtccctggagcttggggccagaggaggttgcagctgtgtaagcaggtgggcttcagcccctcaggatagcaagtctcacagccagggatgcagatgctaacatctgtcacattgtcttcagtggtttattatcttagtttcagctgctgcaaccaataccatcgacttgggggcttaaatgacagggatttatttctcatagttctggaggctagaagtccaagagcagggtgccagcatggtcaggttctggtgacaaccctctttctagttggtagacctctgtcttcttgctgtgtcctcatatggcagaaagaaagcatctgtctcatgtctctttttagaaggacactaatcccatcacaagggctctactcttgtgaccaaatcacaccccaaaggcctcacttccaaatactatcacattggagattagggcttcaacatgtaaatttggggttggggggcactcacattcagttcatggcacttgtgaactgaagccaagtgttgtaggtcttctgtcgccacagctgagcaggctgagatgagcatagcaagtcctcactcttttttttttttttttttttttttttttttttttttttgagacagagtctcactctgtctcccaggctggagtacagtggcccgatctcggctcactgcaacctccacctcccgggttcaagccattctcctgcttcagcctccccactagctgggactacaggtgtctgccaccacgcccggctaatttttgtatttttagtagagacgggatttcactatattggtcaggctggtctcaaactcctgactttgtgatccacccgcctcggcctcccaaagtgctgggattacaggcttaagccaccacacctggacagcaagtcctcattctttagcagcagaacattttagggtctcttctctttcttttgtgcataacttaagtttcttctccttaatgataacatcattgctttattatttttagagctttatagttaacagtgctttcaaccagtttgcttcatttgtgcttcctggagaccactgtgaagtaggtgggatgattattgccattctgcagatgcagaaattgagggtcatggtttagttgccccagtacaaagcctgatgctgggttaagtaatttattcaaagtaaaacagcatcgaatgctgaatctacatcttgaacccaggtccttctgaccgcaggtccttcccatgggtatttagagatttgcaaaaagcacttagagctcctgcccattagtctaggccttccttgataataaccttgtgggggagacctctagtgtggccaaggatgttaggaggttgccgtggtttcagtgtgtcccccaaagttcatgtgttagaaacttaatcccgaatgcaacagtgttgagagttgggacctataagaggtgactaggtcatgaggcacaacccacaggaatgaattaattctgttatcttggaagcacgttcctaagaaaagaataagtttgggccccctcctctgtcactcacacacatgctcccttgcccttccacaattccaccatgggatgacacagcaagaaggccctcgccagatgctggcatcttgatattggacttccagcatccagaaccatgaggaatgaatttattttctttataaattacccagactgtggtattctgttatagcaacatgatacggactaaaacagaggccatctgtgtctaaagcaacttaaagctaaaatttgccaaaaaggtttaatccaagtcttcattttaatgcataaggaaattaagggccagataaatgcctaagttacaatgagtttgaggcagggcctgggctaagaattggtctcagactctcagcccagtgctctccagatcattgagccttacctctccctcatagagtggcaagataagatgccccactcgtaccacggccagccattatggaaactttcagggtagaccttgtatgaaggccagcccctgcccactgtaggtagaggaagacaagacactcagaagcatccctcagctggctgcctgggcctggagtagtacgaatcaccttgctttggatgcaagctggtcagaatctgtgagtttctacactctgggcctgtttcctatggaagaaaagggagaatcagaagtgcattctggactagcttcaataaatcatcttatgtcttatcccacctcttttccctattaaaattcttacctttggccgggcccaagcttgagaaggccactcctaaagcaaggcccctttggactagggcctgggcaagagttaactggcacctgctatgccagcacaaagcttaattcccctgcagcagcacacccgcaggcagctattgaagcaaggatggaatgtcttacaatacaaagcctttgtaataatgagagggaaatagaaaccagaggtttgcaagctctttttttcttggggggttctgagtatttttgtttaacttaagtttcgtgttccaaggaaggggcgttttagtgaaaattgtgaagggaaaccctgccaaacagaaattccttataggatgagtattttcctcctttcaaggtgtgagagcgaccaagaagcaataacgcataggggagtcggggtgatagattggaatgctcttggctggagtgtgattggtgtctggaagtgagtcccagcaggttggctggtgaggccatgtgagcattgggcctgttccagggctgtgaagtgtgcaggcttgcttgaggctgtaggcaccactgcctgagccatgcacgtaaactccccagaccctaagagtagtttactgtcagggggtaagcccccaaatcaagcaagctgcacagagccaagactcccaagaaccaatgccttcttccagcctttcattcattcattctgtaagtgaaaactcagcgtggatgtggatgaagatattcatgcctttgtgatcattacatttcagtgtgtgggtgcaaggggaaggagacagataagaagtgagcaaataagtaaagtatctagtgtgtctaggggttttaaatgttatggaggcaaaaataagcagagttctcaaggaactggtcatcccgatgtccatgggctgcacttggttggggcagttctaagagtatctgtcacacttgcagagacgacctgggtcaactcttcccaggcactttgtagaacaccgggcagggatacttcaatttcactctttgttaactgggaatgtggaggcttaggaaagaactctgagatttgtgaatgtgataccagtcctcctatagttaaccaatgtgtttgttcattctcatacactcttgcatttgtatgagaatattaactatttcaaagctctcataaatctattgcatcattttagtcttatatcaaagtaggaagggtggatattgagacacaaaattgaagatcaatgactgtgctgtggcatgggttgtccagtcaggacagtggccatacacagtggttggccatagtgaaaactggctgaatagtcaccctgtatatgacaggtttgctttgcaatttgttttttgtttgtttattttttgcattgcaatggcaaggtcatagaaataatcttgtcacccttcaaactcactactttgaaagccagcactccattgtatgcatatatatacacatacacacacaaagtgtacttgttttgtttttttaaaaatcagtctccttactttgacccatgagaacaggagcacacaggagttcagacatatccattggccacatagtacctgagatctgtgaatgagatcacagtcgtcctatagttagccaatgtgtttgttcattctaatactttctttctttcttttttcttttcttttctttctttctttctttttttttttttttttgtttttttgagatagagtctcactctgtcacccaggctggagtgcagtggtgctatcttggctcactgcaacctccacctcctaagctcaagtgattctcgtgcctcagcctcccaagtagctgggactacaggcgtgtgccacaaaacccaattaattttttgtgtgttttttgtaaatacggagtctcagcatgttggccaggctggtctccaactcctggcctcaagtgatctgcccgcctcggcctcccaaagtgtcgggattacaggcatgagccaccatgcctgacttagctttcatttgatgagaatattaattatttcaaattgctcataaatctgcattactgtatgtcagatattggctttagcatttttctcaagttatttcatacaacaaagtataatataaacatcattattactatgtcatgaatgaagaaagtgtacatgaaacatgcctaaggtaatatgcccaaagtctcacagatagtaagtgttgaaaatgaagcttacgcccagttctttctctttccagaaattatactttcaaccactatcctatattcactataggattactttagattctaagattccttaggaaattagaaattcttagaattagaagctgttgggatatcaccctgaactcttttttgttaaatgttgctgctttttagtttatttacccttgaaggtctttgaggctttatattttattattgttatatcaactataattcttagtgtgacttataaagtctcacaaggctacgtaattttattccatctttaagtattttaaacagttagaaaaggaattatattacaattagatttctcaatttagtagctctttttttttaacccaaataatcagaaattactttgctcccccagttactgacagactgtgtatctttaggatataattacttttttttttttttttttttttttgagacagactcttactctgtcgcccaggccggagtacagtggcacaatctgggatcactgcaacctctacctcccgggttcaagcgattcttgtgcctcagcttcccgagtagctgggattacaggcacacgccaccatacccggctaattctttgtacttttagtagagatggggtttcaccatgttggccaggctggtcttgaactcctgacctcaagtgatccacccacctttgcctcccaaagtgctgggatcctgtcacgcccggccaagatagaattactttcaagactatttcccaacgtttggtcttgttatattctttagttttgtgtcatgaggctactaattttttattcctcagtggtaactttatgaaatctcttagacttgcagcaatcaagcctctcccttctatcgtgggctttaactatgcaagcagtcagcccattacagttttttcacagactggttacattcagcccgagtttgaaccagggccatttgggggcatttggagaggatgaagatggaccaaaagcaatcagttgacctgtgtcttgtttcctcttgaatttgggatttcagctgcctcctttgattatgctggagactgtatcatactcgctaggttcagggcacccccttgtggtgcaactcgaaacgtaatcaacgtgaggaaacagaatgatggccaaatgacgaggaatgaagaggccacgcatgtagatatgattttattgttcttcccatttttaaaactctcaaatcaaatctcctgtttttctcctgttgtttcaaatttatcagtagttatttcaatgctaagtggttttttttttttggaggtagaaacaaatcagaaaagcaagcacaaataatttaatgctacatctcgggagtttttaaaaaaattttattacaaaagtaaccatggatattctaggaatgttagaaataatagactaagagtaggagaattatttacaatcccatgacccacatagaatacttgtgttaatattttggtgtatatccttctcctatttttttctaggcacatagactcaaaggaaagaaaccacatgccacaagcacatgccatttttttttcttatttatgttattttattttttgagacagggtctaacactgtcaccccgggctggagtgtagtggcgcaatcacaggtcactgaagcctcaacctactcaggctcaggtaatcctcccacctcagcctcccaagtagttggtactgcaggcagacgccaccatgcctggcgaatttttgtattatttgtagagatgaggttgcaacatgttgcgcaggctggccttgagctcctaggctcaagcgatcttcccaccttggcctcccaaagtgctgaatttacaggtgtgagccacagtgcccagcccattgttttctaatatgattttatccacttaattatatgtgtgaacttctttccctcctgttacatgatagctacttcatcattgcatgtggttgcctggttttgttggttccactgtgtgtgggcaaataccatatcatgcagggcctccttgtagataactgtagattattttcttgggttctttattagaaatagaatggctgggccaggggcgatggctcacgcctgtaatcccagccctttgggaggccgaggcgggaagatcacgaggtcaggagatcgagaccatccgggctaacatggtgaaaccccgtctctactaaaaatacaaaaaattagccaggcgtggtggcgggcgcctgtagtcccagctactcggaaggctgaggcaggagaatggcgtgaaccagggaggcggagcttgcaggttcgggccactgcaagatcgggccactgcactccagcctgggcgacacagcgagactctgtctcaaaaaaaaaaaaaaaaaaaaaagaaagaaagaaaaagaaatagaatggctgtatcaaaaagatatgcaaaattgtcttcttgttcatttgttaaaatagagcatctttttgagaatgcaattttttttaaatctgcaagttcctaacatttgcatccttagtctgtgttaggaattgtgtacagtgtttcacatgcctggatctcacttcatcctcccagcaacctattatgatccattgccacaccaacttgctgatgaggaaagtggggcttaaggaaattaaagagctgttgtgggacttccaaagcagaagacagtaggctttcagaaatttgataaaaatagcactttgcatttcttgaatcttgagctaaatggaaattaatactaaacattctccactggtaaaatagagaataaggatattaacagtaaaagaaaagaagaagaaaaggaaatgtgcttccacagatttagaaacataagtaacaatctaagttaaggctttggcgattagatcttcatgttggaagatatgctggatggctcagtgatttgctgtgcaattacaaacccgagacaatttgtaatacaaagagcttttcatgagatcttacatttttttatgaatatattttcgtttaccatggttagtctcctaactggttaaattgcttccagagagtcaaaatttgactctatgtaaagtgacatcagaaagtctctaatttctgggccgggcgcggtggctcacgcctataatcccagcactttgagaggccagggtaggcagatcacttgaggcccggagttcgataccagcctggccagcatggcaaaaccctatctctactaaaaatacaaaaattagccaggcagaggttacagtgagctgagatcatgccactgcactccagcctgggtgacagagtgaaactgtctcaaatttaattaaaaaaaaagaagaagaagaaaagaaaatctttaatttgtgaacaaaagtggaactttgggtgagtgcttaaattttagcagcctccagagtttcctgatgttactccctagagatcaacaattcactttttccctcctttactgatacttttctttgtgccttgttatagaattatatttattatagaaaaccctgaaatagacatagcaaaagaaataaaataaatatcgcttgtcattcagaccgtttgaagtactgtacgtgtgtcattcatttctggttctctccactacatttgctcattgtgtggttacccaatatttattattcttgagcaattcttctcagactcatcagcattaggaaagaaactctgaacccctttcccttcctgccacatttagcctttcaaagagatctcaagtgccatttagtacaacaacaatgtctgaagtttctttttgccattttcttatgatagctgatgaatttattaggagtctctgaaataataaatgctcttctgtttaatttttacagtattattatttttgccattccttgaggtagttgagtcttcctgttttctcagtaacattcctttagttttttgtgggttttgtttttgtttttttttttttttgaaacagggtcttactctgttgaccgagctggagtgcagcgtgcagtggcacaatctcagttcactgcaccctccacctcctgggctcaagcagtcctcccaccttagcctcccaagtagctgagacttcaggcgtgtgccactatgcccagctaatttttgtattttttgtagagatggagtctcattgtgttgcccaagctggttttgcacacctgacctcaagcactcagcccaccttagcctcccaaaatgctaggattacaggcatgggccaccgcaccaggcccattcttttaatcttgatctaacctctttatatgtgataaactactgattatcattagcatagataatccagaagttcactgaaaacactcaactctggtctcatccactttttttttttttttgagacagtgttttgctcttgtcgcccaggctagggtgcaatggcgcagtcttggctcgccgcaacctccgcctcccaggttcaagtcattcttctgcctcagcctcctgagtagctgagattacaggcgcccaccaccacgcccagctaatttttgtatttttagtaaagatggggttttgccatgttggccaggctggtctcgaactcctgagctcaggtgatccacccgcctcagcctcccaaagtgctgggattacaggcgtgagccaccgcacccagccacccgctcttattttttaagaacaattttctatcgtatagtcaaagccgtaaatcaagcttgtaaatgctccacgttgatttagcaggtatatgtgagaggcctaataaaatccagttttcttttttattgctcttattgttgggctcaaaactttccacacagatggaacctactgagaagcgaaaaaaggttctcagtgaggttcattttgtaatcctgagaaaacttatgtgtgattataggatcctgaggcctaaagttcgtgagcttattccattgcatcttctgagaagggcttcctacgtctccagcatcccggggccttccctgctctgatggtgggagattcttccagcttctaggtttccgtgaccttagttagcaaaggcaggaaaagatgtaacaggtagactaggggtttgctccacagttcggaggctttgagcaattgtgtgtttctcttgcctgcctgccttccttcctttctttctttcttttttcttcctttcttttttttttgttttgttttgacagtgtttctctctgttgcccaagctggagtacgttggtgtgatcatagctcactgtactcactgcaccctcgacctcctgaggtcaagcagtcctcccccctcagccccctcggtagctaggactacaggcacttgtcaccacaccaagctaaattttttctttcatcttttgtggtaatgggagtctccctatgttggccaggctggtcttgaactcctggcctcaagcgatcctcctgtctcagcctcccaaagtgctggggttacaggagtgagccacctcacccatcctcccctactttcttgactttcagatgatatttgtctaaagcaatggctgtagcgactttccttgcccccgtttctccatatttcattttctttgttgtaagttcctctgatgagggtcacctagcagagagtggttgaggtctctttgtccctcctggcagactcactgggactccggtctcttccattaccactttccattcctggtcctctctgaagggctgtggttgtcctggttctcctcccgcagccggtgttacttatcatcgctctgtgattttctgtgctttttttttgtcccccttttccctgtccatagcagctcttcaaatctatcatcctgtttttatcttacacttttatttaccatgcatctgcagggctttattatttgtggtctacttcagggtatttctttcacagttgatgaagcctgtaaacttcagagcagagaatcagagggccctaagcaaccctcacctttctggtgagaatatattcacctagaaaagggcttttatgaggtcactttagctaattgtttttctaatagtgtcactccctttttctcttcaaggtctcttcaagttcttttatttatttatttatttttttaacccctatgtgcatcttgggtagaatattttagtacagtttttgtctggagacctgttgtttggctttttggctttcgagtgtagccatctgtgttcaagtgttctttttcttctagtggaaatttgtgtctgatgtgtgggactaagttctaagtaatatacacacatatatataatctatacacaatggtgatatggatcatggatattgtataattcaatcatgacggtacttagaggctcctatatgttactagtccttatggatatgtgtatatgcgtgtgcagtaagatatgcagctatggcaccccactggcagatattgggcacaagaggaagtcactcttcttgcatgaggattatagaaattttcattttttaagtcacaaaaaaatatttcactgccatgtttttttaaaaagttaagttgctcaaaaatgagtcggatgcagtggctcacaaatgtaattccagcactttgggaggccgaagcaggcagatcacttgaggttaggagtttgagaccagcctggccaacatggttaaaccccatctctactaaatatacaaaaattagccagctttggtggtgggcgcctgtaatcccagctactccggaggctgaggcaggagaatcgctttaactcgggaagcagagggtgcggtgagctgagatcacgccactgcactccagcctgggcgacaaagtgagattctgtgtcaaaaactaaaaataaaaataaaaataaagtcagtggcatcaatgagaattaaaatatttaaatgcttgcacagtaagcattgtaaaccaaaggcacactccagggtccaccaggttcaaatattagaatttgtgccctgaattacagtgtggatcttctgttcctgcatgtattcaccttgggtgtgccctcctgcatggcaaagcatgggcagagagcactgcactcacaggcctgctttcgtggagcaatctagtggccagtgagcccggggccagtgacaatcaagatggcagcctcagactgcattctggctaagaaagctatttcatttgggttgggcaggctctagtaagttccctgcagctctgggacaacctcagggatggtggattaatatgacacattctccaatgatacaaggtgaattcagaagcgcctatggcagggtattttggggcaaacccattgctagttaaggcttcaacatgtctttctaaaatataaggatggaactgtcatcatttttctttcttttcggggaagaggagttaaccgtgctacattttcatcatgaataaataggtggtccatttggtcaacctattctttttctcttcatgttttcaccccttttctttcctatttttttcttgttttctcctggtccacaggctttgaagggcatgctgatctctcttcaggcagaacttgacattcaaaggtacttgatgaaaattgaatcgtctcagcgagttagtactctacctgttctttttctgcatcgagttgcaccctcatcctgcacctttccctcacctgcaagtgccattctaatcagtgtcagccactaacgcctgcacttttcgctgtttaccccaatccctgattcaaaactatcagagccaagtgcttgtagcattctgaaatatgtgcatttctaaaaattatgagagtcagtattaaaatgaacactaattgcatgcttgcttcgaaatatttaatttgctttccacagattggattgtggaatcagcagtaatgcaaccacaagctggagatctttgaataattgtttgaaaagtgggcatctctaagcagagatcctatccttgccagcttgctccagcagaatactcatggcagtaaaacagaagcctgaatcattctgacaatcccaaagctatgtcattctgctttgctcagttccaatgtgtccaatgttgggtccagatcattttacttatatacattttaataatgatcataatggaaataaacacatttctttagaacttatatacaccaggcactgttctaagtgccttacaagtattaacttctcacagcaaccctgtgggggaggtatactatgatccccattttacaaatgaggtgattgaggcacagagaagttaagtaacttgcccaaggtcacacagctaggtaatggttgtgcttaggaaatgttcggccatctggctttgtacaaaagtgacctccttcccattggtcagtcttcagtgaccatgcttatctctttaccttccccttcttaataatcagtctcattgatctctttttagggtaacaagctcaatttagaaagttcctgcccagacaaataaacattaaagttcaagtttagacactaaagagaattttcatgtcacacatcatcccaattctgatgagtgtttatccttaattttattcttaatcattttcacattcctaaaattcatgcaaaatagaggcatctttattatttccgtgcgcatgtattgtgcactaagttaaaatgcagaaagggaaaagaagggcatagtgagctcttccctacaacttcacaccctgccattaacctttattcctactttcagaatagagatttgacattgcccagtgggattttcccatcataagtagtactgagtttgggattccctcccgctattctttttttcttctgcttgaaacaaataaatcttcagtactgactttccttttctttctttttttttccatatcagcaaataattggatatctgaaatttttcttgaagtgcttttttggcatttacaagcattttaaattataatgctgtttttcagagatggaataggatgaaggttaaggttggaaatcgaaggtgatcttccccctttagtgaatgagtaactctcagatcctctccagatgtcaaattctgttttgaaattggatgtaactatttacctatctcacaagaccaagatgaaggcatggtggatccattaaaggtttgtttgtacccttctcctctcacataggatcccagaagctacgggacttcccaagaacagtaggaagctgagccatctagaatcaccctactgagagtaacaccagcttactacctaaggaaagctaaatggttggcatcttttataatttaccaattgctgtcccatgcaacatttttccaattacttctcactttatcaagtagatattctgattattttataaaagtgagaaccgaggttcagaaaggtttcatatggagttgcaccgtgagttcatggcaggattggagtctgcttttcataaaataacctgataaaaacagtaagttctctcattataaattttgtcttctgtccatctcttcaaacactggtatactttcctagagcaggactagaggaaaatcagaatctttggtgcagaaagctagttagaactttcactatgtgtgtgtgtgtgtgtgtgtgtgtgtgtgtgtgtgtgttttcatttgaaaatcattccagtgaaattgggcaggtggtagtggtggttgttttggactggcgggagggggaatgtgtttgaaattaacagtgaacgctattcccaggatgtatggggagggtctggccataagctctgagccttggtgaccccaggaacccacaagagtccctcttgcccagttccctgtggccttctccactgtggggtgatgaggacatcataagctctcccatggcacagcccataccctcactgagggtgagggcctttgctagcaaggaaagcctctttggtttggcaacaatgcaattaagttttaggggtacgattccgtggcttgggatcccacatcctctccataaagcactgaagcctaggttgcagagatgagcttaaaaatggcttttgttaagaaggccttctaagatgtgtacttagcaccatgttttgctggttgtattttacttgagacttcaaaggctacaagcaggtttctttccttttatcagtataataacagcaatcctcacacagacaccttttatcctatagccttttaaagtgcattcctgactttctgaattacaaaagcatctgcagtcttgctcagacctcaaccaatgaggattttggcagccaaagcctgttcaacattttacttgttgataaggcattacttttcttgtttcagaaagaaaggagagaaagaataaattaattgttgtattcaaggcaacttgcaataaaaagacatctacctggccgggcgcggcggctcacgcctgtaatcccagcactttgggaggccgaggcaggtagatcacgaggtcaggagatcgagaccatcctggctaacacggtgaaaccccatctctactacaaatataaaaacttagccaggcgtgatggcgggcgcctgtagtcccagctactcgggaggctgaggcaggagaatggtgtgaacccgggaggcggagcctgcagtgagccaagatcacgccactgcactccagcctgggcaacagagcgagactctgtctcaaaaaaaaaaaaaaaaaaaaagacatctaccctaaggtagatacactgaaaatcaaaaagcaaaatctcgtaagaagaggaagcaaattttaaaatataggtactatgattagcttggacattaaatttactttcaagcttcctgacatacatgatattttacatatgacaaggtaatacttattaatccttcaggaagcaaaatcatattctttgtttcaaattgtgaaagaaacattgttcgtgcctttataaaaggtacactgatcagcatagtaggcaggaccaacaagtaaacagcagtattcttcatgtggcttttgtttttttagagacaggatcttgctgtgtgacccaggctggagtacagtggcatgatcactgcatagctcactgcagccttgaactgccaggttcaagggatcctcccacctcagcctcacgagtagctgggactacaggtgtgcaccacgactcctggctaattttcatgttggttttttgtagagatgggacgttgccgaggttggtctcaaactcctggcttcatttatcctcctgcctcagcctctcaaagtgctgcaattataggtgtaagccaccacacctagtccaggcttttaattttgtatcggcaaaacgaaaagaagaaaacacatcactgaataaaaattgcatgaacgtatttctgaaaggggtgaaagtctgagttaatgagatccagacttggaacttaccgatgatctaattttctaacttggtagaaggatgctaaatggagatcatagttgagctaggctttattttctttaaatagcttttgtctcattctggctttggggaggagtcagagagcagtcaatctgaggtggtatttcagtagagtttatgtcatgttacaggtaggccacaaggcagacaggtggcaggttgatgtctaatcctggagttgaaaaggccaccctgccttctgatctgataagaacccctgtctcctctgcaaggcaacagatttagcagctcctctaggtggaaccaaacctcttcaagggaaaaaaaagaatactgtatcatctacaaactatgaagggttgaaaggtggaaaatatctctgggatcatagaaaattgctaaaattccaaatttacctagaatcaaattttaagagcctttaaattaaattactataatggtatcagaactacagatgtggaagtctgtctctttaaaaggtggaatgcaatctgcatgtctgaaattgatttgatggccttggcgcttttcttaactgtatcgttttgtagaattggaagttttgtaagaactggattcttgccaaatattgcatggcatgaaaatgaaaacgtgtttcccttcccatgttttccccatgcatttgtgttgtcatttcaggggccatctctaatgacaagttcttaaacctagaatccaatcatacagaatacacaagagaagacaggaattgggcatgaatacattcaggtcaccatagacaggaatccttctggattctaaatgttttatgggaaagttcccttcctctgatctattctttaaaaatatcatgcctatttagtaattctctgatttgtaaaaacaacatattcttattttggagaaataaagaaagtgtgtcactcttatcctaagcaatctaatgcagaacagaaaacccaatgcagcatgttcttacttaataagtgagagctaaacattgggtacacatgggtataaagatggcaataatagacactggggactcctggagtggggaggcaggaggagagcaagggttgaaaacccattgaatactacgcttgttacaaaaacaccgggggtttggtcgaggttctgctgctcaccaaacagaaaaccaatcactgagacaagtattgccaaggaagaaggctttgatcgggtgctgcagccaaggagacagaagctcagtctcaactccatctccttgactgactagaactaggggtttatatagcaggaaagaaacgttaagaacacataagaaaacaacaactgagaaggcgcaaggaaacaatcatgatgaatgaggggtgtggcatctggtgtggtgatctggtgcgtttcagttctttgatacttttttgagagtcctaaaggtgtttcctgaggaaggaactcagataaaacaaatactggtttccagctttgagaccagaacaatttcttgttcagtttatcaaaaaaaataatctatgggactgttgggtcagtttcatgctcactgcctgggtgacgggatcaattgtaccccagacctcagcattttgcaatatacccatgtaacaaacctgcacgccaaaataaatctaaatctaaaataaaaggtgaaattatttaaaaagaatgttacccgtaatcccaccatcaaaagaaaactaatgctcgcatttggctctattgtgtccaattactaaattataccccaaaattccattaaaacacctttattatgattgtgtagtactctagagtacacagacattgtaatttgttaaccagccctccaaattgtttcaagatttacttattctattaaagatgtaatatgtacagatttgcttcctgacactccagtacaagaactaccacttttcttaattttcccaaatcaaaccaatctatcctggcttcagcaattattgagaaattcatcctcatcatattaaggggaagcattttcccctcacttggagtcataaggaaatcttgaggagcttgtccaatccaataaaaccaggccagggcctctgagtctcctgggacttatagtgaattgctttctgtgcagcctgtttgcatccaggtttatggggacctttgccaagtatcctaagtgtgagcacctggttccacccactctaagcatgtcacacatccatcttcccagttgtgggtcacttcttgcaaatggaatacaggtcttcccaatttgaagagcaccatcgccaccactgacaccaaaactgccaccctcttcttggctctgggaagtcatccactcccctcttcctgcgcaattaggaacttcctcctttccccttctggaggtaagtccagacgtcttttccagatacctttaccttctaaccccaatttagggagagagtcttcagagtggcctctgtagcatggggataccattaacaacccttccctgtgggaagaccttggaacttaaaggcttggaagtttcccaggaggtgatggctagcaatagaagttccataaattttttgttgtttctgacaaccacaaggacaaggtaaattaacaatacctcagaagatgaatctgacacacagataatactctatggagagtatttgcatagtgtggtgcttctttaaacaatgaggaagagcccttttctgcacagaggtgtccttgtcatttgtttgtttgcagctgtaggaaggcagggggctttgcatggtgacaatgggttggcagaggggtcctgcctggctcacttcgctccacacagaggatgcctcagtgcagggatgactgtggctggctccatatgagctgcccgtgggcagcgggtaatgggtatcactgccctttcatctttccaatctgataatgaaataatacacacagagaaggaaaatgtggaaacaaaagatgcagttgtactttgcccaactgctgaatcgtctgatttccatccagaacaaatgccattctgttttcacaggtgaaaatcatgaataacgtctgggtactctttggatggaaaagggagaaaagtgttgaaatattagcgttgaagaaacaggatataaactgagtgtatcaaggatatttcatcaaaataaatcctagagaaaatgcttcccctttatctaagtcagggaagagaaatactaattatcagacctcaacttaagctaggagaaacgtgagaatctcagatatgcaccgttggaagttggcattaaaatgtggttagtgaatatagatctatcttattgtaaggcccagaagttcctggttactagtcatcctggcaagtatccacaaactgctcacatccagcatccagatgtccactaaacactcgattttgtgtgtgtgtatattgtactgtagattaacagcaggaccctctagcgcctgcacccaaggtttctattaaaaacaaaagctgctgatttattctcctctaccaccatttctctgagtctttaatgccagacccaccccaaaattgcaagatcataataaaactaactacagttctcttctccatttgtgttgcagttctcacatccacccgttgtattttagaatcatgggtgtctcagtctattacccagagtgatcatagttgcaagaatggcactggggagatatcattcagattttgcttttctgtccataagccacagaagccgtgggaagttgccaagaagacatgcatagctaagccttgctgttctttttttaaattttgtattcttctgttattttttagagatgggagtcttgttctttctcccaggctgatgtgcagtggtgtcaccctagctcactgcagcttcaacctcgggctcaagccatcctcctgcctcagcctccccagtggctggaactacacgtgtgcagcaccacacctggctaattttttaattttttgtagagacagagtctcaactaggttgcccatgctggtcttgaactcctgggctcaagcaatccacctgcctaggcctcccaaagttctgggattacaggtgtgagccactgtacctgaccccagggctcgctgttcgaaatatacacctggctgttggtcacaggactcaccagagaatggcaggtggtggccaactggaggaagaaggcctcagctgatgctgtcaccagggatgggtttatgtaaggatgggagataagatagaagccaggtgtgcccgatggagctccctgtcttccttcccacccttagtcctcaacccagcatggacattaaagacaggaaactagaaggagagcagaaaatgggaaaaaggcaactgcactgtggcttgtaaaaaggactctgtaagcaaatttagaagcgtagagcttccaaagtgagagtttattaattttcctttggagtaccgtgaagcaggaatggtagagaaaacctaaattctgtggatgatttatttgttaatttaatattttgttcctggaatttttaataaaagtacctagcaactagaatgttctcttcaactgaaatcagaattttgactgggtttgagttgaaagtttcacaagtgaaagaaatggggctaaagtgtctgaatgtcatgattaaattaaccatgtcctttaatgagtgctaggaatgagtcattccaaatacatttgcatgtggaaaacttcattgtattttcaaatgccctgtggcaaattgggcattaattaggatgaagtaaaacttcatcacggcaatgttgatttttcttttcacaatagaacgtaatctgaagcaaagtgaataccttggctagccagacaccccactgttcctggcaattaacatattacgtaaagctacatttgcaggttcattttctggacctcggcatttcaatttagggtttaagggtctgaaaacgggaatgaaaaatacatcatcaatacctctagctctaactttcttttatctttgttgttatctccaaatccaatagcattgcaaagaatatgaataaatctgatctccctcgcagaacagtgcacttggtgaacatttcagcaaatatttgttcatgatgttaaaatgaaatcatgaccgtcttttaaaaattaatgctgttcaactatgttgcatacacttgaggacataaatgcggaaagccagatcttagcactacctagctacatatatctatggagcaggtgctataggataaataattcgaaggaaatctcagtaaactgtttttctggatgacatgatcttttcttcttatatgatgtgtacttagagttagaaagttttggtcctgcaagggatctgagacaccaactagctcaacctctggccttacagatgagatacctgtgactcaacgaggttatatgtggaccagtttttggcagaagctgaactagaactagcattcccagactcctggttaaataaaaattttaggcagggtgcagtggctcacacctgtaatcctagcactttgggagactgagatgaaaggatcgcttaagcttaggagtttgagaccagcctgggcaacaaagtgagacctcgtctactacaaattaaaacaattagctgggcatgatggtacacacctgtagtcccagctactcaggaggctgaggtgggaggatcgcttgagcctgggagatcgaggctgcagtgagccataatcttaccactgcactccagcctgggcaatagagaccctgtctgactgaatgaatgaatgaatgaatgaccaaccaaccaatcttaccactggtgtcaactctggagtgcgccacacgtgatctttgctcctttcatttggtagagtttcagggcaagctgctttttctattttctcagtggtaatcagtagtgtgaggttacagggaaggttaaattaggttaccacatgacagttacttgatacagagcagcaggcacctgttatgttgggtcctttatttcttccctcatcctttcattaggaagagaatatttctatagggtcaatcacagatgcagaagaggagagagctgcattgagccaatgacaccagaatgtcttcgtgacagagagaccccttcgaagaagagaagaatagaaaggacaagtggggttcaggtggcctgattatacagaccacccccttcatgcatgaccccaaagggcttaccatttgggtttgcgggtttggggttgcctaatgatttggggaagtctttacaaggttgtgatggaaacagagggagattggtgtcatggatctccatggagcaaggaggaaaatccagtcttacagacccttgagtcctgctcacgtggctcagagaatattcccaccatcccctgcttcctcctcagttaggcatagctctccactcagcagcttagggtagcagcttcaaacaccaagctgtaggccatgcatgactgagaaaagttttcaccggaggcaaaatgagaacactaactccaacataaagaatttttcactagatcaaacctgaaattgtgtttgcttcccccttttttggtattaaagtatctttcctttcttatggtaaaaaaatgataccacagagagtaagatttctttaatgcctcttactttgcaaaataaaatcaacatccttgtattgtaacccctcataaatttgggggaaatatttctttagaaattttcatctatgaaatataaaataatgggaactatgattatggaaataagctccagagagtttagctttctccatggttcttactaatatgaatatgtgagcatcctagcagcttagccaggaggaaccattagaattggtgttggtcagcggtggtttgcttgtaaggcaccgttatcccaaactagtgcaagaacaaaaactgaattaattgaaggaattcattggaaggaccccacagtgtactggaaacagaaagtgggaagcccaggagaccccagatggctgctgtcttatcttttgtgctctctgaagatcgtgggggtctcacatctctgttttttaatacagattcgctttattttttttctctgcacttttttctgtttcacttttcctgcccacgttaaccacagcttcaagttgaaaactaagttgtttcaagttctctgtagacattgactaatagatcctctgtcccagatctaaatttacaattgagagtttaattggaccagctaagttcaggtaactacttcttgacccaatcaggaaagacatttccaggggcgagaatttgattgatccagctaagatcaggtgactactgttcagtccaatcaggaaagaccaggctgggagtgggtagccctgtactttattgcccagttcagagcaaccctcgcacctccctcacctacactcttcctcctcccctgatgcccctttaaactcagcagttactgccccagactccttctgcacccagggtgatgtgcctcttcattcttcctgtccatctattgcatatatattatcttttgcccccatatagaccttacatgcttgacgagctcaagaacttttatctctggtccacttttacccatggtgcctagcactgttccaaaatgctattttgactttttttttttccagcatatcagatcacagggtatctggcacaagtgtcagcaatttccattgtcttttctctgaactaaatgatgtctcagcagcaagctggcatcagaggggagggtactgcgtgtgaggagactgctaatatgtagtgatcgttttcagtgagaacgtgaataacaacaaaaagaggagtttacatttggagctaaatagctatgtttaggaagtgaggggagaaaaaatatatagccctgcatctctgatttttctacttacctaccactacgatgaccctgaacaagaaacagagatttgattttgattttcttcaaggattattaccttctgcaatggaaaatgacaactcatcaaatgtatggtttctgccgtgagctataaagatgaccaaaaggcagaggttataaatgtagccatgttgcttaaagtaatattatttcttggctatcttgctaaactgaatctaccttctttaaaaaaaaatgtcaggaatgaggacatcataccttgatattctgctgagcacagtaaggaggaagctacttcactgaggaccacgtgaatttgtctaaatcttggtgaactgggcagtgatttagggataattttcctggtcaaatacttgtaatgtgtgtcaaagccagatccccataacagaagcagactttgtaaaaaataaatctaggaatgcaccactttggggacttgtacagaaaaattaaccaaaggagacaatttcactgttaatgcatgtcctttctggtcatgatattggcatatctttgctgagtttcctgtagaacacccagtcatctccttgaagccacatcccttaagaaacacagggcggaaggtactgaccttatccctgctttcctctatgggaaggtcctgagaggcatgtaggaaggtgtgattgtctggataatgcaattggttctgttgagaggggtcgtcttgtacttttagcaagaagctgctcatcccattctcaaagggtactgctagagtatcaggcacaccttgggcatccctgaaacaaatctgtagcccaaaactcaaggcaggactggctaaagaattgtcagggtaccttgttcaaaaatcattaataaggccgggcatggtagctcgcaccttggaatcccagcactttgggaggctgaggcaggtgcatcacctgaagtcaggagtttgagaccaccctagccaacgtggcaaaaccccatctctactaaaaatacaaaaattagctgggcatgatggtacatgcctgtaatcccagctacttgggaggttgaggcaggagaattgcttgaacccaggaggcagaggttgaagtgagccaagatggcaccactgcactccagtctgagcaacaagaatgaaacgccatctcagaaaaaataaaataaaataaaaatctcccttgcaatgtgagtttactgattgtggaaacagtcttggtatgagactctgaaggaccagttgtgttcaatttactctggtattagtagctcatccatctagggtgcgtagaagagtatacagtcccatctgttgtgaaagcactgttagaatttgtcgggcaaaaggaattgttttgctgtcactttcttataatgtggcttgtcctcaactccctgttcaaaatgcaccacataagtcaaacaataaaaatcttaatggagaccaggtgcagcgggtcacgcctataatcctagcactttgggaggccgaggcaggcggatcacctgaggtcaggagttcaagagtactcaaagtactcaaagcctggccatcatggtgaaaccccatctctgctaaaaaacacaaaaactagccaggcatgttggggcacacctgtagtcccagttattcaggaggctgaggcacaagaattgcttgaaaaccggaggtggaggttgtagtgagccgatctcacaccactgcactctggcaataaataaataaataaataaataaataaataaataaatacaatggaacacttaagggcaatgttattttccggtaattttcacaactgatactttgacccactgggtctttagttttccctatctaacccttgtgatggactgttaccccttgccatattatttttccagattaatagaaatggcattggacatattttccacacgattaataatagtctattttcccactttctttaaaatgccttttgcagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggtaagctttagaaggcagtttctgatgcccctttcttactgaatgcgtttgttgttatactactgaacctatactctttcattcaacattaatttgatcttgatttgcaaatactctagtactgggaaacttcattggtttaatatcaagcattgaggatttgcctgctgggtaatcaggtcaagtgcaagctgattttgaggctgggcactttcagaagtggttgggattagcaattcaagccaagaggctagtagtattttacctatgttcctgctactatacagcaggagtccccagtccccaggccatggaccagtaccagtctgtggcctgttaggaaacagaccacacagcaagaggtgagcagaggatgagcaagcattaccgcctgagctccgcctcctgtcagatcagctgtggcatccgcttctcataggagctgaaccctattatgaactgcatgagtgagggatctaggttgcatgctccttatgagaatctaactaatgcctgatgatccgagatggagcagtttcattccgaaaccatctgccatccatggaaaaactgtctttcatgaaaccagtccctggtgccaaaaaaaattagggaccagtgctctataggaaattgtgaggaactgaccgtagaatgatcctcttctcaccttgcaaccctcctctccagtcccagaggccaggacagttggcatttgtacccagtggtgtgggtttccaccagccctgctgcacctgtctggtagtccagtggaggagatgacaaaaagggacaatgtggctaacatctgcatgactgttcataagaaccataaacacgaggctgttcccactaccacgtgaaaggatagaggggcttggtgtgtgtagggcacagcttttctgaaaggcagaaggattctttttatgattttaccacgtatcatttccttttttttttttttgtattggaagtttactttctatcttgctttgcttttttaattgctttttttggcgctttaacaaaatggacaagtcgtgaggatttagacctctctgtcaagggggcagatgtttcttatgcttcattgccatgttaaggttctgatttgggtacttgtgtttgcaaacagatgggcttggggataagaggggacaggaaaagagtcaacatgcaaaagccttcagagtctagcacgtgcaaaagacagctgaactctgccatgtaaaactgagcaaatgccttgctgggagaagaaagaaaaagattgatgtgagagaaggtaccctgattttagttcctttgctgcagataatgacccaagcagactgaattcagacattgtcctagctgtcctaaaaaaaaaccctacaactttgttattatttgtattatcaatattaatatttaacattaaattttgtgtcaaattaaattttgatcaaattaagatcaaattaaaatttgatcttaggttagtaatctaggatcctcattgtataaatgagagaagaccacagaaaatgtgctttttgtttatgtgtgtgtttgcttgtttgagctcacacacttaattaagtggcagcagtgggaagtccagggctccagttcccattaacatgatcttacaaatgaagggacaaggacacacaggggagggacacacccaaggagcatcatgggccaagacagtgtcaagatgacacaggcttccacaccgtcaccaggctggggctttctgtgtggattcaagaaatttgtggtttttcttttcttttttttttttttttttcttgagacagagttttgctctgtcacccaggctggagtgcaatggcatgatcatgattcactacagcctcgacttcccacgttcaagggatcctcccatctcagccttcagagtagatgggactacaggcacgcacccaggcgcctggctaattttttattttttgtagagatggggtctcactatgttgcccaggctggtctggaattcctggactcaagtaatcctcccaccttaacctcacaaaatgctgggattataggcatgagccagcatgtctggcctgaaacttgtgctttcttaactccactcacacttaggagccaggcaaggaatgggatttctcctttgtgcttggaggaaatgagctcaggtctctgtaaagataacctcagctctgcaaaccaaaacgaagataagaataaatgcctgtccgccttcccccatacctgggggaactttgactctgtcggataatggatcttttgtcttaaaggaaggaatttcctctgcagccaagaacggttggcagtgcaggttgagacttgctgggttcaggaaccaagccttggggcagagaggctgcaggagctggggccggcttgcccaaggaatggctgagggtggcgggtgttttcgcacggggtggccacgcttctgcaaattgctccattttactcagcatcctttgctgtagagtgccggtgtgctgtcacagcaggctgaaaaatgcatctgacctgtttattctgccctccctgtgaggggctttttggcctgccatttttcactactcctggatagaaacaaaggaacacagtaagaggagaggagagaaatgagaagtttcttgccaaagccaagggaagctctggttccagaaaatgaggctggcactgggccagctgggttgatgttgcccttgaccgcctctttgtggccgattggggaatgtccccccagccgcacctggcccttatggcgtaatccagttgagcctggacgggaaataaaaaggaaaatgtgactcacagcaagtgcaaatgcagtctccctcccaggggccttgctcagcttagtctttgggaaactccccgcctgcctggccttatttaacacacagacgcacgggttcctgggataaacagtgctccccagagagccccggccatgagcagggtgtctaccagcacctgggtggcccagaagcacagctgcaactccatggggcctcagatatgccgactggatactttgagctgtaacccccctggaaacccgctgttgatgccatctggaagccctgggtgtcttttggcatctgtatgttgtcactttatctcaatccatagagttttaagttctctcatgaagccctgttgatcttgcctttatttaaaattttgatggtttatcatgaattttttttatcattttattttttaggagcaattttttaggtttgtaacaagatcgagcagaaagtacagacagttcccatacacccttggcctccacgcatgaacagcctcccccatgatcagcataccctactagagtggtacgtttgttacgatcaatgaaatgagaccgacacattgatatcacccagagtccatagtttacactggggttcactcttgctgttgtacattccatggatttggacaaagaggctgtcaagggcaacatcaacccagctggctcagtgtcgcccaggctggagtgcagtggaacgatctcggctcaccgcaatctctgtctcccgggttcacgccattctcctgcctcagcctcctgagtagctgggacgcaggtgcctgccaccatgcctggctaattttttagtatttttagtagagaccaggtttcaccatgttagccaggatggtctcgatctcctgacctcgtgatccgcctgccttggcctcctaaagtgctgggattactggcgtgagccaccacacccacctgctttttaaaagtattgcacaaagacattatttatcatgatcactgagcttttgggagacccttaaattttgcactggaggtatgcgtcttgttgacctcaccccagtgctggcccctcatgtaaccccaggagcatcagacactgttactgccagcccccagccacggggcctggagtaaggagagtgaggaaagcccagttcccggcctgtacactggcacgtggtgccacagtttgtcactggagtccttccccagctcaggcagcacagaaaggggagggctaggcaacttgagggtggagccaggacaagatggaatcctcacaccactccggctcctgagaggagaggaagccttccctcacttcagtctgcctgtgcctggagataaacctgcctgcctcttagtttctccacttgaataagtcctcatttctattgcttcagtgtatttgggggctgggagaaatgcaggaaggctgagcatggtgcatttcgcaaatggtgttaaaagacatgcaagagaaagtgtggggaacagtagctgtgttttggacccgtcttagacatcactggtgtctgtgtaatggtctccctcgggtgctgtcctgggatgcaaggtgtctacttctcatttgggagaagcattttgacattcagacagagccaagtgacagcaacacacaagtcctttctgaggcttagagcctagaaatttacaaagaagaaaggtaaagaaagaaattgatgggttcagcagcactgacttatcccaacgccaggttccaacaacctatcgtgtctaaatctgtacttccacagagtgatgggttccctgccctttcctctcatccagagcccagctgaaattcttttcagtggaatttatgccacttctcctttactctctcttcagtgaaaatagagaagaccaggagaaaggaagactaaaaagtaaagtgaaaaccgccttccaatagaatttggttgcagaaataatttccatgaaaaatggtcgggctgatattaggtctggagtcttaatgatggagtagtttccttttaatcatggtgctgtcttagaaatgcctgtctggaatgtgaccatgggcgggggttggtgtctggccactgcgtagtcggccttcggggaaagggtagccacaagatgttcccactcttctgtgagccctcaggaatttgaaaataagactcatgtgaaaacaggaacaacagcagcaacttcttgatgcagacagattcctttgttgaccatattctgaatgcatagctttagaaaagagacctcactgaccagcccggcagccagaggagttcccatttctgcaacaaactgcctctgaaacactcagactgaaaaagcaaaaatgatcttaagtggcataggaggattttagactggttagagggagaagttcctcagggggacgaattattgaatatctgtgtggctgttcttttattccaacatgattaactttgatgcttatcattccctatgggaatttaaggaaaagaaggctcataattgccagaatcttccatcctgtgtacatgcaaggctgagtaggaaatcagggcaaaggaattgatgaattgtctgtctctaaagatgaaaacaaagagggggcaacaactgtaagactaatgtgagactgtctgaatgtgaacagttatttcttgaatattcaaaaataaatctattttatttatttatttatttatttatttagagacagggtctttctctgttgcccaggctggagtacagtggcacaaacatagctcactgcagccttgaagtccctgactcaagcaatcctcccacctcatcctcctgagtagctgggactacaagtgcacaccaccatgcccagctaatttttctgtttttatttttttttagaaatggggtcttgctgtgttttctgctggtctcaaacacctggcctcaagtgatcctcccacattggcctcttaaaatgctgggattacaggcatgggccactgcacctggcccaaaagataaaagaattttaaacaaatgaaaagaagtattgctctgtagagtaagtgaaacatttatgaaatttgttttttctaagaccttgtagttattgaaaagtaatactgtaaaaacaaaaattcgcagaagggagtttcatagcaggtcaataagttcatggtcaggctcttaggctgctagcatagaaaatgtcagagcaggcagacacacaacaaaaaaagagaattttagaccaatatccctgatgaacattgatgcaaaaattctcagtaaaattctggcaaactgaatccagcagcacatcaaaaggcttatccaccaaaatcaagttggcttcatccctgggatgcaaggctggttcaacttacgcaaatcaataaacataatccatcatataaacagaaccaaagacaaaaaccacatgattatctcaatagatgcagaaaaggccttcgacaagattaaacagccttcatgctaaaaactttcaataaactaggtattgatgggacatatctcaaaataataagagctacttatgacaaacccacagccaatatcatactgaatgggcaaaaactggaagcattccctttgaaaactggtagaagacagggatgccctttctcactactcctattcaacatagtgttggaagttctggccagggcaatcaggcaagagaaagaaataaagggtattcaattaggaaaagaggaagtcaaattctccctgtttgcaggtgacatgactgtatatttaaaaacccccgttgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccacttctcaacgaaataaaagaggacacaaacaaatggaagaacattccatgctcatggataggaagagtcaatattgtgaaaatggccatactgcccaaggtaatttatagattcaatgccatccccatcaagctaccaatgactttcttcacagaattggaaaagactactttaaagttcatatggaaccaaaaaagaggctgtatagccaagacaatcctaagccaaaagaacaaagctggaggcatcacactacctgacttcaaactatactacaaggctacagtaaccaaaacagcatggtactggtaccaaaacagagatacagaccaatggaacagaacagagccctcagaaataataccacacatctacaactgtctgatctttgacaaacctgacaaaaacaagcaatggggaaaggattccctatttatttaataaatggtgccgggaaaactggctagccatatgtggaaagctgaaactggatcccttccttacagcttatacaaaaattaattcaagatgaattaaaggcttaaatgttagacctaaaaccgcaaaaaccctagaagaaaacctaggcaataccattcaggacagaggcatgggcaaagacttcatgactaaaacaccaaaagcaatggcaacaaaagccaaaattgacaaatgggatctaattaaactaaagagcttctgtacagcaaaagaaactaccatcagagtgaacaggcaacctacagaatgggagaaaatttttacaatctacccacctgacaaagggctaatatccagaatctacaaagaacttaaacaaatttacaagaaaaaatcaaactcttcaacaagcgggcgaaggatatgaacagacacttctcaaaagaagacatttatgcatccaacagacacatgaaaaaatgctcatcatcactggtcatcagagaaatgcaaatcaatccacaatgagataccatctcacaccagttagaatggcgatcattaaaaagtcaggaaacgacatgtgctggagaggatgtggagaaataggaacacttttacactgttggtgggactgtaaactagttcaaccattgtggaagacagtgtggtgattcctcaaggatctagaactagaaatagcatttgacccaaccatcccattactgggcatatatccaaaggattataaatcatgctgctataaacacacacacgtacgtttattgcagcactattcacaatagcaaagacttggaaccagcccaaacgtccatcaatgatagactggattaagaaaatgtggcacatatacaccatgtaatactatgtagccataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaatatcacacactggggcctgtggtggggtgggggaatgggggagggatagcattaggagatatacctaatgtaaatgatgagttaatgggtgtagcacaccaacatggcacatgtatacatatgtaacaaacctgcacgttgtgtacatgtaccctagaacttaaagtataataaaaaaaaaaaagaaagaaagaaaatacaacaacaaccacaacaacaaaatgtcagagcattctctctagcatcagaaccagcgccctggcctaagtagctgggagtgggtggttagggtgtctggctggaatcacccataccagtctcttcctagtgcacctgctgctaccactgaggctggaaagcagattctttctggaatatccaatgtgctgggttctggaaggtgagaagcaaggcagttgtggagacttgggttttttgttttgttttgttttgttttttttcagcattatttgccaagctcccagggcacggccaccagcttgatcgggttgagactgctggggcaggcatccatctctagtactgaagtgaaggtgaggcccaactctgcatctgtgctggcagcttccaatcaaggcagcatggctttggaatcacacctgaccagagtttaaggaagcttcctctttaccaaaccaggtctatagtcacccagttttactgtgaagattcagcccagtgattctgcaagccatttaataaatccattttttttaactggctgaaccagttcagttctctacaactgatctctgactgcacaggggcctaacttattatatttgtagatattgtagtgctgcctgttctgtgtgtttcaggaaataggacaagtgctggagggtataggttgatgacttctggaggcttggcagggagctgtaagtgtggttttcaaactatgttctagagaacatggaagttctatattataaatactgcaatttcatgtaagatctcatttgaaaaatgagctgatgctaaactggtaaaaaatacaataaaataaaaccgatacacacaataaaaattaaataggccagtagtatgggggaaaaaaggagggagggagggagggaaggaaggaaggaaggaaggaaggaaggaaggaaggaaggaaggaaggaaggaaaattatgaggaaatttcaaaagaaagggagaaagagagagggagggagggaaggaaggaaatgaataaatgtcctttatactcagcaggagtctttaaatactttaatttgccaaaacattctcttagttttctcgcacttgatgtaatgaatgtcctgagaggtagttttttaaaaaccgagtcaatctttaagtaaaacatttcaggctaagaattaaccattgtaaggaatatgtcaaaaatttcttcagtatagtgaagcatgttttgtgatacaagcatccccccagtttgtcctttatcaactaggattttcatatatgaggcttgctgaaaaaaggcagcgttgtccaggtttcctcacttggctcccaattcacccataagaaagaatgttcttgtaaaagatcatgtggattcatgatgcatttgtgcttactttaaaaaacaaagttggtcagatatccttaggaatctcttgtgattaaaattcctgggttgaaactctagaagagatttctcaaactttgaagcaattgtttagttaatatggacctgagagattctatgccttttaccaaaaaaaatatatcttctaggattactttgcagatgggacataggtaaaaaagcatggcctgaagtgaggagaagatgtgatgaatgacaaaggtgtcaaccctcaggcaccattattttagagggactttcagtgatcagggactatgaggaggaaacagtcttagcagtgagagaggtcttagagaagatttaggttctcctgtttctttctttctttctttttttttttttttttttttttttttgtgagacggagttttgctcttgtcacccaggctggagtgcagtggtgtgatctcaactcactgcaacctccacctctggggttcagcaattcttgtgcttcagcctcctaagtagctgggattacaggcaacggccaacacacctggttaatttttgtatttttaataaagacaaggtttcactatgttggccaagctggtctcgaactcctgacctcaggtgatccacccacctcagcctcccaaagtgatgggattacaggtgtgagccaccacacttggcctaggttctcctgtttctctttcttcctttgcagccaggctgttgttaaacctggagtataagtcacctttttataaagttaacctaagacttttcagtgctgaagatggagctatagggttaagtaactggaaaggtaacatatttccaaagccatttcagaaaatcagtcttggcgttaagttagagtgaactattccattctctctctgctatacccattgataccccatcctaacccagacacctagctgattttgttttcctgatgcgaaaaatactctaattcaaaaatgaaccctccatcaagtttcaaagacaacacagaagaaagtaggcaagttttatctatgatttatacctttctaaatccaaattagatttgatctggcttcatcaaaaccaataaaaatatcaaagaaccattaaaataagaattaatacaagtagctgttgggtaaaatatgtgttccagaaaaattaagataaagatgatggctgtaattgcagttaatattagaatataagacaaaagaagaaatgtaaggcattattacatggattgcattgtttaagatgaggtttataccagctcattagaaaaaaaaaaagttttaaggcattatcttccaacaactcttatatcttaatgtttttgacatctgattatctactaagcagttatatatcacagttgttttatgaaatgttttccatgtggctatatctttaccataaaacttcaaaatccaacaacacagtattaagtcatgcagtgagaaggccataacttagaatctatagatttccagggatctaatttaatacatggaaaaagttgatgtagtcttgataattgctttagccctcagatggttggtccttggctattagttgtcttagcaggttgggtaacttcagctgaagaggaatatttgagaggcagatcattgttgaagacttgaatggcaaaagagagttagaaaagtcatttctcccacagtgacaaaattccaaaatttttaatatgttccaataataccagctactactctacactttccccgggaatgacattggaaatttatggattcagatgctgtacttttagatgttctgcaatggtttggttggaacaagagatgagacattaggaaatgttacctgaactgtgtatgaggaaaaagattttgtttatcagcctcttttgtttccctttgccatgaaaactctatctaaaatctgttcaccatgccttactgttttcataaatgcaaaatatattacacacattatttttttttaattaaaagtttctggctgagtcaattttttttgaaagctaattttcagatatgatcctttaggtttatttaactcgatacaagttccccacatttttagcaccggcttttaaagaacagtctaaaaaatgttagaaataaaattaagacgcaagccagttttatggcatacacccaagtagaacttcatccttggtgttctcatcctagcagtggcctccagaaggctgcccgctgatgtccagaaactgagatttagggcagtttctcatatttctggctcagtcgaggaacatgggaaggtacacgttctgcattgctggagggtagattatgtcttcttaggcagaggagttagtgaaaggtcctggtctactggcatccagatttcacaagttagctctgtggtatggatttgaaactaagcaggcccctgtctggagatgaggttctgtctggagcagggaggagccagactttccatccaggaaagctgctttcatgcaggacagcaggcgagagcccccaggcaccaccatgacgctcttcggtttcttgtgattctgagtcactctcttgggggctgttaagggaggaattgtgcctaccctctcccaaattcatatgttgaagtcctaactcctaatacttcagcatgtggctgtatttggaggtaggaacttcggagaggtgattatgttaaaatgaggtcataagtgtaggtcttaatccgatatgactggtgtccttacaagaagaacagatttggatatagacgtgtacagagagaagaccatgtgaagacataagaaaaagacagctatctacaagccagggagagaggcttcagaaggaacccacacagctgacaccttgatcaaaataactctgttgtttaagccccttagcacagccccacgtacttaattgtggcagcctgaacaaatgagtacggggactcctgtcttcttctttcgtcctgtctcctttgaggggaatgtcaggcttatgacagttgtcacaaacatattgtgtgtctttcttcaagacattaaaattgtgtttgtcaagctttccattcactttaatttgttttcatttcagcacatcagcttggtttcttagcattccaaggggaaagtttaaaacctttttgcatatagactccatttgcacggctacttttcttttcggcgattctcaagccccatcctcaaattcagcccgtggaagttgtttgacatctaactgagttaactgcatcctatcaagcgaagctcctattttcagcctgctgagtttggctactcaaaagttggttaatgtcattaaaaatgatattcccaccaacttttcatttgcagaatttgctaaggtgttaattggctttcagacatccctggctaaacatctccctataatataaagctaaacatgataaaaataaattacttgttttcccctctctttctgccccaagttttgcccactctcgggttttgttttgtttttttttaatctccattcatgtgtttattaagaatcgatttggtttctggcactgctaaaggtgccatgatgagttattttaaaaacatatacaatctggttcttgtatttaaggaattttcagtataactaaagacacatggtaactatgtaaggactgactttaaaatatccataaatcaaagacttcccggatgaagctctgattacacccagccaccccggactcctggctgttccagcagtctcgcccagcacctacatccctgccgctctctgctttgattcaccccacaaacgccagtttcccatacccacatctagacctctgcccatcagagagccctccactgggtaaaatattaatagcacccctgctgccggtctctgtctccttacctgctgcattctagtttcatgatgcttctttaacagaacagtgattctcagactttagcaggagacgtgttaaagcgcaggtttctagccctacctcctgagtttctgattcagtaggtctagggtgggacctcataatttgcatttctcacaatttcccaggtgacatggatgctgcaggtcaggggaccactgattgagggtgagacatgccctcagaaagaatgaaatggttatttcagtgaccaccatcaccacataagggcatgtgaatcagtccccagtggagaatagaaagttgtcattttacattggcaggaaaacatagaggcccttgcagggaggacctctcccccattctttgctgttcttatttttgatccctacttgatctctgaatcacctcatctgccacctctttcccctgctggacacccttagactcaacatctgacctccgccctgttgctccggtcttggagggtaatcttttcttatgcctttgtgccactctgcacatacatcccaagttacttcattcaaggatttcccacaccagtgtcctgcccttctcctgccccagggacactctggctccaaccatggtcagtttagcaaccagatgttgatatcattcatggtgtggacgaggcaaaggaccagtgcttaaggccagtgcacctgagaatgtccctggaaaagaaagttcccttggaacaagatgctctatgctttgattcagtaattggcctttcttgattctagggctaggcacgttcttgtgcttccatttggttcataaaaggaaccacataatgtaggagcctttttttaagagacagagtcctgctctgtcacccaggctggagttcggtggtgcagtcatagttctacagcctcaatctcctgggctcaagcaagcctcccacctcagcctctcaagtagctgggactataggtgtgtactatcaattacacttggctattttgttgttgttgttaattttgtagggacgggggtctcacgattagcccaggctggtctcaagcttcaggtggtcatctacctcagcctccaaaactgctggaattacaggcatgaaccaccaagcccagcctataggagccttcttaagagtaaaaactcaattaaaactacataccaatgccagcaatgattcttttaagaaatgcttaccggccaggcgtggtggctcacccctgtaatcacagcactttgggagactgaggtgggtggatcacctgaggtcaggagttcgagaccagcctggccaacatggtgaaaccctctctctactaaaaatacaaaaattagacaggtgtggtggcaggcacctgtaatcccaactagtcgggaggctgtggcaggagaatcacttgagcccgggaagcggaggttgcagagagcagagattgcgccattgcactccagcctgggcgacagagtgagactctgtctcaaaaaaaagagaaaaaagaaaaaaaatgctcaccaagtatctaccaggcaatcttaataaaacagccacaaacctctggcttctggagcttctgttctgttggaggaggcagctgataaagaaataaaatatataatagatggtataagtgctatggagaaaaataaagcaggagaagggatacagagagcgctgaagacatgaagatgggagagttgtaattttatgaaagatggacagggggagcctcactgagaaggcagccttcgagccatgacctggagcatgtgaagatgtaagccatgcagatatctgggggaagagagttccaggcagaggaacagtcaatgcaaaagcccgagaaagagcatgcctggagcattcaaggaacagcaaaaaggccactatgatcggaatgatgtcagaaaggtaacaggccaaatattggatggcttttgcaaaacaaacactctggctccactggcaacattggaaagagaatgtctgcttcattgcagaggtaggatcagtggcgccacttcagatttaaagactattctggctactgggtttggaacagactaaaggcagtgtggacaggagctgggagaccagttaggagtcttgcaataatccaggaagatgggagtgttagcagagtgagcagggaaaagaatctgggttctgtagatgctttgaaatgagattaaggttggtttctgccatccaggagtttgtgttctgatggagaaggcatagatgtaagaaactctttttttttttttttttttttgagacggagtctcactctgtcacccaggctggagtgcaatggtgccatcttggctcactgcaacctcatacctcctgggttcaagcaattctcctgtctacaggcatgcagcaccacacccggctaatttttgtatttttaatagagacaggatttcactatgttggccaggctggtctcgaactcctgacctcgcgatccacccggcttggcctcccaaagtgctgggattacaggcgtgaaccactgtgcctggctgatgtaagaaactcttaaccgaggatatgatgcaaacatcaccatagtagctaacatttgctaagcactcattctatgctaggcggtatctaacacaccaaccagcaaagccaagattggaacccaagcagccttgtctgtagaacctacatacttaaccactacaatgtacgaaaaagtaaaaacgacaaagatcttatctggataactgggagagtttttaatgaaaagtagcatttgatttgggttttgaaggatgactagaaattgacagtttgaaaagggggaaggtctcttatgagagcagtgactataataataagattccactaataaccatgtagtgatcacttgaacattccagcaatgaagctggagccacagaggtgtatttctctctacagcagttattccatcctatccagtgccattcacacctgtagctacagctgttcccacaaccccacccccaataaagagggcactgagtgtacccggaagcagccagtagagtaatcaggatcatctcatctgggttcctttacttaccttgtctgtgacattgggcaagttaatcaatctctgagccatttctgtaaatacctacctcacagagtacagttgacccttgaacaacacagggattaggggcgctgactccccatgcagttggaaattcacatatagcttttgactcccccaaaacttaactactaatagcctaccattgagcagaaggcttgccaataacataagtagtcaattaacacatattcgtatgttctatgtattctatactgtatttttaccataaagtaagctatagaaaagaaaatcttattaagataatcattaagagaaactactatttatttagtggaagtgggtcatcattaagctcttcatccccatcatcttcacattgaataaagctgaagaagaggaggaggggttggtcttgctgtctgaggggtagcagaagcaaaaggaaatccacatactgttaagaatggcaaatatccgacttattggtggcaaatatgtacaggtctgcagcaatctcaattcttgcctcctcagaagaaacaatttgactgaggggcctaaggcagaaaaagaaaccaaggcaagtttcagggcaggagtggaagtttgttagaaagctttagaacaggaaagaaaggaaagtacacttggaagagacccaagcaggcaccttggagctcaagtgtggcatttttatatatcgacatatttcaggggtcttgtgtcctttttcccatgattctttcctctggatgggccgcccgcatgcacagtgacctgctaacacttaagagttgagcgtgcacagtgtgtttactgcagttgtacacatgcccacctgaggcattcttcccttttccagtggcatgcccccagaagatcatgctttgccattttgtctctaaatgtgcaaaccaaagtctagtggcccaatttctgagctgccagttaccaatttcaagtgtttttatttatagggaaactgcctttccctggtactggctgcgaccaattattattttagagagaccattaacaactacctgaccatcacctgatggttgcctgactttcctggtagggttggagggagccctctcctgccccgctcatgcctgactagctgcctaccataataatagaagtggacccacacagctcaaactgtattgttcacaggtcaactgtagttgtacatagccagtgagatcatataggtcatgttcttaatacactgcctgatatatagtaagtactctgtaaattagctgatggtcatagcgatgaactgaggtttttttcttaatgtctattgcattctaaggtaggacattacaaatttcatttagaaatatttacatcataatggttaaaattaagacatttctcatttgtgacgtactcacttttaacttattctttttaccgatgatgttaactcaaacctcatctctttcccaattcaaaaaaatgctctatcattgtcctttcacatcgtgtttcatttgctaagttcatgagttattttataataattaacattttagattggtcagctgaattctgatagtctttattctcattggtaacatgtcactgagttatattttaggttatcttagatcccatctctaaattctaatggccactctgtgttgcactgttcttttcaattctgtctttcagttcctgggtccatcagatctaagaatgtgactgaggtattccagcatggagagagttaatgtgaggttgaatgtggataatgcttcagaaagagtccaaaaaatacagaaattatgctaataggaaagaatgagtatcagaagatttctagcaatatagcagcatgagggatcttagatgctaactgtaccccttgtcaccacaaacacgtagcgacccaggatgaaatataataataacaaaaaaataataataatacatggcaagtttgaaagcgatgaaaggaaatctccagattccaaaagtgaagaagaatatcaaagtggaaatcaccatggacatggatatttcagagatgggtaccatgtctttgaactaggactttgctacttaacatagcaacaggaaaatgaacagatagatggactaatcgcccctgcgtaaatagcctagaggttcaaataactgatcatttattttttaaaaatgggtagatagaactctaatcacatcccaggaaagcagcaaagaggtttgcctctgacctgagaattggggcagaaaaaaaaattatctgggagaaacaaaagccctagacaggaaccgtgcacagggatgaagcctggacttatactacctgacctgcattttggggacttcccacagtatatcagtcaggataggctagttaatgctgcagtaacaattcccaaatctcaacagcacttatcacaaccactgtttatttcttgcttaagttgcttgcccagtgcagcttggcaagaggtcctgcctgtcatagccacccagggtccccatgctgatggaagccccatctcaacatgtcacagaagcaggataaagggagcataacaaatcttggctcttaaagcttctgcaagaagtgatgctttggttaaaagaagccacagatccatgcttacctccaaaggggacaaggaagtgcaatccaacaatggacctggaatatttgtgaacaatactagagacaatcacaccaagcctatacattaacctaaaagtaatcaggatcattgaaatccctagtccagagtattcagctgaagagagaaatagtcaaccagaatataaatatgaggaaatctcacaatctgaggagagaaaacatgaaagaccaacttagagacaggatcaagcaaccagggccacctatgtctgagaggaattctggaagataaggctagaaaaaaattggggaaagacaatagtggatgagagaatagatgagaatttttctagaattgaagacaaacctgagacttaagattgaaaaataacacaaaattccaagcaagaaacatacacacacacacacacacacacacacacacacacacaggcccactttggagaaactgcaaaacatcaaagatcaaaagaaaattttaaaagcagctggagagaaatgacaggttacttacaaagaaaagaaaacttaataccagcatgcttttataagccaagaagtcagaaagcaagagtaatagcttcaaaatccaagggaaagaagttaccatcaaccaatatatatatatatatatatttttatccagcaaaattctttatttgagagtgagggcaaaaagagcctactttaagataaacaagattaggagtatttaccattcacagactcactgaaagtactattaccatatgtatttcacacaaaaatccttaatacattataagcaaatcagattcatcaaggtgtaaaagcaataatacatcacaaccaagcgaggtttattccaggtatgcacggctggttcaatatttgaaaatttataaagtaatccaccatatgaacaggctgaagaaggagaatcatatgatcatgttaattgacagttaaaaatatttgataaaatctaacaacaattcatgattaaaaaaacacaaaactcccagcaaactaggaatagaggtgaactttctcacttcataaagagcatctaccagaaacctacagccaacatcatactttccctctaagatagggaacagccaggagtgtctgatcttaccactcttaacataattctggacatggtagccactgcaataggcaggaaaaagaaataaaaggcatgtagtttgggaagtaagaaataaaactgtctctgtttgcagatgacattatctacataggaaatccaatgaatgcaccaaaacaactctcctagaagtaatgagtgagttcaagatcaacatacaaaatctattgcatttctatatactaagaatgagcaaatggaagccaaaataaaaaacacagtaccatttacagttgctccagagaacatgaaatacttaggtatacataaaacaaaacatgtatatgatctgtatgttgaaaattacaatatgctgttgaaagaagtcaaagacctaataactgaagagactattttcatagataggaagattcagccaaatgaagatgtcactgctctcccaaaagatctataggtttaaaaatattcctataaaaaccacagcaagttttttttgtaaacataaacaagcttgttctaaaatttatataaaaaggcaaacgagtggtcaggcgcagtgactcacgcctgtaatcccagcactttgggaggccaaggcgggcggatcacgaggtcaggaggtcgagaccatcctggctaacacggtgaaaccctgtctctactaaaaaatacacaaaaaattagccgggcgtattggtgggcgcctgtagtcccaactactcaggaggctgaggcagtagaatggcgtgaacccgggaggcggagcttgcagtgagccgagatcgcgccactgcactccagcctgggtgacaaggcaagactccctctcaaaaaaacaaaaaacaaaacaaaaaaaaaaaaaaggcaaaggagtttgaatagctaaaactattttgacaaagaaaaatgaagtgggaggaattattccaccagatttttaggctgcttatagagctacaacaatcaggactttgtagtattggcagacacataggtcaatgaaacagaataaagaacccaaaatagaaccacccaaatacgcccacttggtcttttacaaaatttaagagttctttatatattctagatactggtccttcatcaaatgtggtttacaaatatttcctttcagtctgtagcttgtcttttcatcctctgaaggagatccagtctgggcacgatggctcatgcctgtaatcccagcactttgggaggctgatgtgggaggatcacttgaggtcaggagttggagaccagcctggccaagtgaaaaagcaattcaatggaggaacaatagcttttttagcatatggtactgaagaaatgggatctcccctcaaaaacttcaacctgagtctcacacttaatacaaaaaaaactcaaaatagatcataaacttgaatgtaaaatggaaaaccatacaacttttagataaaaagcagaaggtattattcaggaactgtagcattgtgaagatttcttagacgtgacagcagaaacatgttccataaaaggaaaagttgataattggatcttattttattctatttatttattattattattattttgttttgacacaaagttttgctcttgttgcccaggctggagtgcaatggtgcaatctcagctcactgcaacctctgccacccgggttcgagcaattcttctgcctcagcctcctgaatagctgggattacagacatgtgccaccacaccttgctaatttttgtatttttagtagagacggggtttcaccatcttggccaggctgttctcgaactcctgacctcaagtgatcctcccgcctcagcctcccaaagtgctgggattacaggcatgagccatcttgcccagcctggatctccttaacaggatggaaagacaagctacagactgagaggaaatatttgtaaaccacatctgatgaaggaccagtatctagaatatataaagaactcttaaaactcaatagtgaaaaatcaagcaatccaattagaaattggatgaactacagaaagagacatttcactaaagaggaggtacagatggtaaataagcacatgaaaagatgttcaacatcattagcctttagaaaaatgcaaattaaaaccacagtgaggtagcactacccatgcatcagtatagttcaaataaaaaaaatagagataacacccaatgcgggcagagattcagagaaactggatcacttatacattgctggtggaaatgtaaaatggaatagccacgctagaaagtagttttgcagttccttttattcattttttattttttgagacagggtctccctctgttgcccaggttggagtacagcggcgtaatcacagttccaccatagcccccatctcccaggctcaggtgatcctcccacctcaacttcctgactagctgggactaaaggagcacgccaccatgcccagctaattttttgtatttattttagacacagggtttcaccatgctacgcaggctggtctcgaactctggggtcaagcgaggagcctcccgctttggcctcccaaagtgctgagattaaggcatgagccactgagcccacccctacagttccttttaaaactaaaagtgggccgggtgcggtggcttatgcctgtaatctcagcactctgggaggccaaggtgggcacatcacaaggtcgggagatggagaccctcctggccaacatggtgaaaccctgtctctactaaaaatacaaaaatcagccaggcatggtggtgtgtgcctataatcccagctactcgggaggctgagacaggagaatctcttgaacccgggaggcagaggttgcagtgagctgagatcacaccactgcactccagggtgggcaacagaatgagactctgtctcaaaaaaaaaaaaaaaaaaaaaaaaaaactgaaaatggacttgccatgggacccagcaactgcagtcttttgcatttatctcagacaaatgaaaactgttttcacccagaaacttgtacatgaatattactagcagctttgtttgtaagagccaaaagctagaaactacccacatgtctgtccttcagtgggtgaatagttcaactacgatacatgcataccatggaatactactctgcaacaagggacaaactgtcgatacacaatgacttggatttatgctcagtgaggaaaaaagaaaaaagccagtctctaaagtttacatactgtaccattccactgatacaaaacattgttgagataaaattatagagatgcagaacggattagtagatgccagggactggggatgtaggtgggagagaggagtttgaatacagaggggtagcacttgggggcctagttatgatggtacaattatcttaattgtgttagtagttacacacagctatacatgtgataaaatcgtatagagcaacataaaattaataacaaatacatacacacatacaaatacatgtgtatgtgtatcaacctgaataagctctgtgggttgcagcaatgccagtgacccagttttgttattgccctatagttatataattgggggagggagggcaaagagtgcctgcgacctccctgtacatttctttgcaactttcttattataatttttttcaaaataaaaatacatatacttctctaagaaggataataaacctagaaggaaaaactgaaatgtgagaagtaatggtgagaaaataaattagtaaacatgtttttggaaaacctaaatgagcataaatcctaataaatcatgtaagggggttaaaagtaaggcaaaataaaaatacctggcagaaacaataaaagaccagagagagtgatcagaatgaaagcatcctaaaagtcctcctattttctagaaggagactgatagccatatacttgaaatatttttatgattaaaaggcagaatggtatctaaacctacgatgctattttgatatgaggtgtcatttactgagcatctgccctgtgtctggaaacctgctaacatcacagtctctattataattctgaaaggaagtagctttttcctctttttattgaagagaaacaaatgccaaacagggggtgaataaagtacaagttagagcggtaagtggtaaagtcaatatttgaacccagggctctctatctcctaagcatatgtgcttttaacctccctgtcccctcttgagcataatgaatatggaaataatgcattttctaaaaggaatgctgcagtgttttgaaggtgaagtagtcttacattttatagaatgaaatatgaaatcatctccaaactatgggcacaacagaaagctttcctatcttccctttttatttgatttcattgaccaaagtgtggacaaaactgattacaaaatagaaggctttcacatcttccctttcctttcatatcagctccaaacagtcattgtgaagccatgtgtcccaggaacccatcattcaatgagttgtgctacttggaagaatgacgagcaacaattcacattcagatttggtgttttcttcatcaagctataagcatagaaatgaaatttttgacattgtcccatatggatgagaaaagaaaaagtggtattttgaagatcaaagaaaaccacaaatctatggatgtcctatatgtaaatcttgtttctgtttctcctgatgctaaaatgttgaattctaaatatgcaaaggtacattcacacacaaacacacacacacacacacacacacacaccatacaggatgaacacacacattgctaatgggtcctagaaaaaggtgctagggcttagttgcacatgtttgttgacaggttaaaataaaagaaacctgaacacgcccctctgggtctatcagtctttttctccttttagctaaagctctccagtttatacaattgaaaagagggagtacttttatcttacctgaaacattatgcagccaaagcttctatttactgactcataaaggattttatgcctcatctgttgtacttaagatgactatagagaatataccagaaaaaagatttgaaatgtgttgccttctgaagttagaattataatcaggtgtattattgaacaatcctactttccttaatgtgtacagatttcagcattggcaggaagtattgaagtaaacccaaacacagcattaagcaaaatgtagcctcaaactctaaaaacatgtacaattgccactcctctgtgtgaagacttcagaatgattttgcccaactctttcataatagtttcatctgatgaaacaacaaaagcacctgtcactgggtgagcgcagagccttctataaaaacatcaggaacattctgatcccagaactaccatcgcagctctgtcatggaataagccagagagaccctgggcagatctcttctcctttctagaccttaattttctccatctataaaatcctgacacatttcccaagaagtctgagaggaagattggctttatagaaatggttctgaacagcaggatgtctcgtagcaatgtttaatcgttggtgatgataacatgggagactatttactttgtgtccttgatgaagatacgtgtgtgtgtgtgtgtgtgtgtgtgtgtgcgtgcgtgtgcgtgcgcgtgcgcatgtgatgaagtctcactctgttgccccggctggagtataatagtaccatcatagctcactgaagcttcaaaatcctgggttcaagcaatcctcctgcctcagcctcccaagtagctgggaccagagattcacaccatcaagctcaactgattttttcatttctatttttattttttgtagagatgggttctgattttgttgcccaggctggtttcaaactcctggcctcaagtgatccccccacctcagcctcctaaaatcttagaatgatagggtgtgagcccccacgcccagccaatagctattctttcaccaagataaaaccaaaggcaaagtatcagaaagaagaaactcatcaaaacgaaggcagacatggccataatattctaaaatgttcatgtcccattccattttagagttagtgttttcgaaagcgtgaccttgatggcagtccttaactgccattcctatggccatggtcatgaagagtggcctggtagccccaccttatccaggcggacccgtgaaaagcgtccacttgtatattggtttgtcgtgttcttaacaaaaaaataaagaggtttctgaattttttggtttaagaccctaagttttacatgaatggccaatataacatatttctcaattttgttattggtctaggttcatcttgagcaaaatattatttatatattaattttgagaggtcatatagcatgtggttaacagcatagactctaaagccagacagcctgggatcatgtcccagctccatcatctgccattgtgtgatgctggtcaaatcatccaactactctttgctccagtttcctcatcagtaaatggatataaaaataggacctacttcatagtattgctgtgaggattacattagttaattgtgcagtatagtgcctgaaccataacaaacacttcataagttgggggtatttttgtttttaagcatttcataaaaccaatgtgggaaaataaatcatgagctatcaacccaccctccgaatgtatatagatcctgaccacttcttacatcccctactcctaatccaccaccacctcttgctgggacttgtgcagtagccacctaactggttcccctcttatcacgagcagtctccacagggcaacccaagtagttgttccaactcctgagtcacatcacacctttcctctattcaatatactgcgtggcccatcatttcattcagaataaaagagtacaagccttggctcatcccctgccaccctcctctcacctctctgctccaattcctggcatcttggcagcttctttaataacctagtttattggcaacaacctcaaggcctttgtactttctgttcttttttgcctgatatgttcttctcctagatgtctgtgggagagtggcttctccctcatcaatctttattcaaacaccatcttatctgaagaagggctctctggccacaatctctgaaatatcctttccttccctgttaaatttatctctaacctgccttatttccctatagaggactaatagccacctgatatagtatacgctcattcttaaactgacatatgacctgtctcttgctaaccagcatcggtggtccatgacagcaactatcttgttttgttcactgctgttttacaagctcctagtatggtgcctgcacatagtagatgctcaataaatatgtgttgcattagttaatgaactggcgtggatgatacagtagtttatattggactttcgaagcacttttacatacacagtcttatttgatccttggaaataagaatcacagggggacagattttttttcttgcccctacacctacaaagattggctcagatcccaaaggggcttccattttttccaaaaccaagtaccctgacaccactttacttttgtacttatgtcaaatattactattttatttgactgagtttaagttgcatcatttaatgtactcttgagataagcaacagcatggatgtatctcaagataatgatgcagaatgaaagaagccagaccaaaagagtatatactgtctgatttcatttcttcaaaattctagggaatgcaaattaatttatagtgacagaaagcagatcagtaattgctcaggggctggaggaagggattacaaatggcccaaaggaacattttagggtgatgcagatagtcattatcttcattttggtgatcgtttcataagtatatccatatatcaaaacttaccaaattgtacactttagatgtgtgcagttttttaaaattttttatttccataggtttctggggaacaggtagtatttggttacatgagtaagttctttaatggtgacttgtgagattttcgtgcacccatcacctgagccatttcactgaacccaatttgcagtcttttattccctcacccctctcccaccctttcccctgagtccccagagtccactctatcattcttatgcctttaagtcctcatagctcagctcccatttatgagtgagagcatacgatgtttggttttccattcctgagttacttcacttagaataatagtatccagtgccatccaggttgctgcaaatgccattaatttcttcctttttatgtgatattccatcatatatatatcacaatttcttttcttttcttttctttttcttttttctttttttttttttttttgagacagggtctcattctgtcgcccaggctgaagtacagtggtgtgatcttgactcactgtaacctccgcctcccgggttcaagcgattctcctgcctcagcctcctgagtagctgcaattacaggcacccgccaccacgcccagctaattttgtatttttagtagagacagggtttcaccatgttggccaggctggtctcgaactcccaacctcaggcaatccgcccgccttggcctcccaaagtgctgggattacaggtgtgagtcaccatgcctggcctataccacagtttctttatccattcattgattgatgggcatttatgtaatttattgtacattattttgcctaataaaactgttttgaaaacagagagataccttgcccaaggtcacacacatttttctgcaaatcttgactgcagtccatgtctgtggattcctggtatgtccttctgcttcctgtgttgcttaccaggtgggtaatgaggctcagggttttaacagtaatgatacccatttacaataacatttatttatgtattgctctgtgctgaaaggagaactttgattttacactttgaaggtgttctctatcacttttctaaggctctatctcttaaatttagtgaaaatcaagtagccaacattgattggatagtatttgaggaactgcaggttaatagcacttttatatgaacaaattgagagaatttaaatgatttgaccgaggtcatcaagaacagcagctttggcacaggaattagaaactggattgcccttgcattttgtttttcagcataaaagctacatttctgttctctccattctttatgggcaaattgtaactctttttccccccaaagtacctaaaataatctgtttctcacagtccttcgtgcgtgtcttctttttctcgcttgtgaataaggtgtactaaatgcctcccagcacacacaggactcagtgttatgttctttttttcctctcaattcaccgtgtaagagaggcaccacctattaaaaacaatatccacagacctgaagtcagcaaagatatcagaatgtactgtgcatgtcagattagggctgaaattccaactatagtgtttaaatggggactcattttaattaataaatttggtcctgacatgcaattgctcttcacttgatcaatattttgctattcagttggacaggtttttttttaatttactgctgtgtgtgactgagttcctacttaatattcattgacacaaaaggattcaaagagaagtcagcctaactctcaagtaaacagaatagaacagatatacatgtgttttgcaattgcaaggaaggtatactaattttgagatacttgagatttggggctttaaaaataattaatggatctttatagttcagctttacatttattggtttatcccttttattgtacttacattcccaagacccttggttgattattttacaattgtgattttaaatgcattttgatactaactgctacttacaggatatacttggtgaattctttcacatattaacattactctctggtttatctattatgagaaagtgtgtgtttgtgtatgcatgtgtgtgtgtacatatacacacagatatataaattttcttaaattgagacatccttttctattatatttgcaagtatcactaaagaatctgagtcacacctattctggcagagagaaagaaaacaacggaaaattaaagctccaacatgacttttttttttcattcgtgtcatggctctcatctaattgaacactagtatgtttccttgggtcttgctgtaaacattgaaaacttttagttttctttggattttggagactagatacgatcagtaggaaatcgctaatgggaattgatgcttttgattccagccaagcataccaccgaggtcacagaggtaacatccaactcgtacacaaaacatgccttataaaactagagcatcgccgagggtgggttagtaacatctgcagaggaacagccctacctgtgctgccagaatcatcagtgtaaccaaaagttgttgtgtttgcagaattctaaaagaaagatcccgtgtgatttttatgtttgttataattttccattaagattgtgagaatatcacaaaaatgtttggtccaaaaaaaaaaaagagaagaaatctgaatcttctaaaaatatttctattattactggtggcattcgagccatgtctcatctgacttgcttgtcagtcttcagcaatcatttgggactatttcgagattggatgacctcatgtttcagctttaatgccacattccccctcaagctactggcctatgttgacaaaatgactagatgactagaaagggattatctaaaagcactgtttccagttcttctcctgtcatttctcttggacccatccattgatgccttcaatccctccactccacagaactcgggtccaggtcacagatgattccatgggttaaccagtgcttgcttctcttgactgccaacacatcacatggtagaccatgtcccatccttaagacacacccgtctcttggcttcctggacatctcttccatctcacaagcttccttatgacctcactggctggtcctcctgggtctcctttgttggttgcatctcattttctcatccatagacactggcttctgccctagacctcattgcttctctatattcatgccatcggtgtgaatggatcctgccgcatggtgccaaatatcagctataggatgatgaccgctgtagcctggatgtgtcctctgaaatacagattaatagttcagatcatctacttgacatctcaacctcaacaagtccaaaaaatgaacttcttatttcctccaataaaactatctcctcccacagttttccccatctcaataaattgtaaccctgttatgctagttgctctcaacaaaaccctttgcatctttactcatctttcgatctcatttcatatctaatctgatgagaaatctcattcactcttcttccaaaatatatgcacaaatccagccacttctcaccatctctatctaaccctgcactcaggtccaacccaccataatcactttcctggattattgccttaactcctggtggtctcttgagtttagtccttgtcccttgtagttaattctttttgagatggactctcgctctgtcacccaggctggagtgcagtggcatgatctcagctcactgcaacctccacctcctgggtttaagtgattctcctgtctcagcctcccgagtagctgggactacaggcccagctaatttttgtatttttagtagagacagggtttcaccatattggtcaggctggtctcctactcctgacctcaggtgatccacctgccttggcttcccaaagtgctaggattacaggcatgagccaccacgcccagccccgtagttaatttttaacagagcagccctagccattgacctcatcttgtcacacctctgctcataatcctctgttgccttgcagctcaatcaagagcacaagggcctccaccatgtgatcacctaccacctttctaacctcttctcattccatttctcatctcactcatttccctccaaacacagtagctctctgctgtttctggagcacatccagcatacttttgtctcaagaaaacttgcttttccctttgcctccttcccccagatatctacaagtctcgcttccacacttcttccaaatatcttcacatcagcaggatgtgcaactactatgaataaaatagcaatccgcccacttccaccccactgctctctagtccccacaccctgttttgtctttttccctgtgtcttggcacactctacacttacttgtttatgagtttagtgtctatctacatcaatagaagctatgatctctgagcttaccatcgtatcccctccttttagaagactgaggtacatggtggtattcaaaaaatatttctagagtaaatgaaatccatcttttaccatacccattttgtttaagtgtgaagtttaatgcaatactgtttctctgtaaatctaaaacagtcctaagtttcatcaacagttctctattcctaaagaatttatttaaggatcaagataatagtccagtctgctttgctttagttgttcctccttgcataagtatgccacataggttgaattatcttgtcctgtggaaaggggacacagactattatcctcccttttgttatgcttgttatataagcataatgtttacatatgagctgaattgctactatagaaggtaaagctgacagaatgcacagatgctggtaagggaagcagattccttccacctggggtaggtgctcaacttgtttaatgcatgttatgattggggtagctcagtatgatgactttgcttgataagttcctcaggtaacaaagcagatgggagggggtacttatagggttgattgcttttttcccagtgccttgagttggaaagccaacaattgtcgttttgatcatgaggcatttagggggacttctacctctgtatgtaatggggagagaaaggtgatttatggtgaatctggaagcaggagttgtattttacaggtggtgatgggaagatctggggacatggacccatcggaggatgggcaccttgtccttgcggactcgccccacccaccactctcagagctgttcaaatggggccctgcatggtttcgccaccctcagacatttgttctttattgtgtgatcttgtggttgagaacagaagtgactcttaaaaggcagcgccagaacttcaaaaggaaatgtctaggaggaagtagccatgtgtgatgcctcttaaatgcctctttagaaggtatcagaggagaacaaaagataaaggtacaaccaaaaagtcttctggagttttttaagggcggattggaaagctaggtttgtgaagcccagccttggagatttaagtcatgggaatgactgtccccaagatggctgctcttaaagtccctgcatggttggaggcccggcagtctggagcagcatggtagcctgatctctctctttttttttttttttttttttgagatagagtctttctgttgtcacccaggttggagcacagtggagtgatctcggctcactacaacctccacctcccaggttcaagcgattctcctgcctcagcctcctgaatagctgggattataggcacctgccaccatgcccggttaatttttgtagttttagtagagacaggatttcaccttgttggccaggctggtctcgaactcctgacctcaggtaatccacccaccttggtctcccaaagtgctgggattacagtcatgagccaccacacccagccacttgatatcttgttaccctccttgcacctgtacttccactagcagtgactcttctttcccacttgctcttggggaaaaaaaaaagcatataaagatacactttacagactttacaaacattagataagccttacaaacacattgtaaaaacccccttccctaccagaacacaagccaccaaatgacctagatctgaacatgaggccaacagatcggtctcaacccccttccgcctttgcttgagactcacacactcttgcacactcacacacaagactgtgatctgagcactcatccccagccttagagaattgggcccttttcagtgccatctctctggaccctcaaaagcagtagctccctcaggaacccctttattgctctggccagggctgagagaaggacattccagttctcccacaggggcagggtgtgtaaaggcagaagacacagacaaggctgccagcagatccacaccctgtggcgtgggcctgaggacgtgggaggagctgtgctgggaacagcagggagacccagggaggggagtgggcagagagccagggactagcctaggaagggatgatccggctggctgctggcttcaggctgcagtcaggctggatttgcctgagagtgtccccagggcagctgtaccctgttacaagggaggaaacttttctaacagccctaggaaagcctattgaaagctttcagtagtgaaccagagactgaacaaataacgacgtaattattacataacagtaacaggaaaactttagagcgtaaatggtaacaaaagttgttccccaatatataaactttggataccctaaaagcagctcagcgtgactcagtttttgctactagcataaaaccaaaaataatcagatccctgcagaagtagagggtactcaggtatccacctccatagcactacttaagaaataaaaataaaataacctgttcatagagtggacagcacaacttgaatgccaaaaggcagagaaggttctgttcctggctttgatgctgacgcttgggaaacaccccttgtctttctgcatcacacacaagcctgcctggggcaagaatccagaggcttgtatatgcccatgtctaaatatttttaaaggtataaatcaagctaacaaactattagataaaatgtgttctatcctcatactttgacaaatttaccttcacgatgaccgaggatgccagatttgattttagacttctctgagccctcacagttgtgggctggatcatgtgatcaggaagggtcccccccacatcccagcctgcagcaagccatcttccctcctcttcatcctccctccagctcccttccgctttgcaaggaggctcaggcacacgtgagtgattttcctcaactacacgggcaggttccctccatgtgccctgcaaacagcattctttggtcacccctcagtgtgaggggtgcatacaccaatgtcaggcaaggattacgggacaaggactcccttcccagactcctcctccattccacagtttgacccttattccttcaggacttatacccctaatccctgtacttccatcaagtcagtcacaaggatttagggaagctgatcatttctatgagagctggcaatggatggattaggttcctttatgttttcaggtcacgtaagagatacagcgagtcttttgttttttttaagagctccaagatgaaggccagcgtgatatgaatttcctcaaactgcccacacagtctttctccccaccctctggggaaaaaaatctgagcctccccctcagatacctaagaagaagctgagaaaaatctgcccagaagaggaacagctgctgagagcctgcctcaccctccctggctggccgtatttccaactttgttgccttcttcagtagatctggggaacaaaaaagcaaggcgtgaaatttgagtgttcccaagtctctctccatagctgcccgtgagcagtgttaccttttgattgaggcactcacgcttgagggccacatgaataaatgcacgcctaagtgtgagggtggcaaagaccaatcattcacagactgatgggaattgtttccctaaaatattcccctgagctgctagaaagggggtgatttccacgagagcatagactgatgcggactagaattgctaggacagggaacccccgtggacggctggccattgagacacagtggagaggaaggagaccatggtgtgaagtctacgaatgagagtgaggaaaaggaagaggtgggaagaagtggtacccaaggataaggctttatggaatctaagcatcccacatttactgtttttaaaaatgagcttgaaaaattagggtgtccgtcctgtgaaatggaatcccacagccacagatctgctaacatttgtttatatttgttgtcaaagaatagcttgatttttttttttttggttattaacataacttaagtggaataaaagtataaaggagcaagcaccatggttttctgtcatctcctctcctcttttcttttttcttttctgagacagagtgttgctctgtcacccaggctggagtgcagtggtacaatcatagctcactgcagccttgatctcctgggctcccgggtcctcctgcctcagcctccgtagtagctgggactacaggcatctgccaccaccaataaaaaaaaaatgctgctttttttttattttttgtagagatcatctcatcatattattcaggccggtcttaaactcctagcttcaaacgatcctcctcccttcttgtcctcccaaagtgctgggaatactggtgtgagccattgcgcccagccaacactgtttcctttccacttggaaagtagtttatcctggaaattcctgggatcccgacttttgtttaccagagtggaaaagctaatcaagttgatacttccccagtatctttctcccccaacttgaggaccaaacaggttgtgccttttcaaaaagaataattttttcccaatagtagaaaataaatcttgaacaataaaatttatacacttcacattgatgctttttaaatctacacgcaaattacataaaaaatagcacttcatgctgaaaactttctaaagatatattcactcctctgtaataactactggttatcactacgtaaaataccaatactttagcacacaagaaaaattttagattaactcaggcagtttctcactaaagtccataatctctgcgcctaaatctgctaatcactgtaattgaagaaaatgcaggaagtataaatctcctagggggcagtgtttgtaaccctttttaaaaagaaattacacccagagtctttttgatagtttgaaaacatgcactggaaactgttgcatatccctaaaaggccaacttttttttttttcctggggccatgattatttaacttttacatttttgttcttatctttaagaaaatctctgctgggtgcggtggctcacgcctgtaatcccagcaatttgggaggccgaggcaggcggattacctaaggtcaggagtttgagaccatcctggccaacatggtgaaaccctgtctctactaaaaatacaaaaattagctgagtgtggtggcaagtgcctgtaatcccagttactcgggtagctgaggtaagagaatcgcttgaacccaggaggcagaggttgcagtgatcacaccactgctctccaggctgggtggcaacagagcaagactcgtctccaaaaaaaaaaaaaaaaaagaaagaaaatctcattctttctgacctttgctctttgctttctataaccactcatcagaagctaagggccataactacatccagatttggcctcctgagtcagatctgagtgctctgtgggaggggaactattaagacagctctcttttgtcacttttaaaatgatttttctttaattttttgaatggaaaaaatacagaaaacataatatagtaataccataaacagatgttagtgtctgtttaatgtctgagaggcagaatggtacagtggtgaagacaattagctaggtaagtcacacaacttacttctctctgcctcagtggtcctcatctgtgagatggggataatagtagtgacctcatacagaagattaaatgaattaatatgtggaagagtttggatcagtgcctggcacatagcaaatgctatataggtttttgtcagattttaaagagaaaaacatgtttccataattgcttgagccctcttacacttttaaagtaaaatattgtaaaacccctgcactttctttccccatcctttgccagagctaaccacatgctggagttggagagtgtaactaccatgcacattttgggcttccactatgctcacaatgtatattattgttttgtgtgttataaagctttacttaaataggatcatactgcacgtatccttttataagtttcggtgttcactcagcattatgtttttgagattcatccatattgacagagatggttctagttcataatttgttaccgctgttaactgttccaatgtatcaataacccactgagaacaagcagatgacaaacggtgctacaatgagctccatggaacaagtgtccacatgtgagattttctctgcgatggtcagcttaaaagacgtagctaggtatgggaggcacctcttcaacttcatggatagggttcaatagtgattatgcaaatttacactctcaccagcagtaaataacaggctgtattttcccacatcctcaccagtacttgaggctgttatattttctgacttttctctatgtgacgagaataaaataggatgtgacatttttcatttttatgtccataattactaatttattggccactggagtttccctctcattgaattgcctatttatatccatttttggatatccattattgtctattttcttattgctttataaatgttctttaattattctgaatgcaaatccttggtagagcatgtgagttgtaaatatcttctctctgtggtttgtcttcattactttgtttgtaatgtcttttgtagttcaaaatcctcatttcaatgcagtttaattaggtaatattttccagcatagtttatgatctttgtttctttttaaagtccttccctgtaccaatacactgggagacaacaccatgtggtgtttttagttttttgtttatgcgaagttttagagttgagcttctcacatgtatgtctttggtccatcaggaattgcttttacttatggtgtaagaaagggatgtattttttactttttccatatggaaaaccaattttcccgacactatttattgaatagtcatttctctatgggtttgtatgacctcttctgtcatatatcaagctctcacaaagtctgtgtctttgtctaggctctctgtttcattgcgtagtcttgtttgtcctatccgtgtgccaagccacactggcttaatagtgctgatacctggtggagcaagtaccccctcttattattattcctcaaaattgccagattgatgttataagtggttttgtttgtttgtttgtttgtttgttttgttttgaggtggagtcttgctctgtcacccaggctggagtgcaatggtgtgatcttggctcgttgccacctcatgcctcctgggtttaagcaattctcctgcctcagcctcccaaggagctgagactacaggcctatgccaccacacccagctaatttttgtgttttcagtagagacagggttttaccatgttggtcaggctggtctcaagctacggacctcaggtgatccacccacctcagccttccagagtgctgggattacagacgtgaaccatcatgcctggctgtaagtggtatatttttattaaactgtattctctattttttctagtatttcaggttgctgtcaatcctatatattgatcctgtatcattcagttatattgaatagttataatagtgtatctgcagatttccttacattattatattgtctatgaacaagtaccattttggctatctctttttaatccatattgcctttatttctttttcttatattcaccatgctagtgagttcttaggatgcagtgacagcaaaaattccaaattttaaaacaatccttctaacatttcatcactgagcctgatacttgtttgaggtttttgctaaacataagaacattctttttaatttttaaattactggtttttaaaaaagttatgaatgtgtgttggatttttcttaacatttagctgactctgttaagataagtgtatagtttttttatttatattgcagaaaattttagggctggactgtctaatgtgaaaccagccttacattcctgagataaattattttggatcatgatgtgtttgttcatatattgctgtatttgctttactaatattttatttagggctttggatttgaatgtaaaatcccttcttattctatgtcttcgtctgttctcatgctgctaataaagacatacctgagactgggtaattgatcaagaaaagaagtttaatggactcacagttccacatggctggggaggcctcataatcatggcagaaggcaaatgaggagtaaagtcacatcttacatggtggcaggcaaagagagagcttgtgtaggggaactcccttttataaaaccatcacctcatgagacttattcactatcacaagaacagcatgggaaagacccacccccatgattcagttacctcccaccaggtccctcctatgatatgtgggaattatgggagctacaattcaagataagatttggctggggacatagccaaaccatatcattctctctttctaatatcaaggtttatactagccttataacattaattgatattataatatttgatttaaaccacagctcatcttaagtgttagaattcagatacagttatagcatattcgtaattagaatagtgttcctcacagcattttcttataatattttctcccttaattgttgagtaacctttgagatgaaaatgaggactcaactgatgttgctacaagttctgttgtgactttacattatagcttcttcatggacaagtttctaaatatccatgcaaagggacaagaagacctatttggaaggaccaggaggatcacagcactggaaatcagcatctttcactcagtctgaattccagaaatcatcaattgattctttcagccattgtttagagaaatgccttgggatgctcatttcaatgatattaacattttacttgaatcccaattgcaccaatttgtctgaaacaaaacaaagttaaaggggtaagccccagggctttctgtggagaatgagtgcctccaagcagaactctgcccagtgactgccctctgtcaggtggttatggggggcaagacactctctcatattacttcctatagatttaactttttttttttttttttttttgagacagagtctcgctctattgcccaggctggagtgcagtggcaccatcttggctcactgcaagttctgcctcctgggctcacaccattctcccacctaagcctccagagtagttgggactacaggcacccaccaccacacccagctaattttgtttttgtatttttagtagagatgggagagatggggtttcactgtgttagtcaggatggtctcgatctcctgacctcgtgatccacctgccgtggcctcccaaggtgctgggattacaggtgtgagccactgcccctggcctagatttaacttttaacatgttctttcagggtgctaacataggtttcctcacacttatgagtctttaaagcactttttttttttttgagtcagagactcagtttgtcgcccaggctggagtgcagtggcacaatctcggctcattgcagccactgccttctgagttcaagtgattctcctgcctcaaattcccaggtagctggaattacaggcgcacaccaccacgcccagataatttttgtttttttgttttgtttttttgagagggagtcttgctctgtcgcccaggctgaagtgcagtggcaccatctcggctcactgcaacctctgcctcccaggttcacgtgattctcctgccttagcctcccaagtagctgggactacaggcatgcaccaccacacccagctaatttttgtatttttagtagagtcgaggtttcaccatgttggccaggatggtctcaatctcttgacctagtgatctgcccacctcagttttagtagaaatagggtttcaccgtgttgcccaggttggtctcaaattcctaacctcaagtgatccacccaccttggcctccgaaagttctgggattacaggcatgagccacagcacccggccaagggcacattcaaaattggaatttagcttaaaattattattgcctggaatttctcagtccttcataaagattcgtctagagactctcaaagtcttacattgtcctcaagtatcaggtcactaagtgaaataaaaaaataattgacagatagatccttcttgaatacagcaaaaatttggtatttacccaattcaagataaaaacagtgaaatccaagagtaaagttattccaaattttttttttttttaaatccagactttctgcggagaatgaattttctattatctttttcttctttgcaaggcaattgtcatcattctgctttgtcacctactttaaaagctatcctataggaagggacttaacagcgggagagttctctctgggatttgagaagttactgacatcagaaggtatcctagagccatttgaggaacacacacacccttgttcaaatcgctgctgtgtttgaaacaaaatgtcagctggtgttaggtaagaattgctaacttctaaagaatagtgtcatttatagaaccactgcaggggttagaacacagaggatgaccagaaaacacctccaagaagaaagagattgagtgagacttttttgattgcttttgtactcccgagttcctggcacaggcctggcacaagatgggaacttgtctagtgaattaatgaagccatttctaccgttgcctctagggtacctctaagtacgttatattctttgtgggtgttgtttttctgttctgttttttgtttttgtttttgctttttttgagacggagtctcactctgtcgccaggctggagtgcagtggcatgatcttggctcactgcaactccgcctcccaggttcaagcaattctcatgcctcagcctcccgagtagctgggattagaggcacatgccaccatgcccagctaatttttgtatttttagtagagacggggtttcaccatgttgcccaggatgatctcgatctcctgaccttgtgatctgcccacctcggcctcccacagtgctgggattataggtgtgagccaccgcgcccggcctctttttagttttaaatcataagactcttgaatacagtctcttaaagatatgctactgtgttaactgtactggaatcttttgcttaccttaaatgtcaatgtctttcccatttcagatgccagtgtacattctaccaactctactgaaagcttttatttgagcagcccttggcttatttcctctggcttcaaaaattacccagttaactgagtaggattcctaactggccagtccgtttagcgattttttagatgaaagttttagattttagtgcagaagttgtctttgaagattatcaaatcaaaacatccttattttagaaagatgatacagaaaatcataaggaaatctgagtgaacttaccacccttcacattttagggtatagtcatcaggtatttcaggagacttaacttgaacctaacgaaaccaagtttcaggcccctctaaatataaatgttcacttttatacctaagtttctgtttcaaatgttgttattcttgttcttaaagaggccactcaaaattgtgtaagcttcagggctcacaaaatgtggggtccatcactgtcatcaaggtgattaattgatttgtataaatctagttcctttctgttttatgatatgctttgtcatttaataaaatacagttttttcacattgccatattctcttacaattgcttttcataactgtttagtgttccagtgaacagatttattaaatgaactacttattaaatcaatcccctattgttggagattctccctcaccttatattattcctacagttgatacttcattgagtgtctaggtaaggatgtcattgtgcctaaatgtgtaaaagttgaattagtgcttcaaaccacatgtgtactttgggggcttttgatacattgacaaataacccttcagagaaatggtatcaacttactttcccaacagtgatatgtgggagtatccattttcccatcccttgtcagcactatttattgtatcaacctttgccaatgttgtaggtgtaaaaacttaccttgctattttaattttaatatttttcataagttgaaaacttatttcccatcagaaaacgcaataagaatcctttatatatttaaggcattagccatttgccactggtattgcagatggtgatctgcatagtcctaaaatggatttggagaaactgaggcatttagtttatttggaattgtcaccgtcagctgcctgcagaagacgcccttcagggaaaatggtattgctattccaaaaggcaagcatacatcatattcacttggccacattacaggaataatttaatgtgtttcaactaaaggtatctgagcgtctactaggtacctaactctgtactctatcttaccatctggtgagggaaactgtatacaacaaaccataatgcaggattaaaagccacgcttgcagccaggtgtggtggctccacctgtaatcctagcactgtgggaggtcaaggtgggtgaatcacctgaggtcaggagttcgagaacagcctggccaacataccaaaaccccgtctctactaaaaaaatacaaaaattagccggacatgggggcatatacctgtagtcccagctactcaggaggctgaagcaagagaatcacttgaacccaggaggtgtgacgttgcagtgagccgagatcgcaccattgcactccagcttgggcaacagagcgagactctgtctgaaaaaaaaaagtcatgcttgcagtctcaacaaaatacaatatgagcacatcggtgaggtaaattaattccttcattcctgatgaggaaatgatggagtagtaatgggggaagattgttcagaggacttgatgtatatgtgaagcaaagaggtggtgagaagtgcgtggcgcagcgtgtgggatgaatgtgcaccgtaagaggtccagtcccactgcggtgccctagcaaagtgggacgcttcgggaaaataaggcaggaagaggagttgaggtcacatggtgaatatccttggataccatgttgagataaagatattttagaagatgtcccacattctggaactgattctgagacgcaaaagataatgaagatgtgtgggcacaagtgtgacctgccaactgcaccctgctttttgtaaaatgtgagtaagagatcttggttaaaatccacattcctttgcaaagccatggaggtgaaagaacccttcagtgttcaggcttctcagggggacactgagcattgcaaggttcatatcgacactcactctggcacaggtttcagagctcggcacctccccctcccaccccacacccccatccagcatgtggatccattctaaccctgtgatggcattcccttcggttgaggtaaagacgggaatcttttttctgagctgcacccagcacgcttcaacatcttcaagcagatggtcagcctaaaagtgtgaggatagctcaggttgccctgagaggatgcttgcaggagatggacagagctaaatgcaggatttcaggagaagtatgcttcaagaaagagagcatggcatctatgaatttggcagaagtggacatatagcttctgccaaatgatgagttgtaacttttaggcaaattgcttggactttctgagcttttatttccttatctgtgaaatggggtcatagtatccatctgacaagagatactgtgctgatgagatgaaatacatacacatggtttctgacatatggcaggcatcctataaatgcatttctctcatcctcatcccttcttcataaaaagggagtttgggaggcagagtcccctggacaacctctgggaatctggagcagccagcactaacttggagcgaggaagcctgtgccaaagcatgcggaatctctagaaaccatgtgggcttttgttcatcatcatgccaataaaacgccatcggatattaagagaattccttctgagtctaagcatttctaaatacctttcctgaattgagaaagcaaactgtgtaaaagccaagcgtgaaaagactattctgtttgcaaaggcatttttcccatcctgcctggcttgtcacgttctgtgactggactcatgcacccagctggcagctgcaccagccagaccctgaggtaactatagtttaggcccattttttttcctgctccagagactacaaattctatttcaagcacacgcatgtacagaatgcagatgtggggatgaaaatcagaccatcttctgggagcgaggctgtgatacttaactgtagggacgccattggtggcctttctgcagtggcctcgcccaggcatggctggggcatggacctcaagagcggttttggccttttgatgtaccatagcaatcacatgggacaatcaccacacatcccacgtggggccaagacattgcgtgatctgtgatcagacaggcttaaaaggtattctccgcattctgaggaatttgtaacagcatggagattctggaaaactagttccctgaaaaagctgagggtcaacacagggatgagtggagaggggacatggagcccttatgcctgacatgaagggactgctctagtcaaggaaacagccacttcagaatgtgtctctactgtggatacaaaccaagggcgaggttactaggctggttacatcatctagcaaaagctcttatagctcagatagacccacaaatgagacattccttttcaatgactaataaatcattcgtttattcattcaacaaatatttattgagaaactactatgtaacaggtagtctcataggtactaaggatacagtagaaaacaacaacaaacttaaaaaaaaaaaatcccttagccccagttacttgagaagattgcttgaagccagtagtttgaggctgcagtgagctatgatcataccactgcactccagcctgggtgacagagcaagaccccatctctttaaagataaaaaaaaaaaaaaaatctctgagctcatgaaacttacatgttagcaagagaaactgatcataagcaatatcactaattaaaatatgaattataacatagagtagaaaatgctaagaaaacagacataaagcaagtataagagtaagaaatagtatggagaatggctactaaaattctagctgaggaggctagggagggcttcactgagaaaccaactttatagagacctgatggtttggataggtatagacctagattgaaaatatttccctccaggttttcaaaggcattgctccattatcttttggtttctgaagttcctgttgagaaagctattgcctttctgatacctgatccttcctatgtgactttttacctgttctgggggcttttaggattttctgttttccccatcttctggaatgtctcagtgacaaacctgtgtgttgagtatttcataaacttttacaatctgcgatctcatgtccttcagtttacaaggaaaaaagaacattcttataatattgttttggaaaactctgttttttctgatctcttttacccaaatctccattactggggatctgggtactctgacatgattctatgtttcatattgctcttctctcttttcccatctctcagtctctttttttcggaggggaggtggcctccactttctgagattgcgtcaactttttcttcttcactgaattttaaaattctgctctcatggttcctagagactgatcttatcctccaaatgctccccctttttctggactgtttgttctcttccgagtttctttttcctgtttctttgggtgttttcatttgtgttagaagcttctataaaaatgtttgtgacatcttgggagtcagttaatgtaagagggaggcacggttgtaattttgggaagttttatatgtgggtctggctgcttcgctatggggtgaccagacagaatctgaatatgaccctcaaaaatctgtttgtcaggccagacatggtagctcatggctgtcatcccagaactttgggagtccgaggtggtcagatcacttgagctcaggagtttaaaaccagcctaggcaacatggcaaaaccccatcactaaaaaaaatatacaaaaaattagctgggtgtagtggttctctcctatggtcccaggtactcagggggctgaggtgggaggatagcttgaattcatgaggttggggctgcagtgagccctgatcatgtcactgcactccagcctaggcaacagagcaaggcaagactcagtctctcacatacacacaaaagtttgtctcttctcatgggtcattcagcattcctagagaggaccctccagtgtcctgactaaggagctggcccctttgccagcattcggtcgagggcatatcagccccttcccctatgcttggtcagccagaatccagtgtgtttgatgtggactcttccatcttctgtggatgtgatgggtggctacctggctgggtggggtgggaagagagatggacatttgctacatcagtggtccctagcctttttggcaccaaggaccggttttgtggaagacaatttttccatggacagggttagggggagatggttttgggatgattcaaacgcattacatttagcatgcactttatttctattattattgcattgcaatatataatgaaataattatacaacgcaccataatgtagaatcagtggaagccctgagcttgttttcctgtaactagtcagtcccatctggaggtgatgagtgacagtgacagatcatcaggcatgggattctcttaaggcgcatgcaacctagatccctcaccatgcgcagttcacagtagggttcacgctcctatgagaatcttatgctgctgctgatctgacaggaggtggagctcagacagtgattcgagcaatggggagcagctgtaaatacagatgaagattccctcgctcagccatggctcacttcctgctatgtggcccagttcctaacaagccaaggactggtactggtttgtggcctgaaggctggggacctttgtgctacaccattttaaaatcaagttcagtcaggcatcatgcattcaactcactatgcatttctaccttcagaagggttgggagcctcatttcctgagtttccctggctctgcctgttttatgttgagttattcccttgaaggtttaggtatcagcttgctcttgtctactgttagttcctctctcattcccttacttctttgatgtatgcttttgtatcccttattgtcactttaatggaatttctggaggaagcagagacaaatgtattacatgggctgccatattgaaccggaattcattcttttctcttttgagtctccctttccaaagtttactccagtggtagtagttcacccccagtagattctcacaaaaagcaagactcaaattcagtgtcaggattgtggatatcctgtttcagttatctgtttctgaataacaaatcaccctaagcatagtgacttcacatgacagtcatttatttgcttatcattctgcaatttggacagtgcttggaggggccatctcatttctgctggcatcagctggggtagctcacctggggctggggagaccactcccaagacggctcatccacataacctcagtggttccagctgtaaaatgggcgcttagatggggtggttcttcagcatgtgacctcccgtgtggctgggttggactcctcagaagctgagttctgaaaggaaacatccccaaaccaagctcaccaagaggacaaactccagggtgcaaacacatatcaagctttccttttgcatcacacttgctaatatcccattggccaaagcaagtcacacagccaagcccagaatcaacgtggaacagagctgctctccacagatgggtgagtgctaggaggcagggtgcactggggcccacataccccctgggaactctgggatcctgtgctttttccattttatttctgaaacattgaggtgccagattctagcacgatatgaacattcaataaatatgtattagaaccacagaaatcttgttgcatttccactgaaaatgtttctgaatggactagacagatttaagctatgtagcttacccatggctataatgattgtgttcctagttaatgaaagacatgaaaaaaaatcactctatgaggtcagatttctaaatatacctttccaaggaattaagtatcgtcctttttttttttttttttttttttaagatggagtcttactctatcgcccaggctggagtgcagtggcgtgatctcagctcactgcaacctcccaggttcaagcaactctcttgcctcagcctcccgagtagctgggattacaggcatgtgccaccacacccagctaatttttgtatttttagtagagatggggtttcaccatgttggccagactggtctgaaactcttgaccttaagtgattcgcctgcctcagcctcccaaagtgctgggattacaggcgtgagttaccgagcctggccaagtattgtcttttgctttaggctaccagaggtttgcttcttgcatgtttgtttttgagtcagggtctcactctattacttaggctggagtgcagtggcgcaatcatagctcactgcagcctgcaactctgaggctcaagtgatcttcccaccacagcctcctgagtagctgagactacagtcatgtgccaccacacccagctaatttttttttttccaaagagatgggatcttgctacattgcccaggtgggtctcgaactcctggcctcaagcaatcctcttgccatggcctcccaaagcactgggattacaggcataagccattgcacccagcccttgaatttttgaaaattaggctctttaacacctgcttggacttcaaagaacgaaggtgagtacttacacaataaccaaacagtgcattccttggaaattccaaacctagatctcttgttacatgcttgccaagcttgtcctgaacgttcctaagtgcagcaggaaagaagtggctcagcttgtgctgtgtgtcccctgagtcttgacctgtgactaataactgtttcctttgtgtgcaggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggtaagttgtgacatcattttttgcctgccattttgccttagagttttttttgttttttgtttttttgtttttgaggggtttttttttacccactatattgcatttagagtgtttttttgttttttgttttttgttttttgttttttgtttggtccatcatatccctttcatagagtttataccaaattctaatttctttatatcctagtgaagaaagcagattcattatcctgattggttgggcttatttcacccagtcagatgatttcactatctggttttctacaattcatttacagggtatagcttataaaaacgaggacaaatttctccgccacagatttttgaatgctacatctgaaaagaacattagaaatgattcagtccaccattttatctaagggttagggaaactaaggcccaaaaaggtagcggagagacctgatcgaggtcttaagagttgtaggcagtacttcattcatattggaactttcccaattccccctcaagtgttctttcctccatagaaagaccctgtggacattttaggtaatgatcccactgggtcgttatttacacataacaagttagaataaaagcagtgggctctgtattattttccataagaaaagagactgagaagcatcttcactttccattcatttcttaaagagttgtcctttacccaaagatcttactttccaggtggcctttccccagggcccccagttgaatatcctccaaaattaagctaaatggactcctgctattgatgggattgagagtcagttagaaacaaaagcatctctctctccctctctctctctctctctttttttttttttttttttttttttttttatgagacagtcttgctctttcgcccaggctggagtacaatggtgcgatctccgtttactgtaacctccgcctcctgggttcaagcgattctcctgcctcagcctcccaagtagctgggattacaggcgcccaccaccaggcccagctaatttttttctatttttagtaggtacggggttttaccacgtgggtcaggctggtctcaaactcctgacctcaggtcatctacctgcctcggcctcccaaagtgctaggattacaggtgtgagccaccatgcctggcctcatctctctttttttgaagacagggtcttgctctgtcacccaggctggacctcagtggcatgatcatgtctcagtgcagcctcgaccttctgggctcaaatgatcctcccacctctgccttccgagtagctggcactaccggcacatgccaccatatctggctaatttttaatcttttgtagagacagaatctccctatgttacccaggctggtctgaaactcctgaggcaagcaatcctctagtctcggactcccaaatggttgggattataggcgtgggccaccacacctggctcaaaagcatctttattgtcattttggtgtcatgtatacagtagaaagaactcatttgatctgttccaaccaaacaacctggaaaacaggacttagatcaacacaagcaatcagttgctagtatggtctctaaacattttagaactccacagattatttagtgactaatccagccatttcattttatggaaccagaaactcagacgcataaaatttgagggacttattcaaaagcacacagccagctaagtaccaagctctgccccaaatatggctgttcacacttcttggtcaagaactttttgatttcttcgaatgttccctcaccaaatcactggaggcagaacttggggtttctgagtccacaccctggggggaatagcaagttgccctgtttcttcatcatggaattaatgggtaccacttttaaaaaatatgcctctagtgcataataaatgtaaactgatctgtatctaccaatgatcacaaatgacatatttaggcatgtgcccaggtgtatgagtaatttagaactttcaaagtttgacacatgcctcaaggtatagatactacatctgtttcacaaccttacagctttttaaaaatgtgtttaaatattcatgggtacccaaaaattcatgtttgtttttaaactaaattattaatcaagctgtcaccaaaagaaattttttgcattcacaaagcgtaaacttgaaacatgaaataatcacattatatttaaagacaatgtttgtagtaatataatcccacatactgtttttacatggagctgccagttacaacaatcatcttacatttctgcctttgcaattagaggaattgaaggacacagtaatagcaagtaaacatgcaacttagggaagccacacttgattatggagctcaaggctgatgaggttattatgagtaattgggcctcactgtcttgcagcctgtgcaaggatttttatattacaatgagtcaccattttctagagcttttctcaagcttcaaagtatggctactttgccttcttttttacattgtttgggaaagtcgagaagtagtcacaaaataaaagaaatgagagggaggaaaaagaagaaaaggtcatgattctccttaatggaaatctagttgataacataaatgaaaccatcagtcaatatgttgatatttgtgaaaatgatgatcttgttgatccgtaagttgtagtatggatagcctaactttttttttttttgagacagaatttcactcggtcgcccaggttggagtgcagtggcatgatctcagttcactgcagccaccacctcctgggttcaagtaattctcatgcctcagcctcccgagtagctgggactacaggtgtgcgccaccacgccaggctaatttttgtatttttagtagagatggggtttcaccatgttggccaggtttgtctcgaactcctgacctcaagtgatctgcccacctcggcctcccaaagtgctgggattataagcgtgacccactgctcccagcttgatagcctaaagttatttttaaaaaactctcatttaaaatatttaagtggaaagatcaccgatttataaatttgtctgtaattttacttttcagttactttgatttaaataaaaaaaagaacctaaaaatgttcaaatgtagacaatgttttatttggtgatgacagtaatgtttatgctatgtgagcacatgcatgtcgcttccaaagaattattctatttcttgattttatgcattaaatgccttgattatattttatttgaatggtagaagaaattttcaccaccagcattatataagacaaaaaaaaaaaaggctgggcgctgtggctcacgcctgtaatcccagcactttgggaggccaaggtgggcggatcacgaggtcaggagatcgagaccatcctggttaacacagtgaaaacccgtctctacggaaaatacaaaaaattagccgggcgtggtggcgggcacctgtagtcccagctgctggggaggctaaggcaggagaatgctgtgaacccgggaagcggaactcacagtgagccgagacggtgccactgcactccagcctgggcgacagagtgagactccgtctcaaaaaaaaaaaaaaaaaaaaaaaaaaagacaaaagaaaagtatcatgtagatttcaactggagacagtgactttaatcttctaagttcagagacaaatttcactgcacttccttcagtgtttctgaagcgtgagcatatttgctaaacagttgcctatctcatcattgtgttaggctcctcatattttccttagggaaatgctatggagagttcaggtcagaatattgtgttgtaaatgttgccacagtaaatgcaaccccggcctttactgttggttcatctcagatgaatatgtttctaaagtcatgataaaccaacctcatgcattttaaatacctccagaatcacagttagtctttttcatggctcccgtgaggttttctagtttttcacgtcctcgcctgtgactccttcctctggccaaatggggagctcctttagtgaaaccccacatccttacctctgtgagtctccccttcatattcacccagccccctttaataacagggctgctggttccccctcaagccgacttctaacaagctactggagcaaccgtgcaagcttgggctagtcattgcttcaaagcaattactggcggatatttaaaggagaaagagaagactagtccaagaatcctccacttcagttaaaacagaaacacaagccagtaatcccagtgattgggtcagcccactaaatgaggctgcacctggaagagaggaattcttcctcctgcccacatttctctgagctagcccagccggcattggaagggatcacagtgtagacagagccaaaagggccttgggtggcccttctgctgatgaaagctgaacatggagggagagagacttcatagatattcatgtgctcttcgataattttaaggtaggctctgatcctgtcttttgctacgttatgacaccttggctctaagagccgggttcagagaaaaaagaagaatttatctgctgctatttcttcacatccagcaattcgatttgtatatagaaaaactaattttctaacccactatggaaggaaaaaaggcatggtaaagatattagatctttttggtactgtttttttttttttttctggactccagataccttttctttcagttgccgaaagtgtttgaaggcaaaaaaaaaaaaaaaaaaagaaaaagaaaaaaatcttctttcatgtacattcattagataagcagcaaaccaggtgtttgggaaaagtaaacaattaaatatttaaatatcaaccaaatctctttgaatgtattgtaaatattggaactttatttttttttttaaagccttagtttccatactcggaatcttgaaagaaagttcgtgccacccaacatttatgggtggggaactatactggaggaataatactttcttggggaacaagaaaaggagagaaaagctgaagtcatttttcttcttcttttccgtatttataattgcctattttatggtcacatagcttttgactggcgtactgtagatagcctttggattgtctgttcatgttttttacctgatctttaagggcaggctaaggaaatggccaaagtcaggcttctttcatctgccatagttatcgatgtttttgattccaggaacattcaagacagatcactcctcaaagtgtacaacaaggatcctgcacatgcgtttaatcacacaccaaaaactatgaatggagacatgagggtaagtgtttctgtcatatttttacttatcttcagtgggtcaaagcgtccctcctcttgcttgtactcctgatgtaatcagaactctacaactgagttttggagggttctccgcactcatctcacctagtggatcattatttgttcttggtagagaagtaagatttcctggttatttagggcaaagggattaaaataaggctggacacatcctaatttatctttaagcaaggagttatgtccttactttaaatgaattctgaaaatcttcctataaaagggtccctggtccacagtatattaactgactcagaagatctcttgcatttctttctccaattaaagcaaacctaacatacaaaaaggcaaacagcaaggtgcacaattgcatggaaaatctattcatactcttacattagctcttccaagttctaacattctaattcaatttctcaccttctaattcaggagctaccctggaagaattttgttgttgtactgtcttaaatattaccatatcctctctgagccatgctgaggtcataatacaaaaatccgcatgatttgggaactaaaattctctagctttagattgtctcaggagattatccaaacattcaaagcacacagggatgttttgaagaaaaaagaaggagaaactgaaaaagcagattttaagatcatattaatgcaggtccactagaaagggattgagtttctaaaaataaggctacattcctctgtagcaaaactgggaggtaaaaagaagattagcttctcagctgtacaccccctacacacacacacacacatttggaagacactgtgccattttttctcatcttttctacagattagcacttggctggatgctcaagtttagctagaaaaataaataaataaatgattaccttttattgccaaagaaacccaggcactgttctgtcttggagctgcagttttgttcctgagcgaggctgtctctgcttcctgatagtacatattagtttcctgttgctgctgtaataaattaggacaaattcagtgacttaaaacaacacagatttactctcttaaattttagagtctgtagactgaaagtctctggtctgacataaggggtcaccagcaggtatgcattcttttctggaggccctagggagaatcttttcttttttttttttttcccccaacttctagaggtcatcaacatttcttggtttgctgtcctcttcctccatcttcaaacccagcaagatagcttccctttgaccctgcttccatgctcacatccctaaccctcccatgtccacttttaaggacactttaaggacattgagcctccctgatcctccagaaaaatctccctatttcaaggtcagctgactggcaatcttgactcccccttttccatgtaacctgatgtagtcacaggttgaggggactaggatgcagacatctttcagggaccagcattctgctttccatattgggtaagtttagaaccataaaagaagccagcagatctagctgaaagtgctgggagaaggtctgtccttctggactggaatatgaatgacgacattgtgggatcagagcctacacttctggagggaaaggcctctcacgtactcaactgctgttatttttgtgtcagaaatgatgtgtgacttgaattgaaagctgtgtcgctacttcagaaattctaggattttcagccttattttgccagttatactttatgtgtaaaccagagccacatggagacagattgagtcatgccaatcgtgaagcatggactaaatattacagcaccatttgccttttattactctgttattctctttcttggagacattcatcaatgtcttcgctccttgaatatctttattttttgctatgtctagccttcaccctggagttccatggtgctgagagttctgttcctatcacatagagccatttccacaccggtgccccagaatcgcctctgagaatcttgtttgtggctggaaagacacctgttttaaccctccagcagctctggtacctacgtaaggaccagcagtgaggactgagagtatcgaatattgaccgtatgaacaaagctgatcaggatatgcagaacatgtgctgtgggtttctgcagagtggttctgttcttacttcaagatgaaaccctgctgatcactttttctgggttacccagagcctactttaagccctcattttgtgtgtgtgagaaactcaatcattgtccccaaatgaagggacagtaaatgttcaccatctaaccagcagaaaagcttttgtgtttcaatgcagattacttagaaatgagaaatagaaagcggtttcaaagccagctaggtgtgatcatgcctgcagtttgcaacttggttcctgttcacagattgcagacgctaaaaggcatggaattcagctgccctcaccttttggctctgcaggttggaattctttttcctttcttgatgaatgtggctgcattgccattaaagggcaggaagctttgttgagccctgcctctggagcccagctgcacaacccactgcccatggtggagaacagaaacagagaacagagcaagcatcaattgttgtagactaaaccacgctgcagcgtggggttagggaactccgtcctcccttatgtttgcaatgtgagcgtggccatgaaggaattcgatgctaactactcacatgagtcagtcactgcagtcctgcccctgatgtcattagacctcactccccagcctccagagacagcctggcacagacctcccagctgcctgcttatgaccaataaacatgcatgtcatgaaaaacatcagttggaataagcagaggggcaacaaaagtcacaccagaactcctcaggggctcctgagactttccttaaccaatgaatgtaatatcttgcctttgaaagaaaagaaaatgtaaaactctccatctaaaacagtcttcccagagcggttttatgattggaaatgtgttactcaggaagcgtgctagactaggcctcagagtgtgcgtggaatgcatgcttggtggggaaaacgtgtactaaattttcatctagcatctagctgagcatttttgaggctagtctgtctaaggagacttgtggttctcggctggaactcagcatacctggctcctgtttctctacccaccaccctgatctaatttaattgcgtggcttttgtttccttacatcagataggagctttgataattcagttcccaagggactgagctcaccatatggaacaggcccttttgcaaaatttatatatgtactcacagggttttaaattcacaaatgtacaacttgaagatggaaccattccatttcatgactctcaaaaagtacacgtttttccataccagcagtttgttgaaggaactggacaattctgctttgagggtgacttgctagtcaccaaacctggtggctttttcatagtgtgggggcttctccaccttcttgtgtgctttaagacaactttccaagactctctgctctcatcatttaatactctccctcttctctgcttcctttaatttctcttgcatgtctttgatttttacttgtatatagacaattaccagattggccctacctcttaaattattccccaatacccaaggtaactgctgcctcccacccctcttctactgatctttgtatttgacaccagtgaatggtccccttataaatcattggtctccatggcacttttgtgtctaaataccttgtctgcattcacagacacctcagcttccttcattccctaactcttcttcctcttgcctgtgtttaagcaggcttctctagtttggagtttatttgttttgtttttttaaatttactcttttttatctgaacctttgcacttgtgatttttatcttaccacttgtttgactattacatcagtgtggttgacccttgaagccatatccctaactctgccatctctagaattcaagacccaaatgttcagcttctaagtgtcttcatatggagatcatttccgtggtttccaatgcattctgttgaagaaaaaattcctaatcttttttccactcaagtctttatccttcttgattaccttttgaagaatggaggggctatgatagggtgtgtgtgtatgtgtgtgcacatgcatgtgtgcctgtgtgtgtatgcatgcatattttggggaatgtgggaggagggatgtaaaacattgagttaccaatgattcttctcttgcctgacctttattcttccatgcatccagctggtcaccagagttcatccactccactttgcaaggcctctaacagatgacccttctgccactgcctgtaccagtattcttacaatagctaacttatttgagcatttattaagcacttttgtgggatttttttttttttttttgagagggagtctcactgtgccatccaggctggagtgcagtgttgcaatctcggctcattgcaacctctgcctcccaggttcaagcgattctcccacctcagcctactgagtagctgggattacaggcatgcaccactatacctggctaatttttgtatttttagaagaaatgggattttgccatgttggccaggctggtctcaaactcctgacctcaggtgatccacctgcctcagcctctcaaattacaggcgtgggctactgcgcctggacagtaatgttaattatttaatcctcaagataaacttttgagccaggtcttggtataagcccccctgtttacagatgatgagacagctccttatgttaagagatttccccaaggccacacagccagagagtagcagaacagagatttaaacccaggcaccgtggctgctgaaattatagccttcattatctctctactgaatcacctaacagttcttacttcccacatctcattctcctgttctctttttccaagtgtctcaaattcactctccctctctacatatctgcctttcaaaattctactcatctaacatattccagaacaattgtctaattccttcagcaaattgcagtcatgaaaaaaaagtgggggagggagcacagttaagtttctcgggggtcttctgtaccataataacaaaatgtggcctgtgcaccatcttcagattttgagaagaacaaagcaactgtaaaagacatctttaaaactatttgggaaatttgaacatgtgttaggaatcaggagatattaagggatagctggtaattctgttaggcataataataggttagtggttatgttttaaaagatggaacatactaaagtgtttacaggttaaatgacatgaaaaatgggacttgctttaaaatactgcagcaaaccaagaaaacaaaaaggtggaagtagatgaaacaaaatggtaaaatgttgaaaaatgtcaaagctggatgatgggggtaccttttattgttttctctacttttttgtgtttgaaaattttcataataaaatctgtttgttttcttttcttttcttttcttttttctgagacagagtctcactctgtcaccgggctggagtgcagtggtgcgatctcagctcactgcaacctctgcctcccgtgttcaagcaattctcctcccttagcctcttgagtagccgggactacaggtgcacaccaccactcttggcacatttttgtattttttactagagacggggtttcaccacgttgaccaggctggtctcgaactcctgacctcaggtgatccacccgcctcggcctcctaaagtgctggatttacaggcgtgagccaccatgcccagcccataataaaatcttttacaaaataataaaaacttgtttttagagcccaaataaaagacttcctaccccaggaagctttcgctaatgctctgtcagaattcatctttcccttttgggggcctgttgcacattcgcattgtgttataatcatttagctgtgtgttcatctcatgcaaaagactgtacactcttcaaagccacaagccatattatgtgatgattcatcttcacgtccctccaaaaaccagtcatggcatcttaacccctggtgagtgcagagtaaacacacttgttaaacaggatgcgctgagtgtcctactgatggtcctacaaatgccatattattcattttctatcattaatgaggacccactgtaaaaatatctctctgttctcatcaccagaaatagttgtgcttctcctggtttatttttatcatatggacactttgagtcttgtaagtgatcattttccctctttgtgttgctactctaaagcttagaattaaatttgtggcccacccacagcaagggtacaggcatttgtggcgtgtgttttgtgtgttggcttcattcctggactctctttttaattttcctactttcatcttcctttggttgcacattctactttgacttcttttttctgtaaaactgtaaaaatgtataggaactctattaatttcttggtgcaatctatcaggatataaatagtattcattctctaccatcgttgttctagatagaagatagcaaacctttttgtgtctgcagagtaggcagtgtgttaagtactttacatattatttaaattagtcagtaactctggcaaagtgggtatactgacttcgttttcacaggtgataaaactgaagccaaagaggtctttcccaagctcacacatctgatcaatgttggacactggatttgaacttgtttctgcttgtttatacacagcccacagcctcccttccttgatatttccatttaagttttgcaattttgaagtgatgttcctactaagactttagaacaaacaaaatatgctttattaaacatttgtttcatttctgtttttaattattattatactttaagttttagggtacatgtgcacaacgtgcaggtttgttacatatgtatacatgtgccatgttggtgtgctgcacccattaactcatcatttagcattaggtatatcctaatgctatccctcccccctccccccaccccacaacagtccctggtgtgtgatgttccccttcctgtgtccatgtgttctcattcttcaattcccacctataagtgagaacatgcggtctttggttttttgtccttgcgatagtttgctgagaatgatggtttccagcttcatccatgtccctacaaaggacatgaactcatcattttttatggctgcatagtattccatggtgtatatgtgccacattttcttaatccagtctatccttgttggacatttgggttggttccaagtctttgctattgtgaatagtgccgcaataaacatacctgtgcatgtgtctttatagcagcgtgatttataatcctttgggtatatacccagtaatgggatggctgggtcaaatggtatttctagttctagatccctgaggaatcgccacaccaacttccacaatggttgaactagtttacagtcccaccaatagtgtaaaagtgttcctatttctccacatcctctccagcacctgttgtttcctgactttttaatgatcgccattctaactggcgtgagatggtatctgattgtggttttgatttgcatttctctgatggccagtgatgatgagcattttttcatgtgttttttggctgcataaatgtcttcttttgagaagtgtctgttcatatccttcacccacttgttgatggggttgtttgtttttttcttgtaaatttgtttgagttcattgtagattctggatattagcactttgtcagatgagtaggttgcttaatttcattatacatctctttcatggtatctttttatatttaattttgcttcattctcttcttttctgagcacactaaaaatatatccattaaaaaaagaaaagaaaagaaaagaaaaagagtgagttgcccatttagtatgtgtgtctgcagtggccactgaactcagagcactttttctcacagggcagtgttcttgttgagaagaggggtttgggattcagggagtatcaagtcatcccgtagtaacaaaagaatcccacagaaatggaagtttcagaaaacactcctagctgataatctatttagagatcgtttttgacccacctgtaatatccccttcactcatgcaatgacaacggtatcaataactaacattcctgacgtgcttactctgtgccagtcaccatactgagcaatttgcttgtatttactgccatttgattttcacacctatacaatgtgagagaagttcttattattctcctgtttcagaagtggaagctgaggcttaagagaggtcagtgtgcttgctcaaagctacccagctaaagagaagtggagctgaatttagagccaggcaggccaactctagaactggcctttgtaatcatgcctgtggtcactaccgtccgtcctttcccaccactgtcttcatcagtgtgtcgatgagtcatcgccacatgtccatgggcctctcatttctgaagacctaacccagaagccactctcttcatcaagcctctctcacttctttccaaacctcaccactcactgtcccttctcgaaacttccatagaacttcacctccctgccccgctctctttgtgcactccccttttcctgactgcactgagttattgatgcacgcttctttttcttttcctttcaccattttattctttttttaatgaatgatttatatatttatttatttatttatctatttattttatactttaagttctggggtacatgtgcacaatgtgttatatatgtatacatgtgccatgttggtgtgctgcacccattaactcgtcattacattaggtatatctcctaatgctatgcctccccactcctcccaccccacaacaggccccggtgtgtgatgttccccaccctgtgtccaagtgttctcattgttcaattcccacctatgagtgagaacatgtggtgtttggttttctgtccacacgtcttaagtgtctttcagctctaagcttctcagggacagggtctccatttcattcatcttcacgctccctgtggctctctcggacaatgccctgccctgagtagattctcattaaatacctggatagaaaaagatacttacttcagcccttttctatcaccaactttcagttaattagtgccttatctactaagagcgatacagtgatttgtaaaggtacgtgtttgaggcttatagcacattacctaatgtatcccgctattggccactgacccaaatgagaaataagaatgtctgcctttcctcagtctatcagtataatttgatagaagttaattaccctgggctgagcgcggtggctcacacctgtaatcccagcactttgggaggctgaggcgggcagatcacgaggtcaagagatcaagaccatcctggccaagatggtgaaaccctatctctactaaaaatacaaaaattagctgggtgtggtggcgcgtgcctatagtcccagctactcaggaggctgaggcaggagaatcacttgaaccccggaggcagagattgcagtgagccaagatcacaccactgtactccagcctggtgacagagtgagtctccacctcaaaaaaaaagaagttaataaccctgaagtttaagaataacaataaagaaaaaatctgctttgtcagattaaaataagtgttcatcagaaatacacagttatctaacctttttttgcgtggggggggctggagttttcaggagttgaattcacctgtggtagaacgtaaactaaatccctagacaacaaatctaaataagatagatctgattttgctgtgtttataattcactaggagaaatcttgcttttattttgctttatttttattttattttgaaggcagggtcttgctctgtcacccagtttggaatgcagtggcacaatcatggctcactgcagcctcagcctccctggctcaagtgatcctctgccccagcctcctgattagctggaactactggcacacaccacaatacttggctaattttctgaattctttgtagagacacagtctccctatgttgcccaggctggctttgaactcctaggctccagggatcctccctccatgccttccaaagtgctgggattacaggcatgagccactgtgcctggccccttgcttttagattgagtcgatagtcagtatttcaaatatctctaaacttacaccgtaagggtgatgatttttgaacagttaacctaacttcattactgtaagcgtttactgattcactcaatcagccatagtgagtcagatccttcctctggtctcagctctcatgcaagatcctgaagatatattggcaaaaagcaataatgatacagacaataatcaattaactcaataatcaataatgatacagacatctataatttttcacataagttcaggctcatgaaatccttgcctgtgttctataatttgctggagttaacactatggaactcatttatgagtgatatacataatgatatcttttttatattgtgcttttctgggaggcaaaaagatgtttctgttatgattgataaggaaggactcttacagaaatgattagctaggcaaacacatttgaatacagtggctgtccagaacatgggagatattttcttgttccttctctgcttccagttataaagtcttattttttagaagcaagaaaaggtaatatatgcacatctgatatgcaacttccaagtgatacaaatctcatctttcctgctgcgtggctgcttgcttttccttgtactatttttttttttattttttgtcattgagaggttatgacaacatgagccatattgtatttataaacatcacgtgtttccttgatatggcttgcagtttctgccagacagaacacatggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaaggtaagaactgtgcctttatgataggatattatctttagaatcttttttcatgctctggcacgtttatctttcattaacttgtcttctgtattcaagttcaatgcaataggcgattgcaattttaggttttattttaacttcttgcacactgcctagaagaaaacctctctttgttattgacattattctgtttttttgaaatccacttaaattaaactgggctggtcttcaatctataaatcttgtggtctagtttctggctaaccttataatttggaatgggatttaaagtgccaacacagtttgcttttacaggtcttgttgatttatgtgctctgtgacaattttcagtgttttcatgaagttgttgacatacattcagtgtctgaggcaaagtcgataatttgaaggcatggtacaagcaaggagggaaattcatatgtgtcctttaacattccagggaaaaattatttggtgttttgttcttgtgaaaatcactttaaatttaaaaataaaaataacctttatcctggtcttgaaaaaattttaaagaaatagcagtttaatctgtatgaaatcacattaaaaacttctacagttttaaatgacaagcttgatataacaaatctcttatagcaggtttagtgattgcctgaaaaagtctttgacagaaatcttgtttacttgagataactattctgtcaactcttgcagtaattcactcacaatatttttgcattgatttcctttaaaggaatttaataagagcaatgtccttttaaatcagtctgtttcctttcaaaagtacatgtgttcatgaatttgcttgttcatatttctgtggatatctttatcccagtttatagatgagttaatatacctgagaagttgttatccaatgtggtttacgtaatatctattattctatttagtcatcatgataaccctatggaataggtactattacacccattttaagtttggaaaaccaaggctcagagaggaacaagatcaagatcacacacttgtaagtaacagagctgggatttaaatccaggctgactgtcttccttgtttttaagtcctggacagcacagcctcaatagtagctgagagcttcaggtctgtaatcaaatatagatgacttatcttgaaaataataataatatataatgtttacgtggcttcaggataaactattttttacttttctggaattttattttattttagatctgtagcatccaaaacctagtatcacactggttgtttatccagggacctggttacaacttactcagagcataatgaaaacagtgaacatcagagagtgtagagatagagaaaagcactttggataaacgactcttccttctttactacacagacctttcctgctctcttctttgcttcatgtgccgtgttgctcataaaaaaatgtttccataggacagagcaggaagcttgtttgtgagcttgatttgggagcaagaaagtatctttgaatggagactggctaactgtgcctgcccactgcccttcaggctgctggcagagctctcaggagggggacaggaagaatgttaaggctgaaggtggagggttctgaagttagggcagctggctcagctgcctgagagcccgaacttcaccttcaacagtgctcttcccacctcctcctgaagattgagacatcaacacagcagcaaaaatatcctggtgatttgtaatgcaaagtaattactgctaacagcatcaacaggggatgcagctgctcacaacacaggcttcaggatcaaggcttccagccccagttcagcataaaatccaggattggctacacaaccaacacaactcaaagttgattggagcagaaccttccttctccccaacaggtcctagggttagctcccgaagagttctgagccgtggctggctggagtgcacatgagaggtttttgccacatccctctgccctttgatatccaaaccacatcccttttctttgctcttataagtataggtgttggcggagattgcttttgactggggacatatgtcctttcattttcaagttgcatcccttgtacctgcatgttgttcacttgctgaggtcttgcttttctgtgttctttgtgggtgcccagcaaggcatcccagaccatactaggctgttgtctaccacatcagcctaggcgccccgagtcccagaccctactctatagagggcttccaggggaccatttttctcttgatgctgtttctaacatttctcaaatgagcatgtgttacttttatataaatttgggggtagggagagaacacgttaatcttttaaaaagaaaaaagtgtttttaagatacattttgcctactggtaacacattttcttctgtcctagtttttcttgtggagcaggtgatctctgcttgcatgtggtttgcagaagtcatagatactctgtccgcttttgaggaactagagctggctactgcagacttgtaattgagaagacaaacctgacctgcaccaccggtgctccctcaagaaacagcactgaaactaataataattttttaaaagacggttaatggtacagaaaaatcatttagcaggaatgaatgagacggccgggcacggtggttcacgcctgtatttccagcactttgggaggccgaggcgggcggatcatgaggtcaggagatcaagaccatcctggctaacacagtgaaaccccgtctctacttaaaatacaaaaaaaaaaaaaaattagctgggcgtggtggcgggcgcctgtagtcccagctactcgggaggctgaggcaggagaatggggtgaacccgggagtttgagcttgcagtgagccgagatcgcaccactgcactccagcctgagtgacaaagcaagactgtctcaaaaaaaaaaaaaaaaaaaatagaatgaatgagacctagtatttgctagcacaacagaatgcctatagtcaaaaataatttaattgtacttttaaaaataactaaaagagtatagctgaaatgttgtaacacaaaggataaatgcttgaggtgacagacaccccatttaccctgatgcgattattacacattgcatgctgtatcaaaatatctcatgtaacccataaatatatacacctactctgttggcacaaaaattaaaaatgaaaaaaagaaagaaagaggcctgacttatttggagtcgtaggatttttgaaatagaaagaaggtcttagacatcatcttttgtaacccattgccctgtaacctgagacccaggagttccagagtggttggagtgagatggtcaagatcacaaaataaagaagtgacaaaaatagggctggatctcaagtcaccgttcccaagaccagacccttgtctctatgcagtgccatttcagcctgttctctgcttttgttctcacccctctggatcttatgaggtttgtcttcttgattgatttagaaaaacactatctatttgactatctatttgacttctcttagccatcttttgtggtacctgagtccagccagctttcgctaatcctctagaaagcaggacaactctcttttctggattatcttactaaaagagaaccagaaatcctgtagttaggccagagctgattaattggaaatgcatgagcctggactaaaaataaatggattttaaactaaccagatttagattatccagtattttttatggaaggagaataggccatcatgtcaactgaaaaatagcagctgtttcaaattatgagatactttgaatagagcaatattggctcagcaagattgtacagtgttatggcattattttaaaaaacagcctctttgctgtggcaaatagctcctgcagttatgctgtttgaaatgttaatgtatgactcctcacattactttcagagttgttcattgcttggaaccagtgattttaggtggcaactagaaaagcagtttgtaaatggtaataattatatgatgttgttttgaatgaatgttggaaagactggtagcacaaagaacttgagagttacttttcattaactccttaagtcacaactataattcttagtcacgactaaggagagaaaaagtcaatttaaaactgacttaaagaaaattattaaatgagtactaggacagctgatacaaagatatagccaaagtggtgatagtatcttgttaatgtatgaagtataaaaaccaaggctttaagatgaagcccaaattgagggttcaaggaaggaacagggtaaaacttgatttaaaagcatacaattggcaaaaaaaaagaaaaacgaaaaaaaaccattttgatgtccaaatgaattctaattcctctctaagagttctcaagacgatcagcatcgtactatttggcagaaaagacaaactactcattaaatagttttttgagcagatttatttatttaaggtctctccagataaaaggtgtgactacctagcttttcatttaagctagaggacctctttccattgtgcaggcagcactaactcactccatattcctgaaacagaaaatatgtttgactcagttgatcgacacatgtatttgatttctttccttttcttcttttcttgtgacatcaaaggtcgtgctttgccttgttctgatttcactctttgaaactgttccttttcacgcacccttgatagagtaggaagagttaccaaagaaaaacacaaacaacaataaggaatcataccaatgccaatgatggggcaattcagaaatagcaggggcctgatctgtagggtgcttaaacttccatgcatgattttcatgaaatgcagcacctctaaagcataggactggtggtcagggtctgatagcttcgtctagaatgagcatctagtgccagtccttgcagtcacttacaaggaaggagggcacggaatagaacatgttgtagatggttgaccccttgcagtagggactgagggatcatgacggatacatcatggatggaaatccacaaagtggaaaccgtttttgcttgcctttaaaagcaaatctaaaaatatgttttctagcagctgtgtaactgcaaggaaaaaaaaaaaaatctgctccactgcaacacaactcgctcaccagatatctgcagggttcagatcttaatgcttcagaaatttgttgcagattttactgtatatatttagaccaaggagcctattagcttgcaatctgagagaacctctgcattttcatgaaaatgagaaatgtggcactgttggcaacctcgggctataattatgttaatctgaccattttaagactgaaatatgttgttttaaaatgtttctgtatttttattattcgtaacaatgatctgaagaaatttactgaaatgctaataagtttctattcagtatcactttgagactagagcacaaaaaatgagtcagatgtggaattttgatatttttaattttggcacagaatttttatcgacagatatgtactcatatacatagagtatcttaatataaaaactacccaaatataattttatattttaaatatagatacagtgagtatatgtgcaaagctgtcttggcagatatgtgcaataacaaaacatctctacatttgcattaaattcccaatctttgctctgccaaaaattaattttgcgcattattacaagataaatgtttttctatcaagaaccatgctaaagcacccagttccctgtttttgatataaatgtaggacaggactagaatggataatgtagttgaaattctgagagcctctaaacacatatcttgagctaattagttcggcttcctcttcagcagccaaagcttgcattctggccacagacaagtaatgacacgggtgctcttttcattcacaaaagagatgttctcccaggtggtaagatgggaaggaaaagagaatgatccaatgccaagatgtgggtaatcacccatctcacagtgattatagataattgcaatttgagtctatttgttgttgtaacactacgaaatgaattgggagtcttttacatatagcctgatctgggttcagaatgatcaattaatttgggaataggaatgaggaaaagtactttttgtttttttctgagacacgagtctccctctgttgcccaggctggagtgcagtggtgcagtggttcactgcaacctccgcctcccgggctcaagagatcctcccaccttagtcccccaagttgctgggactaaaggcgtatgccaccccaccaggctaatttttctattttttgtagaggtagggtttcaccatgttgcccaggcttgttgcaaactcccgagctcaagtgatccaccagcctcggcctcccaaagtgctgggactacaggcgtgagccaccatgtccagcctggaccattttctcaaatatgatatctttgaaatataatacagtatgatgttcttacattggctgcatccagagtcctcattttttgccagttcttgtatctccaaaacgaatgtgtcattcgtttcatccttctgtgaatacattcaagtgagtattttccgttttattcattttcttctgcctcacagctcactgagtgggcccgtgaatgtttgctgatgatattaataatcatgcgtgctcagtgacacaacaatgatggaactcattaggtattcacagcaccagaagagaaagtgcaagaaggttttactgaagcaagtaagcagctgaatcaggggctcagagttcagtgtcaggactacagtcacagttatgagaccacagccaagaagagattcccagcagggaaaaaccaagccctttgagtcataatccagtgctcgatccaccacaccccactgccttccttgagatgatggtgtggaggagtactgattgatgaggaggattaaacctttttttttttttttgagacagagtctcgctctgtcccccaggctggagtgcaatggtgtgatctcagctcactgcaacctccgcctcccaggttcaagtgattctcctgcctcagcctcccgagtagctgggattacaggcacctgccaccaaacccggctaatttttgtgtttttagtagagtcaggtttcaccacgttggccaggctgctctcgaattcctaacctcaaatgatccacctgcctgggcctcccgaagtgctgggattacaggtgtgagccactgtgcccggccaattaaaccctttttaattaaaaaaaaaaattggaaactaatttgtgtacttcagtgtgttggaggaaacgtcatcgaaatggcaccagtgtcttgctgccttaattttaagaaatcccctttatttattgtcacttatcttctgtcctctctgggagaagtgttgctctaacgttgcttttctgaaaagtaaagataatgcaaagataaaaagagttggggaggttgggttgggcattgagggaagataagctacctttggttcagcctgcagcttgattctttttgaagtgacttgaaagctcttggtgctaatcaagaactttttgtttgttttttgttttgtgtgtgtgtgtgtgtgtatgtgtgtgtgggtggcggggtttggggggaacaggatcgtattctgtcacccaggctggagtgcagtggtataatcatagctggagtgcagtggtataatcatagctcactgcagccttgaactcctgggctcaagccatccttcacctcggccttcaagtagccagggtacaggcatgcaccaccatgcctggctaattttttaaattttaattttgcagagacagggccttgctatgttgcccaggctggtctcaaactcctggcttctagccatcctcccgccttggcctcccaaagtgctaggtttataggtgtgagagccactgtgctcagccctaatcatgaactttgaaaagtgctccatagattacaaagcattttcttcacttgccttacatcctgtgtgggaaggaagtctttccttcctggaggcaacgggtaagaagagcaactagacagtgtgtagctccttactctcggtaggcatttcgtcatatggagcatgacttattgacttgcttctgttctttctcatgagctactcagtgtcaggagtacagggcttgacttaaacatagggatactcaaaggcccacctggcagtttgttgttgggacacagggaagcagattgtgtctctgaagaggaggcttctgtcggtgtcagagcctggtggggaagaagggattggtcaatatttggctaaactccttcagctgttggtgcagcaaaaggcatggcagggcgtgggcagagatgcctgccaagcccggcctcagggcatgtacagctcccaaactggttgtctttgaggctgttatttatccaaataaggagaagcagtagttttgctgaccatctcagatttccaagccatgctccctggctggctgactgacttgctatttgaactgaaaacacgaaggtattcctttgaaatggagcagtcttgtggggctcgtgagtaccctagagtcattacttggaagaagattttttttgctccccacatttgtagataacatgaacatggcttggtctatttgacccttctcttgtgactctggcaacactcaatacagatggacctgatctgggacagaaatagtactcattttcagaggttcttgaaccactgccctcctttgaagaggattcaaaggtcagacctccacactgatttcttaacactagaatgcaagattattctagcacttcatagatcctggccctgttatctgacttcaggtaagatatttgaagtctctgagccccagtttgttcatctgtgaaatgggaattataatgtatctaatgggaatgagatgagaattaaatgaggtaattttggaaagcattggtaaataggaagtcacccaaaatattcattttcttccctatttccatcttctcttggcagatttaattgacaatatttataatagagaaattctagataattatgattgctgtccaaaggatttaaccaagctcacagtagaatggagattgtgatgtgaacgttcagtgaccctgcattactatgtccctctactcactaaagcagtggttctcaaagagtattccctgaaccagcaggtcagtatcacctggggacttgttagaaatacagattcctcggcaccacccgagacctactgaatcagacacagtggatgttagacccagtaatctgatttactaaactctccaggtgattctgaagcccaccatctgagagttggagaaccactgtccgagagtaactcactggttgggtcggtagtctagccattcccccagggcacctggactttcctatcccttgtccttgaccatgccttagttcctgcctggaatacctaagaaagggacctctttcttacctgctgaaattctattcatcattcatgaacccactctcacctcttcagaaaagtgttcctcagtcatccccaccataagaacctcattattctatgaactaccagagtatttgtctgttgcactcatttgacacttagcaaagttattcttgctttctcatattttaatgttcacgtacatgccttatttttcctactagaatgtaagttcttcagaggtagaaatcatgtcttacagatcccttttccctcatcagccttaaccctgggctttgtatataggtagctactctgtaaatatatggacccacagaatctcatcattggaatgggccttagagaaagtctacatgagatttcttatttacagataaagaaagggatgttgaccaggcgtgatggttgacgcttgtaatcctagcactctgggaggcctaggcaggaagatttcttgaggcaaggagtttgaggccagcctgggcaatgtagtgagctcttagctctacaaaaaaaaaaaatgttttttaattagctggggatggtagtgtgcacctataatcctacctattcaggaggctgaggtgggaggatcacttgaaccaaggaattcaaggcttcagtgagctatgatcacaccactgcactacaacctgagcaacagaatgagaccctgtctctttaaaactaaaaaaagtgaaaagaaagaaaacaatgttaacacctggaccaaaatgctagttccgggactccccatttggtgttcttcccccatcaccctgctgtgccgactgcggagaaacatacctgggggctttcagagccactggcctggccccaaaactagcaggtgttctcatgttctctgccacagacttcaactaaacccaaggaaagcagatgggttttcaaagctatactcatttaatttataaacctggaacctcttacattttttcataactaatgaaaactgggaaagtacaaaattttcattcataagcctataaaattgtataacaaatggcatcaattcctagccttacacgtgagaatttccccagctcacacactccgtatacttaggatacccatggaacttcttttatttttgaataaaagttcacagtgaagatcattcacagtggagcaggcggctcttctgaacccaggaagaatgggcatgagggcttttttaatctaggtccccatcattgtttttttcatgtttattttgaggaaaaattgaacctggcagatctgtgaattactgtctttcggtgttaccctctgggactattccctcagacaatcctttcttctcttgacacatgggctgatgttgtttggctgaggatcaaaataatggcacaactaaaacacctttcatcagaagtcatccataacataccctttaaaatttgctccacagacacagctcactttatgctgtatgttttttcttttgcttggtaatagaacctacacatatcctactgagatcaatatgaacacagcagaatgcaggcaatggaatgtgtttcctgtagacgggctaagacggtaacccaggtccacagagttggtttcagaaaagctataatcaaagaaggaggaacagtgaaggtagacatgagacaggcctgaaggggttaaacctactagggagcaattggtagtaagaagctgagaccacatgaggctgtgagaaaggagttattacagaaacagacatcctgggatttgagtagctccattgtgagaagacattgacagaccacgaataaatggccatatggtttccaagttgacatctgccattccccaatgtgtttaccaccattttctctcacgggctctgaaaaccatctatcctttacactgcaattgtatagtgtgaaattctacatagatcaacatcaattcattgtttcagtttaggtatatcatatcatcaaactaaaatatatatacattttaattttcatgctgtaatcatcctaaagttatataacactccatctagctgttttcatatctgtcctttaaactgcaattgtagagcataacattctttttttgtttttgtttttgttttgttttgttttgttttggtggtggggagacagagtcttgctctgttgcccaggctggagtacagctgcataatcttggctcactgcagcctccatctcccaggttccagcaattctcctgcctcagcctcccaagtagctgggattacaggtgtgtgctaccatgactggctagttttttgtacttttagtagagatggggtttcaccatgttgtccaggctggtctcaaactcctggcctcaggtgatccgcccaccttggcctcccacagtgctgggattacaggtgtgagctactgcacccggctgtatagcataaaattctacacagatcaacatcacctcattgtgtaaatttaggtatgttatatcatcaaactaaaatacatatatacattttaattctcacgttgttgtaatcatcctaaagttatataatgctctacctagctatttttgttcacgatataatcaatttggtcagtttctccagtgaaaagaaagaagagcatagagtgcagcgatggagaccctgtgcctctgtgggtggtgcatgcatctctgaggggcatggtcctgagaatgtcaccccataatggaattagggttgtaatggtaagggattttaatcagctaaggctcagatattttatttcataagtaatccggtgcctgtgactgatgatgactttgtgcatgcttctgtgtgtacatatatgtatatgtatacatatgtataacttgtgatatggtgatatccatatagtactgagtgatgtataatatcgataggtatatataagtataatatatataagcatatatactgatatatctattaaatataactaatatataactaattatataacttactcattttgaggcaagtagataaaacctaattgtaagtcaagagaggctctaaatcattcgagccgaagcccagtgagatgccccagtgattcttttcctttgctgtgaaaatctggacctgtgaatggagtgaggtacttctcaacagacttgttcatgtttcacaccatggccagaaatcgaataaggaatccatcagtgatcacgcgtgggcaggcatgaggaacatcgttctttgcagaatagcttgcagtgtcctgaagtgcacagcaggtcacacgcaaacaaccgaggaagctggggttcttgctgcctcactgcttagcagctatgggaagctgggtgaggttcttaactccctgcacttctgtttcccaactattcaaaaagacataagacacctgttctatgtctttcactgagttctggagcccatgaaatgtcacaattgagagccctttgtaaactgcaaactgctatgtgattattggagtgtttgtgggtggggtatggtgagcacggggatttaaaatctcttgttagaatatgaagtgtcacaagcaaataaagcagtatatcctatatggcaacatgtggttgacaagttacatagtagtttcaagaactgtcataaagagaaaaataaagtctaaggcgctaaaaagttgtagttgggtgccgcagataacttactagcatccaatctagaaaacattaaaagggagctgtgcataaaagaacaaggttcgtccaggaaatgggtggatgtgcagagatggagataagagaaggaattatttgtaccatctgttgcaagtggcataaaaaagatatcattttacaaactgtaactatttttggtacaaaaggaggttgtccttggcctggggaacatgggagtagcccagcagaagattgagtgtcagtgagaaggacatttttcttttatccatcctacagcactgcacaattattgattgtggcttggaagcgaaatgatttatttaacattacttctctattctgctccagattgagatctttaatcactgttggacccaggactggtcagccaggtctggccactggagggctcagtagagttcctctgtcaaaagatttatagaaataacgctcatcttaaatatagccataagctaaccgctgactggaccatctctttcctgggaattaaataattttggcagcagtctgtctgtctgtctgtctcatgtctgggagacattccgtttacaatcaaatgaaacaataggctaactaaaaccttacaaatggcaatcttcccaattttaccaatgcaaacaagatgaatttgaaattttttcaacgtaataatcccttcccttcctaatatcatcttcatatctataggcacagttcagattttctttgagcaaatgtaatttttttaaagccaatgaagaaatgaatatgaaagggaaaataggaatgaatatgtgtcacaatactattggccttgccagagcataaaaattacttcctgttgaggtaatcctgaatatttcctagcacgtccattcttaacactgactcagaaagaatacattgcttccactttgcttttaggcctagtcaatgaaaggaagagggaaaatgaagagtgggacactttatacactgctgggaagaggaacgtagtaatggctgtaatgtcccaaggtagagaaggcagagaaggatctggtgatgtaatcaaaccaaagcgtgggggtgttagtggttgcacacactcatactgaaccaaactttatggtgagttagcctgaaagagcccttctctggagaatgtgccttccactgagataaagccactgggtcctagatggcaccaggatattgtttaggaaattggcttgtctggttcattagcaggtactctggggcctttggagattgaactccacctctcttgggtgagcttggcgcttgctaaagagcatttaactcatcctgattcaccgcaggattgggctggctttcaaactcctgacagtgaattactgctcttgtaatgacgaatccatgcatgcatgctacagacagtgccctggagcattttgaaagtgaaaggaaattgctgtgaacctggcaggaaggaagagaagggagaggtaaactagacttcttctcgcattgaaccgaccgactctcattgtaacagggtcaacagaagccacctctctctagcgtaatggacatggtttcttgtggttttaccctttgttgcttttttttggagccagggtctcactctgtcacccaggctggagcgcaatggtgtgatcttggctcactgtagcctctcaacctctcaggctcaagtgatcctcccacctcagcctcccaagtagctgggaacacaggcatgcaccagcatgcccagctaagtttttactttttgtataggctgggcctccctatgttgcccaagctggtctcaaactcctgggctcaggggatcctcctgcttccacatcccaaagtgctaggattacaggcgtgagccacatagcacctagcccatagcagatatgggataacatgtcgaacatggcatgacttgcttagccaagcagcagagagacagagagttcactgtttgtttcctgggggacagcctggccccagacccttcacatacagtcactgggacaagcaaccctgcccataataagcaggtaaagaagaattataagagccatgtctgttagcacacctcacgccataagacagggtctttggaggatgtgataggggcggcatcgtggcctaatcagacaagggggaccactcctccatcccccttcctggaaagtacgtgcttgactgaagacacaaaacaaaacctgcctaatgtataccagattcatcagaagctgatagtgtgtgcctcccatactctggtgagaaataacaaacccttgctgattagattaaaagtcaagagcttccacattccttctactgttttccgacctcttaggtggcatctgttacaaccacttcatccaaatatttttcctagtgagacatcttaggagggtggcaatgtcacgtgctccatttgcccccttctttaataaccacaaagtgatttgatggcagtaaacagtttttttagaaagcctgcaaaggactggatttgaacttgaaagacgtcatggaattcttttggtcagcaagaacaacctctaaaagccttaaaatgttttaaaaatgcacaggctgcccagagcgtggtagttgggtgtggcgtgaagccagtggggcttccagcccagtgagtggagttccttgtcaccgtattcccacttggatagctttcggttccacccagtccccaagggctcagaaaacatgatggtaatcagagcctgcctgggagcgcaggagatgcttcctttctcccccaccttttgctagcaatgcattaatgccagtcctccgctgagagctgcacaagtcacttcgtgttgtggacacgcaccttcttgtacctgttcccctggaagataccagctgtgctgacagcggttgtagccagaggtctctggggatcgcctaccttctcgtccttcatcttgtttagggtggggcagaagggctctggtttcctttccagaatcccctctgcacagccctggtttgccctctctatctttccttctcgtttcagatgtattttccagggtgattgcagttccttgcccggcgctatgtaggactgattaatggctgctacccaaagttcagcgtggtaaaacagggctggttaattaatagacagcctccttatctccctcatgttttccctctggtgttaaaccaggagaagaggcttacgtttccttcagctgccaattcccagacttcaaaagtctggcagcaaagtgggtattgggtgctggtctaggtttttgcagtagcacctttaagtcaacagaaaactgatctgaaagttggctcctctggattgagtatgttgggttttttgacagtttcatttctcggtggctggttgtttgccctttctaatgatcctgtttgccttcagcgaaatatattttgtaatatttcctttgctgttaacccatttacctaggccgtttaaagttccttcattggtgttttccctgtaagcagttgttgaaggactgagtcacccgtgaggtagcctgtggttggatgtgggctgaggttattcagtgactaatttccaaggggaggagaaattgacttatcacggggaaggttactttttatccatgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaagtaagtggctttaattctttgagggtgaaagagtgtcttaagattccatttcagttttctctgcttacttcattgtgtggtctgattgagtggtatgtttacaaattctagacttggaagggtggggtttgaaatacaacaaactgtacataatattccttttccacaagcaatatatatatatataaatgctccacagacatgattacatgaggcagtttcccaagatgattttaaacaaatattttttatactaggttttttttttctggaaacaattttaatatgttgtttcttatcttacgttcaagaaacttctgaatgagtgatattcgatttgacttatggttcttttgggaaataatatatagctacatgtaagaatttctaactcagacttcagatcttaatttgaaatggccccagatattttctggtgtttcagaagtatggtgtaaacagcattttgatccgtgtgcagtctgtgggcagggacacctgcctgtcagcctgctattatgatgaggctcttgaagaaactaccctctttctaagaactggaagaactcaaataatgaagagacaatagaggtttgggcagtaatggaaagaagaaaagacagtgcctagccaagcagatgaatgaggtagaacagtcttgttcatacattgccattatatctagtgcagttgaatgaacattttctgtgtctgggcttaggtgcaggcaaatagttatctgtgttgtattcagataaggggttagaagaatctttatttttctgtgtcggtcatctctttcttgctgtaaaatgaaattgtttaaagcttacattatgacattagtgttgaaattctgtggggaaaaagtgtcaatggtacaacatagctagttacttaaactcactaagggaaaagagatgataagattagtagcatcagagagatcagtggcagaataagggactgggatatattaatgtgaatggcaactcgtatgtgtgtatgtgtatgtgtgtgtgtatgtgtgtgtgtgtgtgtgtgtgtgttgcttatttattttctttgtaagtttagtataattttctcccacaaggtctgactttgagtaccagcgcaggaaaaacccagtatgtatttaatgccatgtctttactcattagccaaataacagttaaaaaccaaaacaaaataaatctgtgttggtgacagattctaggaagatctctccttagtaagaatacccgcagcaaaggctgggtttgttttaaactgtgaattatacaatcttaaccatcatgctgcttccatctatcagattctggagtctctaaattctactttttattgcaagtgtgaccttggaaatcacattgaagacttgaaaacatccctccagtgatgtccccttaccttcccccacatcctaagagcgagttgccttaggttggtccctgtcttttatggtaggattcccaagttgtctgatcgtaagggttcattctagttgtggttttaaaacaaatgtttcccactctatattgggatcattgtgtcatttttcttcttgggctctgtttagagccaaggatgaaatacatgatcctggttctttttaaaactccgtcttagaaagtcagtcacagcttggcaaaccaacataagaattctgccaagacttccaacatctaagtcacctgtgttgatagagacattcaacctcagattaccaattctgtcacaaccgaatgtttgtattcagcgccactgtggataactcagattgatggtgactctttcggtgacccttttggatgatggcaagattattttgaagtggacagggcagggaagacacacaggattagctccagatccgggctgctgactgttcatggcaagcagccgtcctcattggctgaggtcccattctggttggttggtgtccatgccatactggatattagctgtaaaatatttcgactatcactggtgtttcccacatgaatgcccaatacaatgtatcagaattacttttagttaattgttatatttctttctaatctcatctatacataccactagtaaatctattgagatattctagttagatctttaaatgtttcattttaaaggttatttatatatctcctaaccattttttgcatgtcaccaagcatgtttttaaaatacctatgtaaatacctttgctgttttcaaagaaatgtactcaactttttatgaatttaaataaattttacattttctttttactaatattatttatccttctggacagttctatactctctagaatattttattttattttattttactttattttattggagacagagagtcttgctgtgtcgcccaggttggagtactgtggtgtattcttggctcactgcaacctccgcctcccaggctcaagcaattcgtgtgcctcagcctcctgagtagctggattacaggcgcatgcactgcgcctggctaatttttgtatttttttatagagacagggttttgccatgttgcccaagctggtctcaaactcctggcctcaagtgatccgcccacctcagcctcccaaaatgttgggattataggcgtgaaccactgcaccgagaccctagaatcttaatgtccctttttacactcctgccaaaaagaggaaagcttctgctggttaattgggatcgtagtcccccagataaagatgtactctgaaggtggctaaggaaggaaaagagaacagggaatagtgactgacctagttaggactgttgttcataccaagagggttctagatattatattgattgattgattgattgagacagagtctcactttgtcacccaggctggagtgcagtggtattatctcggctcactgcaacctccacctcccgggttcaagcaattctcctgcctcagcctcccgagtagctaggactacaggtgcatgccaccatgcccagctaatttttgtattattagtagagagggggttttgccacgttggccaggctggtctcgaactcctgacctcaagtgatccgcctgcctcggcctcccaaagtgctgggattacaggcctgagccactgtgcccaggcagttctacatattttaaatatttttctggaattaataacaataatgacaacagtacctaccatttgttgtatgtgatttgccttggacactgtgtaatgctttataaacagtggcatatttgagtcgatgtgatgaatttatctcgatgtttgttttggttggttattgcattgtgtaatctgattatgtggagaatttgcccacatatccgctgctcgctgagccagtccctcctgtattttatgacctgtgaagccctgtgctgcttcctgctgagccatactttgctttttattgagccctgaattgtgaaggcagagtgagagaggtatttatagaggatccgtgtcgctctcctgcaaaacctgtgtcacgcggttgcccagcctccctggaatgagcatcagtcaggtgtattatcatgcaatgaccttgggactgttccttctggtctaaagcactgagcacctgagtcatgagggtgtccaatgagcagggaggtcctcatgggctggagcatcagggcaggggccatgcagagcagacgcacctggagcctgacctcgaaccttcatatggatccccaagaactagcacatggggagagagaccctggagtgaggacagcatcaggatatcacaagttaggtttagagaagggagaacagattagcctatcataatgggagctctgtgtgtgttttgggaggggagtagagaggaagtggagataaaattgtaattgtgagggaggagcctgcatactccagggggcccagaaatagcccctataggagccaagaggccaattccgtggtgcccaggtcatgtattcaaaaagggctcccttttgttgctacatattagcaccttatttgcacttctcattggtcactttcattatgaaatccacttgtctatgtaaaacttgcagggcagggattctacaccgctggatccttccaggagcaagataaggaagccatgggagtcccactggttgttcctgcattcttatctacgaagtttaagaaagaaggtgccctctccatggcgcttgggagtttccatggaacttgggggcttctttagaactgtatcctagaataaccccaggcacttaccaagtgcttggtaaatactctttactacatgcagtgaatttttgtgataaagaagcagttagtttgtatcctgtgcattaggctctgtttcattttcaaccttctcctggtgcctctactatccctactgtcttccacatcatccacatcatggggtctcttggctgctcatcttggttcttgccattcaagcccccacctctttcctcgggtccctccctcatccaccctccaaccatttatacccttcttctctgtcacatctcctggaagtcaggatagggactgtgggctcctgtgacctcaccaatagaacttgaagaatggatggagcctgtctctccttccctcagttatttggagaatctcagtggtcatttccccactgcaccttgaccaaagcaaaaatatatgaaatcatcatatcctgagttatttttttttttattctactcccttgctaaacacagtaacatagttgcaaattacagttgaccattgaacaaggtgggagttagggatgctaagtcccccacacacagtaaaaaaaaaaatcagtgtagaggccaggtgcagtggctcatgcctataatcccagcactgtgggaggccgaggcaggcagatcacctgaggtcaggagttcaagactagccgggccaacatggagaaaccccgtctctactaaaaatgcaaaaattagctgggtgtggtggcacatgcctgtaatcccagctatttgggaggctgaggtaggagaatcacttgaacccaggaggtggagattgcagtgactgagctgagattgcgccactgcactccagcctgggagacagagcaagactccatctcaaaaaaaaaaaaaaaaaaaaaaaatctgtgtagaacttttacctccccgcaaacttaactactcacagcctactgttgaccagaacacttacagatgacttgaatggtcgattaacgcatagcttgaatgttatatatattatatactgtattcacataatcaagtaagctagagaaaagcaaatgttcttaagtaaaccataaggaagaaaaaaatgtgtttcctttctattaagtggaagtggatcatcataaaggtcttcatcctcgtcaacttcatgttgaataggtgagaaggaggaagagaagggcttggccttgctctctcaggagtggcaggggagggaggatatctgtgtatcagtcaacctgcacagttcaaagctgtgttcttcaagggtccactgccattgtactcttattgcttaattatttccttccagcctctccatgctgatttctcataggctcaaatgaagagttggtgaatgaatgaaacttcccttccaggttttcccccatgcatctcctttccccctgctcatctccctagattgtatccactttgaaagatgggaaacatggttactatttcccagggctaacagtagaaaaacgtgctcaggacaagttttagaagactcagcgtgagcactattgatacactagacctgcatttattaagcagcatctctaagaagctgtgacattaaaatttaagccaccacactattttttcctgaaatcccacaaaattgcactctccatcaggtgtattcatttcttgtggttgctgtaacaaattaccataaatttagtggcttaaaacgtcatgatttttttaaacaccataggtgtatcattttacttttatggagatcagaagtccttaatggattttgcacatcaatatcaatgtgtcggcagggtcatcctccctctggaggctccagagtgggatccatttcctcaccttttccagcttctagcagctgcccacattccttggctcatggccccttctcatagcaccttccaaactcttctaaccctacttccatcagcatagatctcccctggagctgatttccctgcctccttcctccgcatataaagacccttgtgattgccttgagttcaccaggataaagatctcccatctcaccatcctcaacttcaccccatctgcaaagtctcttttgccatgtaaggaaacatattcacagattccaggatgagggtgtatacatcttgcaggggaagtcacacggttacacactgagacttctcttgaaacacgaatatcaaagtcaactttctgatcccttgttttcttttcagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccaggtaaggtgcagtgagggtgaccgagggtggtacctgggcccatgtgtcactgtgggcagctctacaggggtcaaaccgacagaataaatgtctgagcacccatctctgcagcatgtcctgtggatgctgcaggagtcacagagtggtgtcaaagccaccattgtctgcaaatagtttctaaattggcaggggttacagtcattaagccatgttcaagaagacaggtgcagcaacaatagtaatcagtcccttgtgcctctggagcatggatctaagagcattatcatttgtataaatctgaataatttggaagaaaattgtcattagcagaagacagatgaaaagatcaaaaggtcataataattgatctgctactgctgaaaataaggagtgagtgttttcagttttaactgttggaaatggcagtttgtgtttttccttgtggaatacaattttgttttctcatctggttgtgggaagtggaaataatgtgtctgttttctaggaggataaacatctgaatttgcatgaaaatagaatggcttagatttaatatttatctaggagtggtgctgaaatcagcaaaatttttccagggaaagactctctggggacttgaatttctttttaaatagacatattttataatttaccaattcagaagcttcctactctatcttgaaaaccttccaaagttcatatagtaatagaaaagctaattttgataaagggaatttctctagcctgaattggttgaaacaagtcaacataataatcataaaaatctagccaaagaaattgagtccaaagaaggtttaagcatgctgctacctattgttatatatgaatcaaggggtatgaaaaataagatgtccaggccaagtgcagtggcttacgcctgtaatcccagcactttgggaggctgaggcaggtggatcacctgagctcaggagttctagacaagcctggccaacatggtgaaaatccatctctattaaaaatacaaaaattagtcgggtgtggtggcaggtgcctgtaatctcagctactcgggaggctgaggcaggagaatcacttgaacctgggaggtggaggttgcagtgagccaagatcgcaccatcacactccagcctgggggacaagagcaagacttcatctcaaaagaaaaaagaaaaataaggtgtctagatattcagttattcaataccttattagaaccactgcttctcactaaaaaatgttaatatcacttactattatataccatgtaaaaagaaggccaaaattgtgaatggaatgtgacctgtctaccttactgttttcacacacaagtcagaaagccctgaagtcctctttagcacagttttattatgaaagggcaatcccttcttacttgttcagttacagggaatatcatagcagaaagattccaggagacagaaagagaaagaacatgaaagttctgggatcattaatgaaacaaaagttctaactctctcatgtagctagaataacaacaacagtgaatggcttgatgatgcaggactaagaaaaaataaggattggaaaatagtattcattctctcctttccaaagtcctcatgaagtgaaattctaagcatcaaagaaagggactcttcccgtcactgcagacagctaaggggtataggataaacactcatagtggttcatgggaacagaccaatgtgacatctggagaggaatctaccaagatgtgcgataagtcttggaagcctgtgttgcatacttcacagaaaggataacacacctgtcccctttggcaggctttgaggtgctggttgggaaatggtatgttgctgaggggatggaacttacgggagcaagaatttagaccagaaaacaataaagataatttgtctcctgcatataatgttgagagccagaatcctacctcccacactgacctatcctagataaaagagcatcaggagcttgattttgccatgaccatattgaactgtttccaccccggttcttggatgataaaaacctgaatttgcatgaaaacagattagtttagatgtaatattcttttgggaatagtgctgaaattatcaaaatttttggccaaccaaagatggtgtctgccttctttccagaacctagctcagtgtcatctgtgtgattaccacgcacacacaacttaatgtacatccttgagcctcacttttcaagacgtttagttatggagagaataaaacaaaccctctgctgacctgtggagtcatctctgtatgggatcaaaatcttgaaagattttagcttttggtactatgggtattctttgagagcctccactcccttttttaaaaaagatctgccaaccctagagacttccattttgtaaaatttcagaaaattctatggacttcagttttacatgttagaaaacctttttagaaaatccaaattattctatttccagattaacaatataagaaaaactgacaaaacagatgaatattcacctaaaatacagtcattatcaccagtgtattctgacatatgattgtaattatgaatgtaattttacatgttcacatttttcattccccataatgtaaaatagcacaggaaaaattttatctcatacatcttgccaaggtgactccccacctgtaatcagcttatctccagagggtggaattggaatgcttgggtatatgtgggccggttagattctcttttcctagagacctgcacatagacacacagacacacagagacacacacataccacatggacacacaaagacacagacacacacagacacacgacacacacacaagacagacacacctacacattctctctacatttagactcactattgctgaaagacctaaacactccccgctaactcccctcagtcacatgtcaaaggtgaagaataattctctggtcaaaagaacttgagtctggaacttttgccctcagcactcctacatgcttcccccattgtttcttacatgggacaaagtgacaagggtgaagctcatgccatacttcctcctccaaggacagctcagaatctggccctgaactcttttagatatcttggtaactaggctgacatgtagcattcctggggaatgtataggaaggaggtgaatggcacctatcatttattgagagccttttatgagccaagcactatgtgaagtggtttctatacattatatgatgtaatcatcatgacaacccagtgagatatgtactatcatcatctcctttttacagatggagaaactgaggctcagagaggttaagtaacttgcccgaggccacaaagccagtaggtggcataaaatgtccaggactattaaagaattctacatattccatgctgtttaccactgtgcagtattctgccttgcaaatgagaactataagccccacctccacacaacagagaagttaattcaggagtgaattctaaacatttcaaccagaattcttcaaaaattgtttcaggactagatgctaagtaactgctcctaaaggatatttacaatcataaacacagtagaatttgcataattatgctgctaaatatacacatgccattttaaatataactgccctagctagtatattagcacaattatgcagaaataggggaagaaagaggacagcattcttggtagacttcatttttttaaatgcatctgagtactatgtcaaagaaaaatgttaaaaacaggaacatcagaaacaattaccgaagcacaaaattataatccattgtctcatctataccatgatgttatttagaaatgcttaatctgtgtaagtattgttaaagaattttcaaccccttaaagcttaacttcatgagcacagggtcgtataaagaaccaatccaatttctgttgcaatttcataatattaaaaagcaaataaatatgagagtgtttttcatatgagagtctcaagtgacattttacatcgaagatgtgaagctgcaaaaacaccagtgggaggctgagaaatcggtggctgtgctttctgttggcactgctgggttcttatgctgttctgaagagcacttcaatatagtagcccaaataactgtgggatgttagaaatcagagggaaaaattcttccttccacatgcatactttgaagacatccagtggtagcttttttgaaggaacatgatttggtaacagctctgttgacttgaaaatagctcactcaagactaagtaattgagtcttcagtcttatatttagtcacataccttgtgctaatgaatttggcatttctttctttctaaagatgcttcaatgagcatctagtaataataaattgcatctagaatatctgaagaacacagtgtctatggtataacattcttgtgatggtaggggtctcctaccagggactttggggtacagtgacagatcatagctgctttgactttcagaacagccattctagtgtctgagcttctagaaaagaaagcaatcttgagtgatgaagtggttttatccaagtgacttccattcagctaggactccaagtagagaatagtcctagtgaccaggagagactgcccaaggagaccatgtgtgacaaatggcttagtgcctgaggctctgtcttctctaggttgtaaaattacttcattaaacagcatcattatttctattcatggcacataaaacagcccttaagaattgtaaaattctgggacatttatgttttgctattttctatttgtagtttggatcatatactgtaatgtaaaatacctttagtgaaataacactcaaaattcaagagtgcttatcgcaaagtgactaccttgccttcgaaatatgtaacagattcctccaaattgatttttcaggacccagtaaacttgaactgagattgtatttttacactattctatacctagagcagctacattcgacaaattagcatagagttacactaggaagaaaaattttgcccattccgagcacctataactacagaaaagcaaacaacttgagtttctattatgatttttgaggcatggtagacttagcagaaccttctgtgtacaggaggaagcccacatggcaactggcagcttgtgtctgctgttaatcatttcacatcactttctcattttatgaggattcaatgttactatgttggtaacttttaggggtgagatggatccttggttaaacagttgatcaaatgaaagtctaaattcagatttatgtcattgaaaaatgttcactgcgactggaagacctttgaagatttcctaaaccatgatttatcctcctagaggacagtcagtttgaatgatgggaaaagaaggattacttgctttcctttcttgctggtatagtaaaaagtgagccacatcagcgatatcctaagtagttacagttagcatctcggtaaagcagagtttcttaacctctgtactgttgtcagtttgggcctgataatttgctgtagggggctgtcctgtgcattgtaggatgttgtcttagtccattctgtgttgctataaaaaatacctgagactgggtactttgtaaagagaagaggtttatttagctcatggttctagaggctgagaagttctagggcatggccctagcttctggcaaggccttttgtgctgcatcatagcatggcagagaaggtcaagggagaagtgaacccaggcaaagagggagaaatctgaggggggtctggtttcctaacaactcactctcatgggaacaaattcattactgatagaatgaatccaatctcttaaaagcgagagcaagaaatcactcactacattgagaacagcatgaggcccttcatgagggatctgcccccataacccaaacaccttccactaggccccacctcccagcactgccacgtgggggatcacatttcaacatgagttttagtggggacaaaccatatccaaaccgtagcagatgtttagcagcatctctggcctctacccactggaagccagtagcaaataccaactaccaatcctgacctagccaggataatcaaagacatctctagatattgtaatgccctgcccaggggggcaaaatgccccagcttagaaacgttgctctaaaggaaatttgaactttttctacttttaataaaatagagaaatgaaagaataccccatgttcaagcaatgtaaattgtgacattcgtaaggcaaggaccaggacagttattacctccattctgccctcctcctcgtgataaagcaactcattattgatagagcttgctatgactaccttcaggtcagtcaatctgctcatcaaccagttgttcagaggcagtaacttgtaatggacttccaagccagagtgcctgggttcaaatcccagttctaacacttgccagcagatgggacctttgacaaagtaccgaatcttgctctgcctccatttgctcaactgtgacatagagataataatagtatctaccccacaggatgcaacaactcattacagttcagtgtgttatggcagcctgggatatactaagtggctgagagtttctagtttgagcaaagcactctactaagtgctactaaagaggaatgtaaatacacagagttggcaaggatgaggaactccccgaagaagcagggagagacatttctgaatataatatcagaaaacacgtaaggtgagcaagggtgagagaattaaactaaatgtgaacacagaatagaatgagctgggcttacagatccaaattagaatgtttagagtatcaaaactgcttcgaagttcatttcaggaaagtagccagggttgcacatctgcttgggtccaggggcaaaaagacaagctaggttcagggcatccttttaaaactgcatctgagctataagactgaagataagacagctaagccaggtatgcgtgaaatcattaggttatctgttttgatgcctaatagtgcttgactgattcagctcttgtctgaattgctttttcatgtagctgtaattatggatcaataaatgtttattgagctgctcttatgtgcttagctgtggactggaggatttgctgcatacaaagaaactgagatatggttcccatacaccaggaacataaaccatgaagacagtcataaaatattaaaagcttaatataaacatataagctttgtcacggtttaagtacaggaagcttcggagttacaaatgcctactgaatacctgtttttgagaaacaaccacaatcattgaatttcacacgtgatatttcttttggctttggtgatgcccagggatgctcttcttgtcattcctgagagtgacaatgtctccttgtgagtcagagaggagagaaggggacatgccaagtcacatggcacccccagaggcttgagctccagagaaagatctcttcccagcttcccaaagtccagcttggaagtcaggacacgttttccttgaaaacaatgaggaacgacgacaggactaataatacattgtaggttaaagaggcttccatgggccagctggaaatccaaccaccatttattccaagttctaaacaatgaaagtacaagtaaacttttcaatgacaagcctgccataatttggggtctgcttgtacataattaattccaaagaagtgatacagacggtaattgctatgaattcagaaaagggaacattttcccaaagttatgtgggtctcagagccttcttgagaacattgagatggtctagaattgagggcatgtacgtaatgaaaagatgtcatttgggaaagaccaactagtctctatccaaaatttgctatacttttaccatcatggtacctataaaaatgacatctcgatatgatgttttgccagtctcagaaatcaagtgctgaccaactgaattgttatttcgttcacaggagtggaatttcatggttaagtcatatttgctagttattccttagactcctgagttcaggcatcagatacttgataaacatactagaccaactaacagatttatgcagctagctctattcttacaccagggatactctgtcagaaatgccaatggaatagcagccacaaggtctgtgtgctactttaaacaaatcaatatctcaaaaggaaaaggcgtcgtctgtcactaattagatcaaattaaaatgtgctgctgtatctcctttgaatattcatgaggtgctctcaatcagaagccctaagtctgagaccagaaacttaagccagaaaaaactaaatactgtgagattcagataactcggtcctttgccaactagaacttcaaagagaagaggaatagcttaggtgcagagtaagcctcctgaaaagatgacaaaatcagcttaatgcagaatcgtggggttcccacccaacctaaagatggatcgtcaaaatagcccaggagctgataatcctagactctgttgacacacaggacacatagtttagcctctcttgtgatttacttgtccttctgtctggcggaaaccatggagattacacttgtccttatttgaattctggacttcatttttcatgaatgaagtgattcaaaaaatacagctgggtctaagcatgaattctaactttcaaaaatcacagatcttaaaaagtctgtattgaactgggtgcagtaactcatgcctgtaattccagcatgttaggaggctgaggcaggagggccacttgagccctggagttcaagaccagcctgggcaacagagtgagatcccatctctacaaaagactttttgaaaaattaggtgtggtggcacatgcttgtagccctaggtgctcaggaggctaaggtggaaggatcacttgagcccaggagttggaggctgcagtgagctatgattgcactactgcactccagcctgggcaacagagcaagatcctgtctcaaaaaaaaaaaaaaaaaaagtctgtatatactcatgcagggccaacttgtatcaccagtaaatacttcctctgtctccttgtccatcctcaaagctaaagagaccttggagaatactgggtcctaatagctgactttacagcaggagaaacagcaaggagacttcctaaaggtccaaggatgggagctactctagttaaatgacatttcgctatcctgctgccttaagggtggctccagccattgctcttgacctcacagccacccactgggccactccacctccatctctcacctgacttgctacagtggtctcccaaaaggtctccccactcagtccctgcccaccttccgcctgttctcattggggaggccagagtgaccccgttaaaacgtgagacctttcatgtcgagcctcagctcaggactcgccgtggcccccctcacattttgtctttgcaagcacaagtaactaagacaaaacaaaaaggaaatgcactagagagaccaaatatagcaaatgtttttttcttttccctaagagtcattattttatttcttttgagtccgccctaagatttacagctctaaagcaggcgagagtggggagttcatttccacagtcaccatgaggtccactcaagagaccatctctcctgacaccgtctctcatttgaaggtaaattagctggccgtgttcagctggcccataacatgaagcaactgctattcctacctgtttgtacctgtgcaaaaaatgagatgtcaattccagaacacaaatgttccagattagcctcagggaagagaaagaaaatgcaaaacaggtgatttcataaagcagggtgtaggcttgccctggggagtggcggctctaggcacccagcagagagccaacaggaagtgaagtgcctcaccctagatgtgagtcactaagggaggcagctcagtgccacagagagccctggatccgagaaagcctgcaagctaattgatctgtttccctaagaaaagccctgcctggctaagcctcagtgtcttttgtcctaataaggggatgataatctactcaagagttctgtgcaatttttatttttatttttattatatttatgtgtatatatatgtatatatgtatatgtgtgtgtatatatatatagatatacatatatattgatatacatatatatagatagatagatatacatatatatatatatatatttttttttttttttttttttttgaaacagtctcgctctgttgcccaggctggagtgcagtggcatgatctcggctcactgcaacctccgcctcccgggttcaaacaattctcctgcctcagcctcccaagtagctggtattacagaagcccaccacagtagcccagctaattttttgtatttttagtagagacaaggtttcaccatgttggccaggctggttttgaactcctgacttcaagggatccgcccacctcggcctcccaaagtgctgggattacaggtgtgagccaccgtgtatggcctatttttatttttcaatgtattattattttagagatgtggtcttgctctgtcacccaggctggaacgcagtggtgcaatcatagctcactgcagcctcgaactcctgggcttaagcaagcctcccccacctcagcctcccaaaatttggggattacaagtgtgagccactgtgcctggcagagggacaagttctgtgcaatttaaatgaaaatagctattagatcactttgtgtactggacagttttctatgaataaatttttcattgacataaaaccatgaagccatagagttgtgccagcccttcggatctgaggggggttgtgtccttattcctgacttggggctgtttcctggtcccatccagaacagcctacacagaaagtgaattgtgaaatagattaaaggctgcctggagccttccctaagtgcatttgctgtgctgggcagagcactgctagaacctgggaagccaattgtgcatgcggggaacaccaggcctgggtgggactgagcttggacctcctggttggacctgcccgctttttttttttttttttaatagcttcattcaagatcacagacccagaatgggaagagctatgggatttatgtaaatcccttccaaccagaaacttatgtaattccaggattctaagtgaggctggatttctgtgggtagtgggtgtgagagaatgggtacccctgtttaacaaggggtaggggccttctgagactgtttcctctacagagtaagggttcgttcagccttttccgtggcctgccaagaactcaactccatgttccctcacttcctgtaattgaccttgtccaggactttctgaccttggagaattcacctttgctctttctgctgcttcgtgcattcttccaccaaatgtctaactgactggctcctctccaaactcaaggctttgccaaatgccaccagctcagggaggcctttcctggccatgacacttgaagttgcaacactcccccgcagtctcccgtgccccagatgtaagttccatgagggcaagccctgtgcttttaccaccatatccccagcatcttgagctgtgcctggcccaagaaatatttgttgaatgaatgaatttaaagggatatcatgaaggcttacacatcctcaatggtttacaggttataatgtgcttcgctacacatttttctcatttgccctcattttgatgtctctgtagggtgacagcctttgggacaggtaaggcagttgttttcccaattcgatggttaaggagcggagacccagagacgttaagtgacttctgagtggagatttgtatctccccgtggatgtctgttaatgaacttgaatgcagcatgcccaaaaataaagtcctatcttccccacatcaggtaacaacagcttcattcatctagtcactcaggccaaaagtcttggtgtcatcttgattgctgtctccccaaccctgcgtttggacacccagacccagagaacagtaagatctgtactcagaggtttcctggctccagccattgctctcgacctcacagctacccattgggccaagccacctccagctctcacctgacttgctgcagtggtctcccaagaggtctctccactcagtccctgccaccttcagcctgttctcagtggagggggccagagtgaccctgttaaaacatgagacctttcacgtccaacctcagctcagacttccccatggttcctatcacactcagggtcaaagtgagagtccctaagatgacacacaagtagggagaatgcccttctcggctggactgggacagctccagggtatccctattgtccttgtacaatacttgcaatgaccaatggctcccctgtccactttctgaagtatcctggtgtggagaataaatgatttgattcccctcgccacaagccctggacaggtcaaccgtctgcccctctgacatcatttcaatcaccctccccttccttccttcactgcaggcacactggcctccccagctctcctcagtactgccaggcatgctcctgccttgggcagagtgtatatgtgtgagtgcacctgcccttcccacagcctagaacgttcctcctccagacagcacacatggcctgctctctcacttccttaaggtctttattcaaaagtgactttctcagtgaagccctgtctgctcaccctgcgtaaaatttcagctcttctttctatctctcttcccagatttttttttctccttcatgttcgttggtgtctaaggtttatcatctatttcgctaatggtcagtagaatgtaacctccacgtaagcaaggagttttgtctgttttgttcatgtctatgtccttagtgcctggagcattccctagtatgcagtaggtgctcaataaatgtcagttggattaatggctgaaagaaaggtcaccgctgtaaggatggagtcagagaacaaacacagttaattcctggtccactgtttttgcttccactaaattgtatttggtctacggcttctccgcttgccctggaaccctgctcagaacactgctcccttctccttcttcttctccctccggataaattctgccattcttttcagcatcattcacatctcacctattataagaacttgttcttccgcagcctattgctccgtctccaccatccaggagtaccttattgatagcactgagcacagaggaaccccacagaattctggctgggctgtagccaccatgcccacccaagccaagtcatccgaagcctaggatcaggaagaaaggcatcagcatcactgactctcagcgcccgtcatggtgctcacgcacaaagtgatggtggaagtgaactgaaattgacatgataatcaatcgtctcccgaggccatgaagaaaataaacagcatccctaggagtatgtgaagaactatttattagagagaataccatcatcgccacagcattccctttccacatctcattgccagttttcattctgtcaacacctcagtgaatttatgaagaaagattagaaatagctttttcctctagatccttgtaaatggagcttcatttttgcctgttttttttacaggtatccttaaatgtgtctgtcttcctgcactgtaagtgaaatgcagaacattttagatgagcccctttgttaggttacagactctttcctgacttgggaaaagtgcctaatgagaaggtttcccccaactctgtctccttgaagattaccagaaggagaggacataggaagaaatagaaggggcacaaggggccttttcttctcatttattaccctcctctgtcattcagaaagcaacgtcagtatagcatgggaacagcaaggctgaaaaatagcccagatgcaatggggttcagttgggataatgttgaaagtattcagggtccaacctgggtaagaggcaggagaaatgaccagagactgttcagacagtatcgaaggtggagaaagcaaggccaggctacagataaagaaatagtttgtatgaataagagaaatgaagacaacaaaaaatcgccatacttagagggggtcttggagtttcagatctagacagtaacaccattctgagttagaactcaaggtcagaggatggctgtaaagattttgaggctgtatagtgccaaatttctgtaggggttgtaagtatggatgttgaagctacaaaggatggcagctggggtatggtggatgggagcaccagggatgggaggggatttcctgggtagtggtagggaacttagggatgagatagtcaagaattccaaagcaggggagatactgagacattagacgaaacaaaatattgaagtgctttttaggggagacagaacgtagccagtcttcttgctcatgccataagcacagggcccggggagaagaaatggcagccctgactgcccactacaccagtgtctcccaaatagatctaaatgtgtcaatgagaagttaaatgtattgggagtttggggaacaatgtctttagttacacagcttttccaccaataggttaacttctggcagaaatagaaaggtcattgcttagagtcacatttgaagctttaccacaaattcagacaatttaaattcctttgttttgttgaactcgtctgaaaacagtctttaattactttgggtttttttttcctcataccagagtcagggcatgaacaaacaagggcatagcctcgctttaaacctgttcactattgcatcctggaaaaatgccttcggcactgccaagatcaaagagttttagttcaggtagattgctcctagaaaaaaggaaattgacattgtcaaagaaaggcatgcctgggaaaggggatgcagtgcctctgctgtgtccacggcagctagcatgttacctagcacgtattaagggctcaaaaatatttgttgattgactctttggccatgtaacactttctggggtggggagagagatgacagggaatgagcaggaatacaaagaaaaaaattgcaaaatttagaactagaagcaaatggcggaaccacctagtagggactctcagaaggccagaatactgcagttgttactgactacagtgggttgaggctgcagtgagctatgatcattcgtgctgtactccagcctgggaacagagtgagaccttgtctcaaaaaaaaaaaaagttctataaatggagtcactggctaaaaatcatcccctaactggttaggaaggttaatgcttcagattagggactaatcacatcagctcggctagctggtttcagccatcttctgtaatatgtcttctggaaacttaagaacaaatcctttgggattcttaataggggaatcgccagcttcatatgctactgacttgtttcttaatagccattcatttacttagatatataataaggacttaattcaggcttagtgacactttggtcagtacaaagtctctagtcaaaaaaaaaaaaatcaaggtgaaacttgaatcaaaaagttatataagtgggccaggcatggtggcttatgcctgtaattccaacactttgggaggccgatctcgcttgagtccaggagatcaagaccagcctgggcaacatggtgaaaccccatctctactaaaaatacaaaagaattagccaggcgtggtggtgcatgcctgtggtgccagctacttggggggctgaggtgaaaggatctcttgagctcggtgagttgaggctgcagtgagctatgatcatgccactgtattccagcctgggaacagagtgagaacctgtcaaaaaaaaaaaaaaaaaaaaaaaaaggttctataaatggagtcattggctaaaaatcatcccctaaacacagattcttttttttccttttctgtgttccaaaggcagaacagaccaccagcggtatgaattttgcttcgtcttcacagacagacatggagcttgcaggaaagttgtttagagtaatcggacttttaacactggaaacagcacttccctgaatttgacttgagtttttttattaatattatgtttggatcatgagaagactcattcagacaggctgacttaagacattaaatgactagttaaccatatacactaatcacataaatatggtttgtggaatgatataaaatggtttacgaaatcatttttaagccatcttttcaacagtaattgtatcagtcctgtcatattttaaaccaagcgatattggcaagaatgagcctaaatgtctttaatattctgatgatgagcatgaaaaattgccactgcaataaaatgacagggttgtgttcatttctcttcttccatggcactttgctttcttccctttcaactttaaaacacacttcctaacatttcatcatgggagaaggctgcataagtttccagttgctgtaatttacttaaaccataaaattgtttccagattaccaaccataaaatggaaagacaatcttatttattaatgtataaatcagataatgtccccaatatgaatcctgaaaccagacacactttgacgattaaataggagggaaaatgttttctcattaccatatgtcaaaagaatggtatttttgtgaagtggctttggtcaagagagtagagcatacacttgtattcggtgctctgtgtgctcccacccaggagagaatggcttcccctctactgtcaagcatctgaactctccaggggggatgtcagatgagaagccacctgactcagtatctctgatgcagcgtgtctctttcctggtggccttgcaggtgacatgccctgaacgaggccatccagggagccttcactcccttcctcacagatacaaaaaggcaagccaagcatgtgggtacctggagtgcatatagcccttttgttctaaaagcacccagactcttatcccagaccgttctgcaactctgtcaatgtcagccttaaagaagaataggatgttgtttgggagttgtctctctctgcaccctaaaactattacctggtgggagctcagggtagaagctgagtactcactgagccaaggaacatgccgaaggtgtgtctgcagctccccagacttccatgtgtagatgacgtggtctgtgttgtgacattctatagttctaacctcgaggatgaatcagtagaggagcagcaatgttgtttatccagaatgattcaggtgctttgtttctttttttttttcctttttttttttttttttttttgagacagagtctcgctctgtctcccaggctggagtgcagtggtgcaatctctgctcactgcaacttctgcctcctgggttcaagtgattctcctgcctcagcctcccgagtagctgggattacagtcatgtgccaccacacccagctaatttttgtatttttagtagagacgggatttcaccatgttggccaggctggtctcgaactcttgacctcaagtgatccacctgccttggcctcccaaagcactgggattacagatgtgagccactgcgcccagcctgttttgaattttaatgctgatgctctcctttgttggacgatgtaatgaaacctgttgaccagactggaagcagaaagaaggctggtctagccctaaccagcattgttcttgtggccagcgatggaatcccaggactcccctctgccatttccctcttagcagagtctcatttagtctctacataaatgagacctacctatttcttgcatttcttaatattactgtcttctgcatgtactaaggttgtcatcatgccttcctatcccacactccagctgtacagaaccctttaagcaacttccttaccaaagctgtctagactctaaaaatgccacgttacctttttttttttcttaaaggaatatcctttgcatttgcctaggattgaagaaaagcagtaaagtggtacatctcaaggtagccctgaatgcacctctgctcttactgtcattcattttactccagcaccactgcggatagagtccctgtgggacgaatgaggacactgggcaactttcacctggggctgagcattcttccgaggaagtcattcatttcccaagagtgtgtgcaagtctgtgccccccatgtggcaggaagagtgaccaaccaccactcccattttttctgagatgctactgtgacttgggtcaataagcttgacattgctgatggatgttcactaacctgctttccttatttgaatttcttaccattgtttctctttgatatgtggactattttatggcaaagagggttgccaaggtatgactgaaatgctatatggctgagaggtttagcatcggctggtgtacctggaaacatttgcaaatcactccgtggagatatatttccacactcaccgtttgagatttcttatttccattctattacagcagagagaccatactattaatacttaaaattgcttggtgttttttttcctccttggtggatttgcaacctttaactatccagactgcatgacttatatgcaagaaactcagtattgtgacagaccttcaattttaaactaaagaaaatgcatggagttctgatatcagaagcttccaattacaaaattaagatcagtgttacatatggcactgagagttacattccaaaggcaaaactcaaggccgcaatgcttgagttggacaaaattacccttgaatatcatcttgattgtcacaaaattcaggatgcagatgcaccagcttaatcagttggctttttctagtggaagaacaggccatcattactttttttttttttgagacagtcttgcactgtcacccaggatggagtgcagtggcgcgatctcagctcactgtagcctccacctcccaggttcccgtgattctcctgcctcagcctcccgagtagctgggattacaggcatgcacaaccacacccaactaatttttgtatttatagtagagacggggtttcaccatgttggccaggctggtctcgaagttctgacctcaggtgatccgcccacctgggcctcccaaagtgctggaattacaggcaggagccaccgtgcccggccagaccatcattactttttccactgacaatcagataaattagccagcatgtatttaatagtgtaagaatatactgtttgcagcatgggaatccccaccactcacaaacccagaggcctgtgggactgagatccgcagtgaggagtgaggtcccctctcttatctcaggctcatgcaaggacactcactcatgggagataacagcacaggcaatgcccatgccatatacattgttctcctctctctccttttcctgttttgaactaacaaatatgcataactgaattcacatgaggtgacatgtgaagcctctattcacttactcgtattgttgtttttaacaatgtgttgaaaacatggcaatagttctgcgaaacgtccattgtctgaggtctagaaatgtgagtctatttcaaatgccagctaaactgtaatgaaacatcaaagagccctggagagagaggaacagtatctgtatatggaaatcattgggaaatttttcattaacatcttgagatggccaagctgttagggatattcgtgttcctgcgtgattctataaaaacctccaggctaaagttcctatgacattagatctaacatcatctaccttcaaataaatgggttgttttgttttgttttgagacagagtctcactcttttgcccagtctgtagttcactggtgcaatcttggtagcagagacagggtttcaccatgttggccaagctggtctcaaactcctgacctcaggtgatctgcccacctcggcttcccaaagtgctgggattacaggtgtgagccaccgcgcccggccgggtttcagtcatatttctccatggtctaaagaagagacatgtttgtgttgcccctaagctgtgacacaagtgttactacccacacagcaaacagctccatcatttacaccaaaaccactccgcagcctcccagctgaggtgtacggcatagaaatgtgtgcagctaggtgagatctggcctgggacactgcgaatgctagggaacagcccttttgtgcaaggtgaaagaaagaaagcagggcagaaagactcaaaaacataggatgtgcaaacaggagtgtttccgagggagatgtctttgagttggtccgtgctgtgtctttttttagccagtcaggtcactggcttgatactgaacactgatcacgaatcttgacctgagctaaggatgtgcggctcttcatgttcctgagccaggttgggtgaacttccacggccttctaggtggtaccttttataaccctcaggtggtgcattcacccggacaaactggtttgaaagtccataaagctttaacaaacaattctcttgttttacagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggtaagtaagtgtttttggagctgtaggaggcctgtgggctgcctgggatgagccctggctggtctcagaaatgtttaacatttccctaagtcacgtatttggtatgatgtcaggggattcctagatattcctgccaatactgaaattccagatttattcattaattcgggggcaaagcactgtattctcccttcggttttcattcattcgctcattcatttgttcattgatatggccacacggtggtcatcttgcagacacggggctgcctgcctagaacttagaattcagtggggaagatggaaatgggacaagtaattttatgtgtgtcaagtgtttaaaagtgcaggataaatgtttcaccaataggactagcctataccaagggcagtccccagacaaagtgacataaactaagcccagaaagatgaagaggacttagggggaagaagggttgtccagtcaagggaatttaaaattgttctaagtgcaaagtgaagccatcggaaggttgtacactggggaaggacatcagcccagctgcaatatggggatggatgagaagggacagtagccaataaggaatgaccagtgtccagatgggagaaaaaggagtacttggactagggcctactttttattttatctttttaatctcatgacagatgacaaggcctgctttttaaatgccagcattccccagaaagacagcccagttctgttagtagtggcgttcactagtatccaggtctttgcaatgaatgtctcatccagcagtctcaagccaggcctctgcaagaagatgaggtcttccctctcatcgggttagaaatagaaatccttagcaggaacacattcagatactaaattacacagaaagcatatggcaagttgggtgaaaccccaaatttagggaagccacgtgtactagttttgtgcagcacggtagagtagacagaattggggacttcagtttagggctctgttggtcgtggttcttctctggctgagcacaatttagctacaaagccaacagggccactctgccatcattcctgatcctgacgggatttgttgttttgcttagaaatcaatcagtggccttggccgaagccagagaattatttcacggaaattgctaaacttgtcttcagagcaattgccagtttgtttcggagatacttaattcattcattttttaaaatggattgtaaacttagggagaagaaaggaaactactaaatactaaaagctcccatccttctataatccattctagaaatgattcatatctgaaagcactgctctaagcaatatgtacgtgctgttttgtattctccttttatttctttttgctttatagagaagaagaagaagaataaatatgtagtgagtgcttcctatgcacttttcatgcattcactcatgaactccttaccgcagcatctagggagaggtacagtttttattctcatgttccagagaagaaaactgaatgcacatccacacacgtgacacacatcatcatagtccaaatgcctcccatttgaactccttttatgttaagatgcctcagtccctttaaagatatataggttgtttcatttctttgttctaaaaactcttgtcaatttcttttcaaatgtggggaaaggagccagtgtcatttcctcagatatatttcccaaagtggaatcggtgggtccaaagggacagttcagtgccactggtgacatgctgttagttttctcttctgaatggctgagctgatttgcaacgccactggcaatgagcacgtggactcactccccacgtctctgctaggtttggactttctcactctaacgtatcagggcgagatatcgtccacaggggcttcgttgccatagcagccttgtatagtgcacaaaatataataattcttccagaatgctaggaagtcagctacaagacaagtattatccctgttctgtagacaagtaaacggaattatatagaagtcaaggaactcatctggccaagagtaaaggaaaacccagacttcctggctacttatggaatgtgtagtttactgtggaaagagaacagatggaacctcccatctcaaaggtttttatactgagcattagatcatttaacacacaaaaccctataaggaagatgtcattacccatattttacatgaaaagaaacagaagctcagggaggttaggttagttttccaaagcgacacagctattaagagtgacagccaggctgggcatggtggctcatgcctgtaatctcaggaccttggaaggctgaagtgggaggactgcttgaggctaggagtttgagaccagcctgggcaatattgcaagaccctgtctccacaaaaaatgagcgtggtggtacatgtttgtagtcccacatacttgggaggctgaggtgggaagactgcttgagcccgagaggtcaaggctgcagtaagccgagatcaagccactgcacttcagcctgagtgacagagcaagaccttgtctcaaaaaaaaaaaaaaaaagtgacagcctgactggctgataattgagtagatagtggtgccactggctacaattaggcccgtattataatggacattggagactcagaagtgggcagggtgggaggggatgagggataaaaaaaactacgaattgggtacaaagtacactactcaggtgatgggtgtactaaaatctccgacttctccactatacaattcatccatgtatccaaaaactacttgttcctcaaaagttattgaaattatatatataatacaattaggcccacagagacagaaagagctttgtggaagacgagtggaaataatgaatttgacttgtttatggaaaagttcagtagtggcgtgaaggcgttagtatgtggatctgaagatgattgtgtgctgctgacgagggtgcgggagaccttggtgggtggtggtagcagaagtggcctccctagaaagtatgtccagcaagaagagaagtggacccagggacacaacatatcaggatttaaaaggttggcagaggaaggagttagaaaagagattgaccaagacggagcagcagaaagggaagaagatcatggaaagtttcaaagtgactaaaaggaaaagaagtggctgacaaagcttagtgtcacattgaagcaaaggagagagtccacaggggtgacaactagaagatcgctgaaatgaacataaagagccatttcagagaatgaaggagctatgacatgtaccaaatataggagattaagaggttatagatgaagatttttttaagtgagtatagattccattaagaaatttggttgtggcttggcatggtgacccacgcctataatcccagcactttggccgaggcaggaggatcgcttgaggccaggagttcaagaccaccctgggcaacatggcaaaaccccgtctctacaaaaaatacaaaaatattagccagatgtggtggcacatacccatagtcccagctttggaaggctgatgtgggaggatcacctgagaccaggaaggttgaggctcggggaattgcaccgctgcactcaagcctgagtgacagagcgaaaccatgttaaaacaaaaaaattgcgctgtgaaagttatcttcttaaaccagttatcagcattcaactgtaacaactagtacctagtcttcagccttttcctccatggaataaaagatcgaggggagggaggtaccttggtggcctcagaatgtgtaaggagaaagaggtatagaaagaatgtgtgatttcctttggctgaggaattagcagaatggttcttagtagcaaacagaaggtagcacagtgtcatctttgttggagaaataccttgttatcagaaatgatatggcatgttgtgagtgtgtgtgcgcctatccctcaaagagtgcctatccctctctgtctggggaatgatgataaagtaatttgactgattctgtaaggaaaacttccaatggattgtggtcagaatcactgacattggaaggcactgttaactctaacatgcagctgtcattggaaatgttatcagatatgttttacttggtactttcatagttggagaatatccttttgaacaacagcagagatgacaaatcttgctctttcgaggatgattttgatttgaggggtggaggaaccaccagaaattggtcagagccatgactggtgatgtgagtgaccatttaggcttagaaacataacgtggctgggcgcggtggcccacgcctgtaatcccagcactttgggaggccgaggcaggtggatcacctgaggtcaggagtccgagactagcctggataacatggtgaaacctcgtctctactaaaaatacaaaattaactgggtgttgtggtgtgcacctgtagtcccagctactcgggaggctgagacaggaaaatcgcttgcacccaggaggcagaggctgcagtgagccaagatcatgccactgcactccagcctggacaagacagagcgagactctgtctcaaaaaaaagaaagaaagaaacataacaaaaagctcgctatcgggtctcctggagctccattgtcagttctttaaaatgccttctggcctgctcccctgctgcctccccaagagggccattagaggggctgggagactggccctatttggatggtcactcatggatgaagaccatggggcgccagcagcatcagcatcgccaaggccaagcaagaaagaggatagtttcagggagctccctggctcatgagccactttgagctccactggggcctggctgagttgtgtgtgctggagcgggaaaggttcccgaaatgactgagccaggatggaaagacagggtaccaccacactatagccactccagggtctgcaagtggccagcagtgctctgtcctgcaaggccagcctggcctgtgacaaagctttacaggaaagagaactgaacagaagtgtgtgtgtgtgtgtgtgtgtgtgtgtgtgtgtctttattagtaacatggatccagcctctactccagaagagtgtgtgtgcgtgtgtgtgtgtgtctttattagtaacatggatccagcctttactccagaacagtgtgtgcatgcgtgtgtgtgtgtgcgtgtctttattagtaatatggatccagcctctactccagaagagtgtgtgcgtgtgtgtgtgtgtgtgtgtgtgtctttattagtaacatggatccagcctctactccaggtacctgtatcaatagaattgcattgtcctttttagagtcccctcctgaagaatttttgcatcttgccttattttcttactaaaggagttgtgtgcagatgccctctttcttttcattttggaaatctgaagggattcaggacagtacccagttcttactaatctccccttggcgattggctgaatctctgcccagaaataagttgcatgtccttaggttacatttgctgtgcagaaaataggcacataagcactctatattaggtctcagaattttaaaattagttttctctattataaaattgcagatattcagtatgcagattttagaaatacaaaaaattggccaagtgcggtggttcacgcctgtaatcctagctcttagggaggcagaggcaggaggatagcttgagcccaggtgttcgagacctgcctgggcaatacggtgagaccctgttctcaaaaataaaaaatagtaaacaaacaaacaaaaaaccttatattggaaaagcacagctggagataccgttaacactttgttttatacacttctaagcttttctctatgcaaacctgtgtgtttaaaaaagctctacttccaggggttaagaaaagaaaaaaaaattaaaataaaaaaaaaataaacaaaattgatcaattgatagaacaatcagtggatagatagataggagcataggcagctctgtggcctgtcttcctatggcactttcttactaaacttctagaatgtgatcattgcacactgcataccataacactgtgtgattcatatatatgcatattttttgtaatgagagaattaggcctttttagaattaccagtcatctgcattgggatgggatgcatagcttagactttcctttgtggccttctgagttctctgatgcacttttctcataggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccaggtattcctcatgcacggcggcctctgtctcggttgccctgagctcttcctaccttccttttcctaggggctccgtgaagacctagagaatgtagaaccatagaaacagcatggcttcctctctcacacacacaatccaagtctagagccttccactgcaactatagtcaatctataaccacttctttttttttttttttttttttttttttttttttttttgagacgtagtctcgctttgtcccccaggctggagtgcagtggcgcgatctcggctcactgcaagctccgtctcccgggttcacgccattctcctgcctcagcctcccgagtagctggaactacaggcgcccgccaccacgcccggctaattttttctatgttttagtagagacggggtttcaccgtgttagccaggatggtctcgatctcctgacctcgtgatccacctgcctcggcctcccaaagtgctgggattacagtcttgagccaccgcgtctggcctacaaccacttctttaagctgtgcgtacttttacgcaggaagagactctagggcatttgtttttggagaagagccgaaaggagaggggccacggggagcatgccgacagccagtgaaggctgacttctgacagcttggaggctccatcctcctccacactgaacggggacaaaggtggatagtcagccaagctttttttttttttttttttttcattttttttgcaaggatctgtgatgtatttagaactatgagtttagaatagaagatgaattcataaggaaaaaaagccatcatggtgatttgttacgaaaaacatctgcatttcattcagatactgtgatccatccgttccttgctcttttccattgttaaggaatatataaactctacgggaatcaggataagtgacccttcaggtcacgaatcttggtcaacaaatcccgtaaatctgccaaagcagaataagctgtctcctgggtaataaggaggtagagatgtgcatctctgcatgagaccacatatttgctctgtgcaccttctcccacctccctgccctggctggtaggttggtcgttgaggatacagtgctggcctaggctctatacagatatcctccctgacttccagaagctcataatccaaatagtgctagaagatagggccaggtgtcatggctcatgcctgtaatcccagcactttgggaggacgaggcaggtggatgacgaggtcaggacttcaagaccagcctggccaatgtggtgaaaccccatttatactgaaaaaaaattagccaggcatggtggggtgtgcctctagtcccagctactagggaggctgagacttgagaatcacttgaatgtggaaggcagaggttgcatgagccaggatagcaccattgcactccagcctgggcaatagaccaagactatgtctcaaaaaaaacaagataaatgtatccaggatcctggagcagccatggggatgcaacctcctgagccctttcctctaataggaaaaaggcttccaatcggttctgcttcttcagcacagcgacagcacaagccctaagttgtttaaccacctaatgaaagctaagaaaacaatttccccttgccctctgcctaccagaaaacacacagaaaggcagctggtttgagagacctgccccaaggccccagcatggatcatgacggttgctagaagagtgagggctctgatctccaaaggctactctgtctcttaggcaacatcccagataccttgaacatctgatgcaaattcatttaaatctcctagtgaatctcatcgtctgtgatggccccatcctttgcattagcttcctctcgctttgcaattttaaagacacattgcaatgaaatgaagtgtacgggttgggctgggttgtgtcagggggtgacaaagtcacatgtcttcagtgtccgggcagtaacagcaagtgaaatggaggagagaccacagtaaattggcccctttaaaggatagtagccactcagttccaactggctcttaacctgatagaataagtatccagtgtttctagatgtttcaatatttcaagcaaatctggagacacaggttttatatgaattaccgccatttaaaaatgttggaaagtaattgaaaactaattactgagtactctgcaggccaaaggacacaattgcagttcagagggggcctatcggctcccaagttcgttcttacctggggctcctggaggtcaagcccttcccttcactgctcctgccttttggcaccatctgctggccatttcgaaattgttacctcctcattgcgccctttaagaaaaacatacatatcatttgtatggaagtacctaactgctctcaaaagtgagcatttgttggtttggggacagggatggaattgctttagcataaatgccgcacttcccctgggaatttcacaggcgttagaggtgaatttgataccaaggctctcttgatgtctgtagctacagcgtcaccccatcagtggctggcgtagtttggtcctctggccggctgggagggatctctcacacttgtctcgccttgcaacccttgaactgtgcagctttgtgaaaaagagcagttttcttaaacaaagaaggtctttggtcaaggtctaggaatgctgtgttaaccacacaagtttctttattgctccagaactactcaacttttctggctttctgggaataaagaacagtgagcaaatgtgcttttgagcctgggaagttgggcagttctaaagcgcagactcgcagggaaaaataagcatggtgtttcctaacctggctgttactgtttctacctctgcatttgtattccctgggtcccattcagctttcctccccatcaaacttctgtcttttcaatcgagggagtctacttaagacaaaaacagcttagaataattaagctatctcggcaccaattctccttcaacatgtgcggtattatataccaaaaatgaactgcagccgcacagtggctctaagtccaataatggagctatcattagagatatacgaaacactagactagtctcaaaagaacaaaaattgaattagaaattcaaatattctttgaactgtgttataaaatagtgaaactgaataaaaccatttgtgcttggcagccagctccagtaattagataattaaatcattggaaaatcctagactgtagagcatatcctatttgagcatttcattttcaaaactgatggattattctcaggaatagaaatttgttgcagacacaatggggtgggtagatttcaatgggacaaggggaacctaagcagaagatcaaggaaaccactaaaagcttgttcatgttatcttctgctctccaatttcacaggagttatcggtctaagagtggttctcaatcctggctactcattagaattatttgaaacccttagcaaaaataccagtgctcaggcacgatggccagagtctgacttcactggcacggactggaggctaggcactggtgactctagaacattccagggtaaaaactactgtttttacctcttggctacaggtaatatgaatgcttagtccatgaagacacctcctggaaatgttgagatagccagctattaccaatgacttaaagccttgacttcaaacaatgcacctcattcccagtggctaatctagtatgttctctgctagctacatttggtatgagagctatatggaacctttatagtgtgatattcccattcccaaataacggttgggtctgtaattagctagcaacaatgggaaagggttttgtcaaggttttgtgcctaacagatgttctcctccaatgatgattatgtttgcctgttacctttcctgatatcattttgaaaaaaagcccactttttctaaataatgaacatctttttcccaaaatgccacagtacttggattttaccaaagtcatcccatatctacagaagtgactgcacttcttcccctccttgtgggtggctgaggagagagagagaagcttctggaagagatggtacaggttctgtggaggccagataggcttggcataaagagaggatggcgacctcctacttctttcatccccaatctctttattctgcttcctgataaataaaaaattgggttgttcattacatttgtaggactcctgagaatttactgtcccttcccaagagaaggaggaggtaaaatatcaacataaaaaataaacacagtagtgcatagagccctatgtatttgaaatgatacaattcaatacaatttccttaatgtgtctttttatgagatggcgcctcgtggaaatgtgccagggtctcatttatcttctgacatgcataacaatggtcacgggaatgcggatccctgagaacagcatattggagtttcccatgtgcaacagacccgtgtcccctgccaagcagaaataataaacggaactagtacagggcttgacgattaggctgcttacaatgtgccaaggtctagtcagatcttcagacaacaagaagctttctaagatggggagacagcaccccaataacatgggttatatagctgtgaccaggcatcccttgtcttgttccctgaagcctgcaggaacagatccaggtgggatcaggagtcgttctgaggtctggctttcctcctgaatctttctgatttgtggtataaccactgttccatgtcactgctagacagcaaaatcagtccaattacattatccattgttggcaagactgatagtcttagattttacctaagaaatcaaaattgagtatgtgagatataggtccattttcaggttgggggaattaggtttaggcatttgctagtttctccatgaagtgatttggataacttatttggtccaattaaaattttaatggacaagagcattatttctgtctcttattttacaagagtgcttataaaaatggcaaagcattttcaataaattatctttctagctatgaggaataactgcaactctacttgccctcccactgtgggcaactagaaaactgaaaaataagcaaatgtatgaaacaaatgttttcagaaattaaacaacacaggaccgtaatccttaggagaatggggggaaaaaacctacagttgacccagctttctgtctggaggcacttttcagatcttggtgcaggaaggaaaaacccaagcatggcactgacagtgagttgaggagataagaccaaagtttagagagagctgaaacagctagaactggtggactggagaaccaaacacaagaaagctctgcagagaaagaagtacatcaataaatgggtctgttattaaatattaagccaagcatgtacagtgtgaaagcaaccgctaagccaggcagaaactaagtcgggggctgtaagccaaaaagttcccgaagttcacacaggcctgggagatgttcacgttttgaaaagcaaaaagcgaagaggccttgttgagcacctgggcattttgtagagatcggagaaggactgtgcctcagtcttaggactaaactagccccagaggaaagactacccttgatttaacctaactgcttaaaaataagcctttaaaggacaaagctgatccacaagtaactggactgtctgccagagaaagtccaaaatctgtaaaggaaaacaacaaaattcagagctccatgcccaatatccactcaaaaattactagacatgtgatgatgctgacaaatgtgacctataacattaagaaaaatttgtcaagagaaaccaaccagacatggcagggataatgaaatcagcagcaaggacttcaaaacagctattataattattctcaaggatttaaaggaagacatgaacataatgaggaaagaaatggaagatataaaaaatatccaagtggagctttcaagagctgaaaaacaatatccaaatgtgcttaacagaagattaatcactgcccaaaatgtcagtcaccctaaaaacagcaatggaaactgttcaaactgaagtatagagagacaagagactaaagaaaatgaattaaaatgtagtgaccagtgagacaatattaataaaagatgaagtggaaagagaaaaatattcaaaaaggtaatgactgaattttttccaaatttgatgaaagctgtaaatccacagaccaaaaaagctcagtgaacccctagaatggtaagcacaatggaaattgcaccaaagcacatggtagtcaaattgctaaaaaccagagataaatggaaaaatcttcaaagcagctgggggtggagagaaaacccattacatacaggaatcacaattaagaattaatgccaacttctcatcagaaacaaaaggcaagtcaggacacagtggaatgacgtctttaaagtattgaaaggaagaaaagtctttcagaaaacagagaatacttcctaactcattttatgaagcctgcattaccctaagagcaaaaccagacaaaaatattataagggaagaaaaccacaaaccaatatccctcacgaaaatatatgtaacaaatccttaacaaaacgttagtaactgaatccagcaatatataaaaagaataatacattatcctggggttttattccaggaatgcaagattgttttaatacgaaaaaaatcaacgtatttgaccttattaacagaaaaatcgtatttcaataaatgcagaaaaagcatgtaacaaaatttagcatcaatgataaaaacagcgctctagaagtagaaggaagcttccttaccttgataaacaatgtttgtgaatgacctacagaaaacatagttaatggtgaaacactaaacacattccccataaaatcaggagcaaggccaagaaacctactctgacatctgtttaacactgtactgaagattgtagcaagttcagtatggctagagaaagaaatagagtcacacaaatcgaaatgtaaaatgtctaattggctttactcacaaatgacatgattatatatgtgtaacattaaatggaatctacaaaacatgctactagaaataagtgacttgagcaagatcacaagaatcaagtcaatgtacacaaatattaaaattttgttatatccatttgtacaatgaaatgccacttagcaataaaagaatgaatcactgaaaaactcagcaacagggctggatctcagaaaaacatattctgaacaaaataagctggacacaaaggagcacatgttatataattccatttttataacgttctagaacacaaagaactcatctataatgacagaaagcagagtggtggtttctttgggctggggcttggggattgattgtaaaaggtctcaaaggaattttttaggatgataaaatatatagctgtctttcagcagtggttacatcagtgtatacatttgtcaaaattcatcgaacggtgcacttaagatggatatgttttattgtctgtaaactttgtgcctcaagacagttgattttaactattgaaatgtaggtatcacctcttaagcaaaaaccaacttaacaatttgagcttccaaaaagtaatttacttgaagcatttagagaaagatggtgatccacatcatatctttagcacttttttacactgtgctcagataagcaggaactgtcctgcagcctggagacagtggcaagaacaccagacagggagggcagggggactgggaaagcagacagagaacctatgtagaccttgttcattcatgattcactcctcattgcccacgtgccagccggtgagctatgacagcttccctctttagtaccctcagcaggatcctgtaaggccccgctttctagacaggaggataataaagcctaggattgaaacagagcctctccctctcctcctcttctagtggagtaagtctagttgtgtttaaacattatgccccgttgtattttccaatatttcttatccttctcagaaacgttatattgcgattcattcatagagcaaatacagttgccccttgaacaacatgggggttggggtgctgacccctcatgcagtaagaaatccataacttttggctcccccaaacttaactactaatagcctactgttgagtggaagccttaccaataatataaacagttgattaacacatattttgtatgttgtacatattatatactatatttgtttttttcacatgcctgctgtgtcaaatatatactgtattctgacaataaagtaagttgaagaaaagaaaatgttattaagaaaatcataagaaagggaaaatcataatattcattaagtggaagtggatcattataaaggtcttcatcctcattgtcttctcattgaatagattgaggaagagaaggggttggtcttgctgtctcaggggtggcagaagaggaaggaaatctacatataagtggacccatgcatgcagttctaacctgtgttgttcaagtgtcaactgtatatgttgggtacctaccatgtgccacacgctgcttgtagctgtgaacaaaatggcatgctccctgccttgatagaagaacaacttggggtggtggggaaattgatgagttgaattcagaagacctggttctaatcctaactgtgctctctaattgccgagcacaccctgagcatgtcctttgacttctcagggcctcacttttcccacctttcaattttatgaattttaaatattccaccaataatttctagcatgatatccattgttaatatccactatctaaccagaccccagatttacgtaagcttgttttaaaatttgggcaggagggttaggtgccctgctgtgccccatagctcatggcacagtgacatcatctgtctattcaaaagcccttttcttagtccatgaaatcatccttggtggcaaatcgaatcatatgaggagttttagaaattcccaacaaccagacggtacctcagaccagtaaaatgagaatctctcagttgggacccaggcattggtcactcttagacccatttaattatctactcattttcccctcacaaccctgtcatcactcattcccgcccccttcaaaggcaggagctctgtgggattggacacagggactgaagttgagcaaatcatcttgatagcacgtggctttgctgtgtgtggttaatcaaccgatatgaacagtgctgacctgtagccctgccacatccccgcagtgagagcaagacaaggcacaggagagctgatcccaacacatatctaagcccatgggtcacagcaggtttcaaccatttagagaagaattttggattcttcattgttgcctgttcttatcaatgttactgattcattcagttcattcattcaacagatgtattttcagttttctgctaatatgccagacacagtgtaccagagactctgtggagggcagaaattaaccaggtggagggaagagcattctgggagatgggaatagcaggtgcaaaggcctggcaaataggagtctggcggaggttgcagtgagctgcgatcacaccactgcactccaccctgggcaacagagtgagactctgtctcaaaaaaaaaaaaaaaaaaaaaggagcctggcccctatgaagaactgaaatgatgtatggcttgagcagagtgccaggtgcatggagggagggagattagccacaagggaagcgaccagattgcccagcgcctggagaatgggctgcagccagagagagcataggaggatgttgttctctgtacactgtctctaaaaatggtgctttttggctgggcacggtggctcatgcctgtaatcccagcactttggaaggctgcggcgggcagatcacttgcggtcaggagttcgagacctgcctgatgatcatggagaaaccccatctctactaaaaattcaaaattagccgggtgtggtggtgtggtgggcacctgtaatcccagctacttgggaggctgaggcagaagaatcgtttgaacccgggaggcagaggttgcagtgaactgagatcgtgccattgcactccagcctgggcaacaagagtgaaactccatctcaaaaaaaacaaacaagcaaaaaaatgatgccttttagcaaaatagtgactgactggcttttaataccacaataaaaagacattagcaaaagtggtgtgagagcatgatcatgagtcctgtagagaaagtaaccaaaagtgatacatttctatgtggttccctcccagacaaaatgccaggctccacccactagttcaccctccctgttagcaatggctggtacgtgttcaggtttagattggtgccagacactttattttattgtctcaccgagtctccatgaccaacctacgagctatgagatattactaccccttttttggatagacacagaggtgaatagcttgcccatggacacacatctactaagtggtaaaactggaaatcgaacccaggcagtctttccccagaggccagttcatcaccatgcagtgctgatgttgggacctaatggtggttctgcttgtggcctgtgttgaaatgttttatctttattcagagaaaacagaaggcatgatgtggctttaagcaggtggtgacatggtcagattgcatttcccctcaatttacatggataatggacagttgacaaagacatcatcacccccatgagatgataaaccagtccatgaaaccggaaaacaggaaaccattgaaatttgttaaatgatatttcagtggaactttggggataatatactaggcataatatcattattgtgatggaggctgattgagtgaattcactcgatggagctgctgttagaaaattgtcctgctccagggactcaagtgctcaaccagactcctgcgaagcctgaataaagctcccacctcctatattctctgggatgagaaacaagaatgttctcggaactgtttggaaattgtgagttctgtatacaggtagcctacctccaatctagagaaattcataaattgccaaaagccctggactcatccagaatcattatcattgccaacattaaagtcctatgttttaagcatctgtgatttcatggtacttggtacatggaaccatgtgaacgaaaaggacacagatcctctttgaactgatactgacgtatttcatagccaaatcaccacgtgttgagttcccattctacaccatgcggtatttcatgtaaccctcaagaatggccaaggaaagtggattccccatcattagaggtaaggaaatgaagaccaagggagtctaaataatgggcccaaagtctcacagtgggctagagagagagtatgggattagacccaaagtcttcttggctccaaagcaggtgccctgtgctgctccctctaaagatacatcagtgagagtttacgcctgttgtccatgatgcattgaccagagtagaaaaaggatcctttgtcttgcaggcagtctggttgccagttggctgccaaaattcagatgttggtggaagaagccacattatgtacagtctttgctccctttcctttctcattgaaataagtaaagattcagccgcagggctgtctacccaaagtgctccgaagacttcaaggcattcactcgcctccatttcaggcaggcagagcccactgaggttgatttttttgtgttcacagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtggtgagtgccagtcacttgcatgttgagctgtttcacctgcaaaggaaaattatcattactaagaaggaggtccttcccagttggtggtcttgccctctctttattgagcacctactgtgtaaaagttagagttctgctgatgctggtatatgtggacacttcagcacctgtccatggaggcccaggaaattcagtggccctcaggtgactgaatttctttaaaagttgcggcattgctgggcatggtagttcacacctgtagtcccagttactcatgaggctgaggcgggaggattgcttgagtccaggagttcgagaccagcctgggtaacacagggagatcctgtctcttaaaaaaaaaaaaaaaacagagagagttgcagcttcatactctcctccagggctcagcaacacacaaaattaaaaggagtaaatggcaaaacccaatggcaaataggaagcctatatttcatctcaataaattaaaactaatggccaaaataacacagctctaaaattatcttcctattattcaactgtagttaaaattgcaaaagaagaatttaaatgtaaaatgtatctgatccagaatgaaaaatgcttccttagctgttatgaatgttatttaaggttcttattgaaagcatctatcaagtcctactattgaaatgagcagaattttattactcccccgtcaccaggcaggcacatcttttatggtaattgtatgttttggtatgcaatgaagatttatcatagaactatctcaccttttagtataatgaatagtaattttgaggggtttctccagtgttgataattctcttgtttcttggaaaacttaaatctttcaaatggggattgtaagggagcagtttgcaaactcttctcatggccataatgagaaaagatttccatgatggaaagcattgtgctcagtcacctatctcctattggagctgtggctcgtgtcgccctggatgccaacctaatgtgtttgattaaaattagagtgtccctctcagcagtctagagggaaaaaaacatcaatttgagttattcttttcctaataaattaaattaggctgctgttcatccatatctcaaaatagcttccaaaattctacttagttcacacatttatagacagagttaatcacccaccatgagttggtaaggctgttatttgtctgaaatgtctttgtgacagcccaattatctaaaactaggtctccagtttcttctttaaaacttcttttaaaatgcatatcctggctgggcacggaggctcatacctgtaatcccagcactttgggaggccgaggcagccagatcacctgaggtcaggagttcgagaccagcctggccaacatggcaaaaccccgtctctactaaaaatacaaaaaaaatagctggccattgtggtgtgtgcctgtagtcccagctactcaggaggctgaggcaagagaattgcttgaacccgggaggggaaggttgtggtgagccgagattgcaccactgcactccagcctgggcaacagagcacaactccgtctcaaaaaataatagtaaaaataaaaataaaaatatatatccttttaaaaacatttatataaattttccaataaaattatgaaaaaaaatttttttgagttggagtcttgctctgttgcccaggctggagtgcagtggcatgatctcggctcactgcaacctccaactcctgggttcaagcctattctcctatgtcagcctcccgagtagctgggattacaggtgcacaccatgatgcccagctaatttttgtatttttagtaaagacggcgtttcaccatattggtcaggctggtctcaaactcctgacctcaggtgatccacctgcctcagcctcccaaagtgttgggattacaggcatgagccaccacgcccggccagtaaatttcttctttttaaaaattgtgtttattggttagctgagataattctcacttctggcctagaaaagccatctttaatctcaataatactctgagattacagcctagcataggaatgagacagaaaaggtagtggaacgaacatatcataagagggctttatctggttggatttgtgggaaggccacagatgagtaaaagaggcaaagagcccttgaggatcttcagtctagcaaaggcaacctgataaataggagtatagccccgaacaggggatttacaggtaccagttgtacccacacaaaagagagactaacccagggatcaggaagacttaacctgaatgaagtcattctttgtatgacccacaggccacaaacagtatcttgcacatagtagtttcagaaatggtttgttaggctgggcacaatggttcatgcctatagtcccagcagtttgggaggctgaggtgggagaatcacttgggaccaggaattcaagaacaggctgggcaatatagcaggaccctgtctctactaaaaataaaaaattagccagctgtggtggcatgcctctgtagtctcagctactcaggaggctgaagcaggaggatcgtttgagcccaggagttcaaagctgcagtgagctatgactgcacctctgcattccagcatggatatcagagcaagactcaatctctaaaacaagaaagaagaaagaaagaaatggtttgttaaactcaactgaggtggccttgaagatggggagattgcatcagcagaggctagagatggaaggacttccaggcagtagaaccctgcaaaccaacaagtttctggcctggaaaatgcaagatgtctttagagaactggggagcagtccagttaggcagcagagttgggtgcaagatactaataacatcccatatttggggagtgtcattcccatttgcacactgacttcctgtatcttagaccatactcaggcctcacatacctgcttgatgcctgtctgggctgtgcctacagagattggaagattctgtaagagaaacctggatttctggcttttcttgaaagttccggggttcaaccccagattcacaatttctgtggatggggcttaggaatctgcagtttacaaacaaagccggtgattctgaagcactttcacatttgagagttactgcctagaatgatgaggaagacactgagtgtttgggtttgtttggtttttgtttttgatcaaggaagtagcaaagctagagctgtattggagagaggtccctctggtgatcatgtgccggactgattaagaggaaaatagatcagtgactaggagaccatatgggaagctactgtatccgtcaggcaaaaggcagtgaggcctgaaccacatagtagaagtaagaaagaagtcaaatgcaaaacgtcctatggtattcaccgtctaagactagctctcaaaattcttctttaaaacaccttttgaaatatatatccttttggctgggtgcagtggctcatgcctgtaaccccagcactttgggaggctgaggtgggaagatcgcttgagcccaggaattcaagaccagcctgggcaacgcaggaacacagggacacccaatgtctacaaaataaaaattaaaattaaaaataaaccctagccgatcatggtggcacacacctgtggtcccagctactcaggaagctgaggtaggagcatggcttgagcctggcgggtcaaggctgcacgatcacaccactgcaccccagcctgggtaacagagcaaaaccctgttaaaaaaaaaaaaaaaactaaaaatatctatatacatatatatccttttaataatggtagtgtaaattttccttccataaggtataaagtaggttaactgattggatggctagatctgaatggcaagacagcaggttataaaagacagctggaaatagctagaagagaagaactagaatgtttctagcatgaagaaaagacaaatatttaaggtgacggatatcccaagtacactgatttgatctgtacaaattatatgtactaaattatcacatgtaccccaaaactcacatctattatgcgtcgatttttaaaaagagcttattttttaaaagccagaaatttcaactctggaatatcagaacagtgatatccctctttccttcccctctccctcctcgttctcctttttgttcttctccttcttcttcttccaagtactagaatataagtctccttgtggagcatgttaggttgaattactggtgagccattcagaaggcagagagaagaaacttgggcctaaaactgtgaagagatgggctgggcacagtgattcacacctataatcccagcactttgggaggccaaggtgggtagatcacttgaggtcaggagttagagaccagtctggccaacatggcgaatccctatctctactgaaaatacaaaaattagctgggcatggtggcgggcacctgtaatcccagctactcagcaggctgaggcaagagaatcacttgaacccgggagacggaggttgcagtaagctaagatcaggccactgcactccagcctgggtgacagagagagactgtctaaaaataaaaaaataaaactatgaaaagaaattgggtctagataatttctacatgaaaataataattggtcttctaataacagtcaagtgaaatacattccaacaaactgcatgcttctttttaacaaagctaggatgaaaagccacttaaacaaatagaatgctgtaaactgtgacgtctatgaatatctgacattctgtggagcaaagctgatattttaaaagtcatattgattaccatgtcaaaaatttatttccagcattcattttagccccatgtctctgttacatttttgaatgaacaaatttgatttttaatgttttatctaaagtaggtatcataaacgtttgcatagaagtgatattgttgtgtacaattgtatcaatatacatttctgtatattccataaagctgtgaagtttaagcgtctccgtatgcaaggttgtgaaatccaagaggcatattgtatagaagagatcaaaacagaattctaggcagactgactttgagtcagatgacagctccttgaagtattaattacgcactgacagacatgttggttgttcacggaaccaggaaaatatttggtccttagctcttccagcaaagctttgcaggactggaccctgtgtccagtcaatacagggaagtcattctgtttggttgtgcaatagaaaagaacttttccacacgaagttaccatatttatttagagcccttcagtgaggtggcacaatctcttcgtgtcaagaatccaatagctgtaggaagtttcccgtgggtgtgttcacagaacactgggcccctttccatagttcacagacgtggacaatgagcagatgaggctttctccctctggtcctgaagtagcatcatttcatctgaaatggccacaagcaattttggtttatttttcataacagaatcaaagacatcaccaaaaactccatcccacttcttgcaggggaggaatttgttattttcccttggatcctgttgaacacatgtggcatcctgcctgaacccctcccgcagctgccatgcgatccagagctccatccacttgcccacctaagtggaaagggccttcgagggccatcagtttgcagacgacactgtgcattcctttttctctttcggacgctggctccacaatccgggctccaggaggtggaatcgctgttcacttactgccccctagtggtccgcatttctgaaagttctttatccctgtttcctttgagatttttctccgtagatttataggtgtttaggatggggttagtaatgtggccaaggaggtggttgttttctcaagggtgagacctcgtctccgatctccgtctcttggagctagcattcccctctatccacagacaccacgtctgtcgtcatttttattttctgcaatcatttcttctcttggtagcttggagaagagttcatccttgttgatgagacaatcagtataaaccagaggttctcatttaggggcaattttgctcccccttccccagggacattggacaatgtctgggtctggagacattctggtttgtcacaagctggggtaggcaaggtttctactggcatccagtagatgaaggccaggggcgctgctaaacatcgtaccgtgcagtttccccacaccacagcgaagaattacacagcccaaaatgtcaaatgctgaagttgaaaagcctgatattaaccactgtgggcttcttgttttactgcaccgcaggtcggtctccctctctctctctttctctctttctccctctctctcctaccccaccctcccacctatccctccttctgtccctctgttggcatcagcaccactgaataaaaagactcggtcctctgttagccaggcacaatcgtccctttggccaatgtagaacattccctggaaaaccctccttgtacctgcctcacaccactgcaaaatgttcccagccactgttaaaagatgagcgacccccctccaccaccaccacacgaaaggcaggggggaggagctggggctctacacaaaatcagaggctgagacgggcactcggcccctcctcttcctctgtgaggcctcgtgttcagctctatgtgctggtgtccttgctcccgcagcgagttggaagactttgttgaagacttgaagaaggactccacggcagccagccgattggttactctgaaagacgtggaagacggggctttcctcctgcgtcaagtgggagaggctgtagctaccctgaaaggtaaactttctgctgggtcgggggaggagtctgagctgtctttcctgcggtgtttaaaaatctgccacatagaggattcattcatgtatgcaagtatttattaaacgtctacatgtgccaggcattgttctggacacttgggataccccacagcacaaagtaggtgcacatccccctcttcttggagctggtattagagtgggtgctgtaagatttcacactaaatgattccagtaacactttctatttgctaggctcttacagtgcaccgggatgcatgtgccaaacccgttaaaaacacaaggtgggaggatcacttgatcccaggagttcaagaccagcctgggcaatatagagagactcacatctctaccaaaaaaaaaaaaaaaaaaaaaaaaatatatatatatatatatatatatacacacacacacaaaaaaaaattagccaggtgtggtggtgcatgcctgtggtaccagctacttaggaggctgaggtggtaggatctcttgagcctgtgaggtcaaggctatggtgagccaccattgcaccactgcactccagcctggcagcctgggtggcagagtgagaccctgtctccaaaaaataaaaataaaaaacaaaaaataaaaaattaaattaaattaaaaacctgtaaccaggcacggtggctcacgcctgcaatcctagcactttgggaggccaaggcaggaaaatcgcctgaggccaggagttcaagaccagcctaggaaacataacaaaaccccatctctaaaaaaaaaaaaaaagtttttttttttttttttttctggccaggcgtagtggctcatgccactttgggaggctgaggcgggcagatcacttgaggtcaggagttcgaaaccagcctagccaacagagtaaaaccctgtctgtactaaaaatacaaaaattagctgggcatggtggcacaaacctgtagtcccagctactcagctgaggcaggagaattacttgaacccaggaggcggaggttacagtaagccaagatcatgccactgcactccagcctgggtgacagagggagactccatctcaaaaaaagaaaaaaaaagttgaattagctgggcatggtggtgtgcagcacctaaatagtcccagctatccaggaagctgaggcaggaggatcgcttgagcccaggtgtttgaggctccagtgagctctgatcatgccactgcactccagcctggatgacagagtgagaccctgtcagccagtcaaattaaaaagtaataataataaccctaatggtcaattggctttatcccaaatacacagacaggaaacaggcctagaggagctttacccttgcccaaggtgagtttctccaatgctcctctgtgctcttaacccactgccacctgaagatgtgtgagccaccctgtggcttgtgaactctgcacttctctgtccagtatcggagtgcgggatgagggttgtcgttctggctttttctcctccaattcacctgctggtttgggcctgcaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggaggtgaccgggccctcatcgtgctgggggtggcctgcggaggggtgcactgggaaaccgagagtggacgtttgggacttcagccttccaccatgctcccaggacacatccagtgtcctgaggaaaagccccaagtccttctcacccttgaacttttattgcaatatggcttgaggttctaattcttcaacacaggattgctaggtggagcccatcctagggtttaaaattaatagacacagtaaacattgttttaaaatcatctgaaaggccaggtgtggtggccactcaggaggtacaggcagaaggatcccttgagcccaggagtatgaggctgcagtgagctatgactgagccactgcactccagcctgggcaacagagaaagactccatttcttttaaaaaaatcatcggaaggtgggttttttaaaataacattttgaagttgaaaaattgattgaaatagtttattagcctccttcacttcaggggcatagatgaattcagttcaaagaaatgtaatagaagtaaacaaagtctttcttaaatgacctcctgaaggagtatctgtgagactgttggtcccacctagaaaagaggaacaaagcattttgagtggcctgggccaggcttccttaccaaaggtaaacctgctcaccgaagaggtcacagtggagtaaagaccaaaagacattcaggaatttcactgcaaagaaaattccaggactccacactcactgaaaacacatatgcatgcaaaatttgtgttgccagaagtaccttcactggccaggcacagtggctcacacctgtcatccccgcactttgggagctgaggtgggtggatcacttgaggtcaggagttggagactagcctggccaacatagtgaattcccataggtattacaggcggtggcgtgcctgtaatcccagctacttgggaggctgagggaggagaattacttgaacccaggaggtggaggctacagtgagccgaggttgtgccactgcactccagcctgggagacagagcatgaagtcagcttcatggagatgattattgaaaatgggaaagatcactgggtgcagtggcacgtgctcgtaatcccagctactcaggaggctgagatgggaggatcacttaggccaggagttcaaggctgcagtgagctatgatcacaccactgcactccagcctgggtgacagagcaagaccccatctctacaaaaaattattttaaaaattagccaggaagggtggtatacacctgtagtcccagctacttaggaggctgaggcaggaagatctcttgaacgtaagagtttgaggctgcagtgggctaggattgagccactgcactccagcctgggcaacagagcgaggccctgtttcttaaaagaaaagaaaatggaagagatggttgaggcagaatgatagggaaaggagagaacaaatccttggggatctctaagaatctaagggattggggtaaaaaaagaaacagcaaaagaaagagcactgagtagcagaagagttatagaatgcaatgtcttttttcaaataaaaaaaagtaacataataaaaaggggatgagggactaactaaaaattagaggtcaagtaccatgtttgacattgcctcacacataactttacaatgttaatgttagtcctaacgacaggtcctgaggaagtcattatcatcaccatcgtcatccccatcttcatcactccattttatgcaaaagcacctgaggcttaaagaggcgaagttctcaacgttatataaagcatgaactaactgctattcaaacacagatctgacaccagacactctgtcttttccactacatcatgggtggggagggacatatagcttcaaatgactccaaacaccagaggaagttgaggaataaacacgaccgttagatttcgagtcactgtgtaccttgtggcaagacttcgttgaatccaggtggggaagccagtgagcaacaggttgagatacagaagagcaaacagaaggaattagaatgtgggcggcccacccaagatgcttggcagtgaaaggaggagggaataagcaaacttttggcttagaactaagcatatttgagggctgcataggccagaatcaggcggaggagttagagaggctgctgttagactcatgattcattttcttctacccaccccccaaacaatgatggagttgcaagggtctgagcacaactgcaccagcagaaagggatatgtctatacatgtccctaagcggctactctgagctttgggatgtgtgactctcacctggctttgggatgacatagcctgcaagtataccaccatgagaaagtgacatgagggttaatgccgctgtgcatggtttctcctagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgaggtagagtcctatttctgtttctcataaccccataaaggagtctgatacatggacctttcccttaaagcatttataggtcagatgatgacatgattgtgtatggatcagagacagggttttggaagtggaagtgggattcagtggccaggttaagagataggtcatgtggtttcagagaagggtgagacacctggcctgtaggaaggtgagacacctggcctgtaggaaggtgagacacctggcctgtaggaaggtgagacagcagtgtgctggtaaatgtttaacaaccagctctctggtagcggttgtggcggcggggtgggggggcagagtgggtgcgtgcagatctgtgtgtggcatttgccaatttccatggtgtaaatatcgcaaccatggctgatttcaagttatgacatgacaccactactgctgaagttgggagaaatgtaacaatcagctctcctgggccaggacaagccggcttcaagcactccactgaggtgaaggcagcctggggagggtctgccacacatctagatgataagtggaacctggttagcatgggagggtggtgagggcatcctaggatactaaaatgctggatcaaagtctgggaccatgactaagcctgtctaagtggaacaagaacgaggacctaagactggggaaatgggctggaaactgacttgagtgcttgaaaaacagtccatgatgtttggagtttatttggaaggtatcagagaaatgctgcagctctaatccgtgattttttttaaatggcatcttctggaaattaatctagaaacaacgtacagaattgattgaggtggtgggtctagaattaagagagctggatgagaaattactatagtcatctaagaatgaacggtagagcagtcagaatgaaaagagaaaactaggtcttaagaccaaatgacatgaggccatgtgtggtggctcacacctgtaataccagcactttgggaggccgaggcgggtcgatcactggaacatgagtgcaagactagcctgggcaacatgacaaagtcccaactctaccaaaaaaaatacaaaaattagctgggcatggtggcgcgtgcctgtagccccagctactcagggggttgaggtgggtggatcacccaggcccagggaggtcaaggcttcagtgagccaagatcacgccactgcactctagcctgggcgacagagtgagaccctgtcttaaaaatcataagatcaaatgacatattatgtttttaaatattctttttatcaagggctggtaccagtgctccgataacacatttgtcttttctacttcttttttcttcttgcctcgtaacttttcctccactcatttgctttatcacccaacaaccttgtcgtaaccctcctgcctctactgaaagtcaccagtggagaggtcaggttgggtatatcgagacgacctggcaaaactgccacagccacggtcgcagcctcggggcctctgaacactaggtggtttctctgtgtcgcaagggccctggcttgcctctaatcagagccagctattttaaaaacgcatatcacaagggtacagaaatgtgattgacagagtgtgattctattcccagtacctagtagggcaggggagggaaagacatttcctcctaagaattggcagatccgtcacttaagacgtcttgccactttaaacatctcaacatttaaaggatgtcagtatgatggcactcttatttaacaaatctctgttgagaacctagtgggcatagttatcattgtgatgtgtgtattttacgctttgagaggagacacgagtcatctctgaaaatgccctgatccacaggtatggaggcctgggtttttctgccagctctgccactgacaaatggggtgagctttattcattcaacagagattactgagcctgttatgtaccaggccctcgtaggctcgggggaaagccagtgaacagaagagacaaagtctctgccctcaagacacttacctacttgtaggaagagacagaaaaaaagtatatgccaggtggtaataaatgctaggaagaaaaaataaaggagggttagaatggtgaaggtggtggctattatttatatgtaatgaaacttgggcaaattctccatctcgctggacctcaaagttcccatatgttgattcaatgatctttgccaattcttaggttataaggttccactaatcttggtgtgaatttccactctgcccccttagaattattaatgtgctggttcaaaagtcacagaaaacattcttttaaaaagtatgcagatgttttaaaatgcattttatgtataactctctgttgtggaacttaaaggagtttacaggtcatctaaataatacctcctccctcattttataagtaggacaatgtgacccagagggcatatagcaattctttgatagaagtggtactaagacacaggatttttgttcttagtgttgtgggttttgtttgtttgcttggacatctcttctacaatgaaaactcaatttaaaaaaattttaggctgggcatggtggctcatgcctgtaatcccagcactttggattataggcatgagccaccatgcccagcctaattttttttttaattgagtgagactcatgtctcactcagggcagaaggattccttgaggcaggttgtttaagaccagcctgggcaacgtaacagaacccattgctacttaaaaaaaaaaaaaattagccatgtgtggtggctgaacatgtgtaatcctagttactcaggaggctgaggcaggaggattgcttaagcccagatgttggaggctgcagtgagctataatgacaccactgcactgcagcttggatgacagattgagaccctgcctctaaaaaaatacatcttggtagtagaaaaaatacttttaaaagcatcttttttaaagttcaggggtacaattgcaggtttgttgcataagtaaacatgtcatatgggtttgttgtgcagattatttcatcacccaggtcttaagcccagtacccattagttatttttcctgatcctctccttcctcccaccctccaccctctgagaggtcccagtgtccgttgttctcctctatgtgtccacgtaacttcctttacgtgctatattcctccagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcaggtaagttccggtcccacagcaggaatatatggaggtacatggctttgggcaaatacagtgccatccacgacagcacatactcatcaacagaaccaatgtctcagttcttacaaatcttacaaaatgtaaaacctggaagagcaaatcctctggtgttccttagatctttactactatctctctctttttgttttttttttttgtttttttttttgtttttgaaatggggtcttgctctgccacccaggctggagtgtagtggtatgatcttagctcactataacttccaactactgggctcaagcaatcctcccacctcagcctcccaagaagtagctagggctgtagatgtgtacaccactgcacatgtctaatttttttttatttttttagagacaggtttcttcctctgttgccttggctggtctcgaacttctggcctcaagcaatcctcccaccttagcttccagagtagctagaattacaggcttgagccacacttgatttcactactactgttttatgctaaccacagtagagaagctgagttctgtgttaggattctagaataatggccaataaaggaaaatttaaattcatagtgtttgcgttttctatgcatttgtgatacttcacagcaagagctgggaaaatattaggcctgcatttaagacaagagcttttgcagaaagaaaatggtagcttttatgagctctcgggggatattagatcataaggcaaaattgcattttttaatcaaaattattagaatatgtatttaaccaactcaactatggaagttaaatgccaacatgtgaataataatataacttctaagaatctcaacctattaaatatcctatcagttacaagccacgcgtcttattctgatcttaaaattatggacccggatgttattttacttgcagtctaatgtctctgcagtgtcacattccacagtgccttatccagcaactaaaattaatttggaaaggaatccccatcttgacttgcatgttgagaaacattaaagtgtattccatttataaccaccgtacagtcatcccttggtatccatgggagattagttccaggactcccattggataccaaaatctgaggacgttccagttcctggtataaaatggcatggtatttgcatgtaacctactcacatcctcccatatactttacgggccagaacacttcagcagtgtgattctgctgcctgcctccatatactttaaatcatctctacattacttatgatacctaatacaatgcctacacattacttcatttgtgtggattcaacatagtacttggcacaaggcaaattcaagttttattttttggaatgtggagggaatttatatatatatatatatttttccatctgcagttggttgaatccacagatgtggaacccatggatgcagaggaccaactgcacttgtctcctccccagttttcatccatttcatcccctaaagttccactcactgcatccctccccctcagtctgtgctaagaggcttttcttacacctttccccaccatccagctgtgtcaggtctgtctagggtcctgggcggggcggctcttctcacacaaagtgactttcctctcacagtccccgtggagaatttctgatggagaaaatgccctagctcatcacatttttttttttttttttgagactgagtctcactctgtcacccaggctggagtttagtggcatgatcttggctccctgcaacctccgcctcctgggttcaagcaattcttctccctcagcctcccaaatagctagcattacaggcacccaccaccacgcctagctaatttttgtatttttagtagagatgggtttcaccgtgttggccaggctgatctcgaactcctgacctcaggtgatccacctgcctcggtctcccatagtgctgggatttcaggcctgagtcaccggccagctcatcacatttttatcttgtgtaattctgttctctctgccccattattaattttgtcatagagtcctttgatgttttatataggtctcataactgttccttctcatgattgaacaacaaaaacatattacattttgttcacttacctcattttggctcttgattctatctgattttttaaatttgcctaaatcacttttaaattactccccaaggtattttgacttagttaaaatgctcttgttttttcttttttaatgcatctctgacctggtctcagaaacagtacagtgatggacaggctaccagagatgtgtaaaggtagcatccgtgacctgtaaacattagtttctgtcattttaatttatttgtcatggagttatcatttttaatgtatttttgtttattaaggaggcaaatttctaagtgtagagttttaaataccatttgtatttccccttgtgtgaattttctgactacttggataatggaggaatatgggtagtgatcaaaaattgataaaggctggcgtggtggctcatgcctataatcccagtgcttttggaggccaacacaggaggaatcacttgaagccaggacttcaagagcagcctgggcagcatagtgagacccccctctttacaaaaattaaaaaatccgctgggcatggtggcacacacctgcagttccagctactctgggctggggcaggaagattgcttgagcccaggagtttgaggctgaggtgagccgtgatggcaccactgcacttcagcctgagtgaaagagcaataccctgtctcaaaaataaaacaaaaaaggcctggtgcagtggctcacacctgtaatcccagcactttgggaggctgaggcagacagattgcttgatcccaggagttcaagaccagcctgtgcaacatggcagaaaccccgcctgtaaaaaaaaaaagaaaagaaaagaaattagccaggtgttgtgacacacacctgtaatgccagctactagggaggctaaggtgggaggatcacctgagccccggaggctgaggcctcagtgagccttgatcacaccactgcattccagagtgagtgacagtgagaccctatctacaaaataaaaaaaattaaaaaatttgtttaattaaaaaaatcaaatccacttcctctccaactttgttctttgttctcatttgcatcccattttttctctggccctccctaagccagattctactctgacattgaccttcagcagaaacccctcttgctgatactgttttttcagactgagggatgaagtatttggaggccaagccaggggctatggatttgcctttgggcttcaattttttttttttatctatccaagtaatactcagctttttccataacaagaatgttatttaataatagtaggtaatactttacatagcatttacactatgccaagctcagcgtataagtcattcaatccttatgacaccccagaggaaagtatattatactacccatttaacagatgagaaaactgagaccgagagaggtttagtaacttgtgcagggtctttttgggatttaaatccagtcactctttagggtctatacacttaatccttgctctatggagagaacagaaaatttttaaatcagattgcattgggtttgtagcaatataccagactttctggatgttttcttgaaaaaagattattcttgtaatggtgcactgttttccagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggtctgataggctaagccctggtaaactggcctctgggttcagatgatacccttagacaaggttctctctgttggaacataaaaagtagtgaggcagagaagtagtaactcgaccacacaagatccccaggaagcaccacagatggaacaatggcagccagtatgattggactagacccagaccatgagttttatccttattttacttttagctgcaacaatatgaaatgcaaatcacaagctatttcccatgtgggcatcataagattgaaaatgagggtaggagggggaaacgcaagaaagattatcttccaaaggtaactgaggtgagctgacaccgttgtgggagtctatacagaaagatgttcaatgagctttaaattccacttaactaaccaagtgttagctttcatgttaaatgtaaaacacaatttccaaagagatgcagtatgggagggcctttcatgaggactgtattagtctgttctcagggtgctgatagagacatgcctgagactgggtgataaagggaagagatttaatggactcacagttccatgtggctggggaggtctcacaattatggcagaagatgaaggaagagcaaaggcacttctcacatggtggcaggcaagaaagagattgtgcaggggaactcccatttataaaacggtccgatctcgtgagacttattcaccacctcgagaacagcacgggaaagacctgcccccatgagtcaattacctcccacctgatccctccaatgacacgtgggaattacgggagctacagttcaagatgagatttgggtggggtcacagccaaaccatatcaaagacactgaatgttgaggagttccaattatattataattatttaatccattcaccaaaatgacaacttatgcaaacacaaatacaaactaaatgcaaaggaataaaatagcctttcagctattttctcagctaagatctaggaagcaagtgttctagacagtgagggaccatacgatctgtcccttttttgctagcacctaggagatgttaaaccactatctgttgtttcaatctcccacaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggtatgtggatgaggtgactgacattggctccttgcctcccgcctgggtctctccagccatggcactcacagatttgttagcgagaaggccagggaagcgcatggaccgggaccatagaagctgtgtcttctggccttagcctttgctttcccaagatggcgctgaacaaggctctcaggatgcctataagatgtgcaaggaatgaccatttcacaaaacaactcacgctttcctacctctggctgtaaaattgactttcctttctttccatcttaagagattctgcttcatttcaaaagcaagtaagataaggattagaaataccagccattgtcctgtcttgataaggacagactgaaggacacgttacgtgggttcccgttccttggctttaccacttagagccactgaccttggatcatggactcaaggccaatgactggcctcctgtggtccataaccaggtccctgttcaatatcaatgtcatcttttcagatattctgaaaagctgaattattttgttttccattttccttggtctatttgagaaatgatactgtatcagttttagatatttattttttaactatgacacagtccactcataggatgaaggatggcgtgccaaggctgtgcccaaaactgatcccacattcccatcacggatgtgattctaccccaggtctatgtcctgagaacttgtctcatcagagacatataaacaattcctagaacaaactttgtgtagagtatttcatttgcctcatgcttcttataggatttttctgtcaatcagatagttggaacaccagcaccttggggctcaaaaacatgttagctttttaccgacgtaccaatggctttgtgccaacccataaattttcctcttttctttggagtagggagaattttcaatctacattgtttttactgcacttgttctactctggtttccatggtaataactgccaaaattgagctgcctggattttgcagggaaaacagaactgctggttgatttgtcacatacgtgagccctttcacacttcactaaaactcacagactagcctgggacatccccgcaaccaatcaggctatttgcaggtttttagaaggcttggataattgttttcataggaactacagatttataaagctggtatctttcaggcttgtggataattttttacacctctctaagagaaatactaaatttgttgcagccacttacagcccaccactgagggacactcttctccattgaagtctaaatatttgatgccctctttgaccactgtacagacattggcatatctggcttcatgtcatattcttggtggttacataataaaagtggtggccaggcatggtggctcatgtctgtaatcccagcactttgggaggctgaggcgggcagatcacctgaggtcaggagttcgagaccaacctggccaacataacgaaaccccatctctactaaaaactacaaaaattagctgggcatggtggtgggtgcctgtaatcccagctactcgggaggctgagacaggaaaatcacttggacccgggaggtggaagttgcagtgagccaggatcacaccactgcacttcagcctgggtgacaagagtgaaactctgtctcaaaaaaaaaaaaaaaaaaaaaagcgtggtgaatgaagtgctctaaccttaacttaaccaaaccctgttagccctctggctgggatagaaacccagcctgctaaatccgcaactcgatcaatggccagtggccataatgattctcttgtttctgcaccttctcaaggcaggacaaggagcagctgtggccccttctaaggacagttgtggaaccactttctgtgctccacatctccaggcatcagaagaaaacacaggctctgaaatcgagggtctaatagctcaaaggagatggcaattggcatttgtaagcagctttctaagtaagcggataaaccaaacacatccggggcaagctaggactggtatgactaaggaacagcaaggagaccaggtacagcagagacaggggagcaaacagtcatggaagaaaaggccagagaaagtccctcatcagccaccttcagattttaggaccagtgttggaatgtttactgagggaggacatacattattctttctgctggcagagatatctccaaatgacaacatttgacataaagaaaacactaggcaattatttaggctgattcatttaaataagtggtctttcaccaggcacagtggcttatacctgcaatcccagcactttgggaggctgaggtgggcagattgcttgaggtcagcagtttgagaccagcctggccaacatggtgaaaccccatctctactaaaactacaaaaaaatcagccaggcgtggtggcgggtgcctgtcatcccagctacctgggaggctgaggcaggagaattgcttgaacccgggaagcagaggttgcagtgagctgagatctcaccactgcactccagcgtgggcgacagggagagactctgcctcaaataaataaacaaacaaacaaacaaataaaaatagtttttaatcctagctgcacattagaattactttgggagttaaaaaaaaatcctacagctcagagattctgatttgtgtattctctgagtggggtctcaagagtatttgagaacaacagtattttttttttaacctgggtggtatatagcctggttgagaaccactgttgtccataaacttgggtccctgagttaccagtctctccttctctcatgatcatattatctgggcattgcccacatgcccgcttcctttttagccctgtagacacagtctatgtctatactttctccctttgtctgagaactgaccttcctgactgaagttcacaagagccaacagttggctcttatagttttcagagacaaatctccagggttcaggcagctcctaggccactcggaatgacatcgttgcttaaaagcatcactttactctaaatgagcctcagaacacctcggagcgcggtagtacctgttactatttcagagaaggattgctaagagtacttttattgtaagacttaaaggtttaaaacgtcttgtgagcttttgctgtataatttcaataaaactcataaaaaaagaggaataaaaaagaaagatagttttttgttttaatttatttacatattgagcattttttaaatgtcaaagcaagaagccctcctaagtaccaatttatgttcaccccagacaggcagaaaaggtagtaatgtctattttatcttggcattccccaagaaaggaaggcagcctttgcctcggactctgcctccaagccagctttgtcaacatgagagcacgtgaggagcaggatttcagggtgctgcctccctggcctaaacctgcgtgcaggacccgggttggggtccacaagcgtctggttgttcctgcctgtttccctccattctcctcagtacccttggatccctgttaacctcagtattttaattccttaggcattccagaagtgttcctttatggatgtaaattcaaacagtcatgctgagccatcccgggctgacagtcacgttaaagacactaggtcgggcgccacagtgccacccaaggagaagaaggtaacgtggcaactgcacatttgccacacggttgggagtccttccttccttgctctgacactaacacggctcttatactcgacctttgtcccctctgtcttttttctctctcttttttttaactaatggagacacaggcataggttaaaatcagagatatcttgctcaggttttcagagcaaacactgtgttccagcccacagcatacaatagtatatgcagaatttagacactatcttcccaaactaaagagtgaacacctttcagtactttctagaacaactctagaaagaaatatatagaaacagcaaccaagtatttagcagtttttctaatttgtaagaccctttgggaaaaaaagaaaaacaactatatatgttaagaaaaataggtaaaaatcggctgggtgcagtggctcacgcttgtaatcccaccactttgggaggccgaggcaggtggatcacctgaggtcaggagttcgagaccagcctggccaacatggtgaaaccccatctctacttaaaatacaaaaaattagctgggtgtggaggtggacacctctattctcagctactcgggaggctgaggcaggaggatcgcttgaacccaggaggtggaggttgcagtgagccgagattgcgccactgcactccagcctgggcaacaagagcaaaactctgtctcaaaaaaaaaaaaaaagtaaaaacctttgatttgggaaagaaaatgcatggtagaaagtatctaccaccacacactggtgtaacctcatggaaacatacaaatgtgtatttgcacaaacgtccaaggatgccaaacagaatttttgctaagtattatccatttataaagtgtaccttccaagatagtaagttcagtatagttttagtgttaacatacatgtgtgatgtcaaaaaaagaatccaggctctgaaacaaagtctgctgtcattgtataagtaagcactctagggaaacgaccatagcctgaatgtttgaaatgcaactttaagttgcacctagagcatctctgattttcagatataaagacatcttacttgaattaagcttccatctaaacttcaggataaaaagcttgcaaggcctaacatttttctccagggacttatctttcagaattcaaagattctagctttccttaaacaaaatcaaactaatcagatgcaagagagcccaatagctactacagatgggtacctcagtccatgtacgacagctcaaggaggtagatgtagtatcacaaaactgaaaggctattctaacacaaccattcaagagacacagttttgggctcccagctcccagccaagaggccttgccaaggaggccagcttgcttccccctggctcataaccaccacggcacccttgtgtaaactctctgccacataaattgacatgtgacactgttaatgggggaagggaatctcgctatatccaaggggggttattgttgataaatgtttctcatgaagaaaacctggcctggcatggtggctcacacctgtaatcccagcattttaggaggccaagacggaagaatcacttgaggccaggagttcaagaccagcctgggcaacatagtgagatgaaagaaagagagagagatatggagggagagagggtaggagggatggagggagggagggagggaggaaggaaggaaggaaggaaggaaggaaggaaggaaggaaaaagagaggaaggaaaaagagaggaaggaaaaagagaggaagggagggaaaagaaagaaaacctactaatttgaactgaacccatgaaaccatgttggaaatatattgatttttattgtttttggttttttttttttttttttgtgagaccgagtctcactctgtcacccaggctggattgctgtgacgtggtctcggctcactgcaacctccgcctcccgggttcaagcagttctctgtttcagcctctctagtagctgggattacaggcgcctgccaccatgcctagctaatttttgtatttttagtagagatggggtttcaccatcttggccaggttggtcttgaactcctgacctcgtgatccacccgcctcagcctctcaaaatgctgggattacaggcgtgagccaccgcacccagccggaaatatattggtcttttcagtatgtggaatttccttatgagggcttattaaaactaactcatggaaggcctggtatagcatgttatacttaggctaatgtgaccatttctgtctagaacactgactgggaatttggactttctcaaagatccctctggagaccattattgtctcattgtagaatttttcttttcttttcttttctttttaattgaaatggagtctcgctctatcacccaagctggagtgcaatggcgccatctcagctcactgcaacctccccctccccggttcaagtgattctcgtgcctcagcctcccgagtagctgggactacaggcgtgcaccaccacacccggctaatttttttgtatttttattagagatagggtttcaccttgttggccaggctggtcttcaactactgacctcaggtgatccacccgcctcagactcccaaagtgctgggattacaagcgtgagccaccgtgcatttctaattggctagaaagtggcatgagatttcttgccccataattagaaatccatatcccattggtctcatttatctcagttgaggatccactggctaataagcaggtctttattgagtgcccaacactgagtttagtcacaggtgcttattctggataattaatctcagtagattaaccttcttcagaatgaccatgtatatcagacttctcttatccccaattctgggtccttattaacctcttccagggctaagtatttacccttccataaatcggatgttttcttaagcattttttctcctgtcatcactgaaactccagcctagttcttcacttgtatgcaattttcttgtaaccctgtctctcgttttggtttattgtccatatgcctattgagtgcttttccagttgtcttcataatccaaatcccagggcctataaatacatattaaagaggcataattacctttcacccagagtcttgaccatctaagactaagaaatcactgtgagtttgcatgacaattatgaccaagctcctgcacttgctttgatacattcattcatttttttctagcccagtgataaaaagtataggtcgtgtgaaaaccaaacttcacatttttatcctagtgactttccattagagcatttatgctactactcagttttaaaatacatatattacaggggggatttttgaaatttatttatttatttttgagaccgagtctcgctctctcgcccaggctggagtgcagtggtgcaatctcaactcactgcaacctccgcctcctgagttcaagcaattctcctacctcggcctcctgagtagctgggattataggtgtgtgccaccacgcctggctaatttttgtatttttagtagagacagggtttcaccatgttggtcaggctggtctcgaactcctgacctcatgatccacccacctccacctcccaaagtgctgggattacaggtgtgagccaccatgcctggcctgaaacgtttaatgatgggaatggcacaggccatgaccaaccaacagacaccagccctaacctccagtaaatagacccccagaacatctgccacgtgtgtgtctttagatcacatgccaaatccatccacgattcagggggcaaattctcatttgggtcctagcatgatatgctgactccatatttggagttgtaaccttaggctgaaaccttttttttaaattcatttacatatatatatacatatattttgagacagaaccttgctctgtcgcccgggaggctggagggcagtggcacgatctcagctcattgcaacttctgcctcccaggttcaagcgattctcctgcctcagcctcccacgtagctgatattacaggcacccgccaccgtgcccagctaatttttatattttcagtagagatgggatttcaccgtgatgaccaggtcggtctcaaatttctgacctcaagtgatccacccaccttagcctcccaaagttctgggattacaggcatgagccactacacatagcctatttttattttttatttttgcgtatatgtgatggagtctttgccatgttgcccaggctgttctcgaactcctagactcaagcaatcctcctgcctcagcctcccgagtagctgggattacaggaagctcaattatttttcttctttaaaaccttttacttgacgtattcattgtttcatattttaaatttaaaatcccacaaaagaagccatgtggctccgctgcagcagccgaatcatggcacttgtttgggggcttcctggggagcaagcagaagtaaaacaggaggtatttggtggctcgtgtaccttgtactttgcacagtatttgcgtgtgattaattctgactgcgttgtttgtgtgtcattcctcaggcgtgtatgaacagtctttccattcttaagtaaggtcataggggttgctctgggttgactttggctgggcccgggtgtttgtgctttgtgttgtcattgctttaaccaagcagccttcatgggaattgtgctccatcctgctataatcaatcacctcagcatgaagaaagggcagcagtgccttggaaccgacaaggcatcactagtgttagtgttatgtcagggcctgaggctactgatacaccttgggaaaggccaggcctccaggtgaagcgccttgaatacctgggtcctcaccactggatccttcactcctgaatcttggtgagaccctaagacatgtatcttcagtctacactggaaaatatagagaatgaaagctgagtcgtgacgtcaccgtcaccaatgtaacctcaaatatctgctttgtgaatgtttaggttctattgtaacagcatgatggatatgaaccaaggttctattgtaacagcatgatggatatgaattgaggttatattgtaacagcatgatcactctgaatttggatttggtcatcgtggctatgaggagtgtgaaggttattttggcacttcgacacctgcagtacaaactgcatttcaatctgtcatttgatcaggggaaaataatgttttttcgtccccaaatgccaaacccaaccaaggcagatgtctttataggataatctccataacagaagcagagggaggactgaaataatgagctgtaaggggaactaaaattcccctgggctggttcctaagtttataggcaagaaaactgaggccaaagaagtaaagtgacttatctaaagtaacacagtttagtggcagatcttgattaggatcaaaactttctgtcagcccatacattgtgcttttcacaattcttcaggttttaaattctgctaagctcacaatctgatgttgaaaagaggacatgttagtaatgactctgtccctttattttcttcaccactcccctacaaaattttaaattcttgaaatcttttgctaattgagattttcatcttgtgcaaacacagggcatttttggcagttggagaacaaagcaatccaaggtaaacagctgtaggctttggattggtgtgtaagaaatatgcgtggcccgcatgtcttagaaatgtaattaaaggaacgatttagttatagtccacttttttggggggatgtggttttgtggagtaacatgtcctacactattctaccagaatttggaatttttccatgaagatgtacggaaatctgatgttgaatatgaaaatggcccccaaatggaattccaaaaggtgagttcaccagatctgggttccgaccaataccatgcacattaagtacctgcctctgcagatccattgctgattaacgtgtgtggtttccctcctccgttctccctctcaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaaggtatcttggtctgctggaaaatgaaaagacccagctgctttcctaaatctgccataatcaccattagtgaaaggtgtcttgtaacttaattgctttctttcaggtggcttttttttttttgtctgttcgccatgaaacccttctttcatactttctccctcaccttccaaacaacaacaactaggtatctaacagctaatcagttctgtttttgcctctgttgctgactggtgttgggtaaacacgaggctgctgggtcagccatgtgctgttgaaatggttgctctgatactcacattaaaatccgtttgatcagtagtgagcagttgattctgtttgattcttctgattaaccccagttggtgtctcctagatctgtcctgcatgtagggctgtggcttctcaccttgagcttctctgcacatcgtggggcagcctcacagatgacctactcatgcgcttctccttctcttccccctctcactggtccttcccacagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 1631 - DNA, 339053 bp, Homo sapiens
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcagggtaagtaacagacccattcaaagatggagttacagggacgcgtgccccttgccgcttgctgctttttataaactgcagctctgggacccggcaaaggaaaaaaaaaaaaaaggcaatttcttgggatggtacattttccaaactgagtagagcatagagaactgtgatttcttaggcttgactttatctctggcacgattttcttaagcagcaaaagaggtggtggggtgatgtcacatttgtagtgcagtgagccatcagcatgagctgtatctctaagcaatgacaaataaatcactaagcagcttttaatcatttccccccggggctccagccacgggagaaaggagctgtttttgtgaaactgtctctaggaccgcagcttccattcattggttgggggattccatgtggcagatgcatgctggctgcaaagtttgtgcagaattttagagttaaatcacagaaaccaggcatgttttattttacagatccgagcagcaggggagggcttgagcatctgggtgatagatagaactctggatcttcttttatgttttaattcaaaacttgggagttgttggacaattttggtaaattttctccaggcagtttccctttaattgtgtttataatagacttgtcttttccgtagggaatttccagaagcttatgttgttccaaagaaatttcgcaccgggttgggtggccagaggaggtccctgctctctggcatctgatgcctgtgatgccaagagctgattctgtgggatcctataggcagcatgttcataaaccacacagccctggaccacccgccccaccctccctcaggttcatgcaggggccagtacacaacaaaaagacgtgcgggagtgcagtgctgtgcgtgggagtagggattatgcacaggggaaaaggtgtgtgttttatgaaaatgtgaaagggaagtaacacatgactcatccacgctgaaaatgcaaagctaagccagtcaggagaacttacaatgacaagagatagaaatcccccagtgaaatgcagaaaacttgaagttttgtaatggctggagaatccctgagtctgaacagtcatctgtcgaagtgtctgccttcgtgctgccaaagcacagcactctccttcaggctaccggggtcagtggcatccagtggaagataaggctacctcgtccccctgacccccgcaaccccccacccccattttctaggacaggatcctacttcaggaattcaacctctgggcctgtcctgaaagagatgactcagattctagaggggccattagaaagggatccatttaagaaatgactttccaacaatcagggcaattcagaggcttcagaggctaggatggtcagcctgagacagtgtgctcctttgctcactaattcattcattcagtgaatattgagcatctgttatgtagacgtcactgttttagctgccagacatccagtggtgaacaaagcagactaaaaatacttgccttcatttaacttccagtgtaaggaccaagtttcagggggtggggagctggtagagacagacaatgaacaaataaataaaatatatagcatgttagatggcacggctgctggatttagcaaataaaaatacaggaggcccagctaaatttgaatttcaggtaaacggtgaatttttttttttttagtataagtatatcccatgccatatttgggatatacttatgttaaaaatacttctccattatttatgtaaagtgcacatttaactgagcagtcctgtatcttatctggcaaccctatttgatggaaataaggttacagagaaaaataaagcaggaaaaggaataaggagtgaaactgtaaataggattattagaaagagcttcgctgaagtgatatttgaacaaagacaggagaggtaacagcagggatgtaatgttttcaaagaacagcaagaacatgggagaaggatgggaggaaaagagattgagaggtaatcccaggccagatcacctagggcccatgaaaccattgtaaggactagagcttttattttgaaagaggtgggaatctcctggcaggtgggactactttttttttttttttttttttttttttttagagagggtctcatttgtcacccagactggagtgcagtggtgtgatcatagctcactgcagccttgaactcttgggctcaagcaatcctctggccttagcttccaaatagctgggactactgggacatgccaccatgcatggttgtattgtattgtattgtattgtattgtattgtattgtattgtattgtattgtattgtattttattttattttagagaaggggtcttgctatgttgcccaggtgagttacaaagggatttgtctttttaaatggggtaatactgggtgctgtattgagcacaatccaagtagggttgagggaagggcagggaggcctttaggaagcttctgcagtcaaggaggcaagaaccagggctagcttggaccaggcggtgattagcaggcggtgataagccagcagattctaggtgtatattgaaggtaatgcccaaagcatttcctgtagcctgggcagcatagtgagaccccatctctagaaaaaaaaatttagctaggcatagtgccctgtagtcccagctacttgggaggctgaggcaggaggatcacttcagccaggaggttgagactgcagttagccatgattacaccactgcactctagcctgggtaacagtgtaagattctgaaagaaagagagagagaaagacagagagaaagagaaggaaggaaaaagaaaaaagaaaaaaaaagaagagagaggaggggaggagaggagaggaaaaaagaaaagacaaacaagacaagacaaaagcaattgctaaaggattcaacttgggatgtaagagaaaaagaggagtcagagacaacttccaaaattttggtgtaagctgctgggagaacggagttgccatttgcctaagttggggagtatttacgaagaacagatgagagggtgtttatggtttgaggttctgaggagcaatcttttgatagattaggattgagaagtttatcaggtatccaagtggagatgttgactacaatttggatattaatcactagagctgaaggaagactgagaactgagagatcccctaagattgaatctgtgtgcagaagaaaaagtccaaaggatgccccccgaggcagtccagcatctagaggtcagggagattggaaggaagggctggaaaaaatagcaaaagtggaataaaaatccaaattagatttttaaaatcctgttcagttctgggtgaatatgatgctgtagagaagcatggcttcatttttagttctcccggtgagcacgagtgccgcaagggagagcaacatctctgatgctaacatcacccataacgttcatttctatcattgcattctctcttgtgtctgcctgtgtatctgttttacccaatgacaatgtgatattccacagcaaggaccatgttttatttattcacgtttgcatttccagcacctaacagagcactgggcaacctaacagagcactcactgggcactgtagaaggcactcaataatcatttgttgaatgaaaggctaattttaccactttgggactttgagtttattatcctgctatagataaggatccctagggtgatcatgtaacttactgtccaaatgagatccttttgaaagtgaaagggaacactcaaataattttactgggacaacagttgtaacccagagctgttttggcaaactggggtatatgatcaccctaagaatagctctaatcaatgaagcttccatggctgaatagcccggctaccaggtaaataacaatggggaagtgtagcgcatagtgtgctttgcggagtaggcactcaacaattattggtggaacatgaatctaactgtatcatattctctttgaagcccatgggctctacattgtgaccctggggcataggcattccttgggatgactctgtccacagcagtcctgacgtgtgtgcttttgctctggttcctaaggtcttgaaacctctatgcaagtgaagtgctattagcccacctgcttgccttccccactgtctgattggcagcctcccatcgagtgcaagcctggggaatcagatatgcagaagcctcctctaaaacagccccctcagtctctgtacccttatcccgtttcattcttcaaagcacttaccgttacatgacatttagagtctatatgatttgtttgtggttggcctatttcaaatgtggactcctctatgagggcattaagtctgacttgatctacttcacactgtatctcctaactcctttcagtgtgggagcaggcagtcaataaatatttgtatgaatgaatgaatgaatcaatcagtgcttgacacagaatgcttttctgggaagaggagctcctgtctctattttgtctaagatctataccagaaatcctcttcatcactggtaaaattttaaggtactatagaggaatataatgacctggtttcagctgtaatttctgtgctgatttgtatatatattatgatagtaacaagggagctaaccccatcactttgggatgctgaggcaggaggatcacttgaggccaggagttctagaccaccctgggcaacatagtgagaccccatctctacaaaaaaaaatgtttttaaagtagccatgcatggtgactatgcacctgtagtcccagccactccagattctgaggcaggaggatcacttgagcccaggagtttgaggctgcagtgagccatgattgcatgactgcattccaacctaggtgacagagcaagaccctgtttctaaaaacaaacaaagaaaaaaaacaagggagcttgaaaactgagggatgctgtaggattctgcggcctgctaaccgattatgtgtattaatcagataggctaattgttgtaaccaccctctaatcttggtggctttgcatgattaaggttaattgttcactcagacacagcacagtgtgatttctgtggccaggtggatttcctgggtggccgatgaggctcctcctgccttgtcactatggcatcccccacggcgttggagggttctgctggatcctttgtattcaactggccaaagagtaaagagagagagaacgtggaaggttatttgggaggtctaggggccccaacaaaaggtggcccacatggcttctgcccacaatacattgactggaattagtacaaggacccagtgagatggagatggctggaaaatgtggtcttcctctgtgtgcagcagaagagcgttctggtcgaacacatagggctgtctctgccacggtacacccagagaggttgtacaaccagaccaaacagcaactccctatgatgctccctatgacaagagagcttctcagcacaattgagaaggagacagctaaccagaagccactagaaagaagtgagggatgccttccctaagagtctgtggcctacctaatcttgacccaggaataggatctcagggaagccatcagcactgttgctggctctggagcaggtgtggaatgcctgagtggtgcaaggccccaaatcccttgctgcaggtcagctgacccagccagagtaacccgagttgtggcaaagaagctggccttggcagcgcctgcagttgcctgcctgccggacttgcagtgcggctttctccttgaggaggccccatcttccatgagcctctgcgtgtttggtgtctgccccagcccctactttctatgctttctttccagaatgccaaatcctagcctgggagctccttggattcctgaagagtgtccctttagcatttctgcctgccttgtcctcacttctccagggaatgttccagggattttgctcggctttaagctcctatgttgctctttgccctgcttgaagtgagctcccaggaggagttgccctgggctctgcagaggctgggaggggcaggaaagggaaacaggactgcctttcagcaagcccaagccttgccttcatgctacagcttcattattttgtttgacaaggattcccagaatagcgaacagctagacacacccatatttaaatgttaacaccaaagcgcattccaaacaagaaatcgaattgtatttctgttttgatgacttggataatccacacttgagcttttctctattcatgtggataatgaggagttggccaggctcagatctctgacaacatggctgtggaattgtgactaaatgtcctctgcctgatccctctctagtttgtaatcattcttagtttttctccactgaaaagaccacattctccttaaatggctggaatggcagagttgttgcttctcccccaggtgtggggcttgacgcttccaagagctgagccttgtcgaggaaaaggctcaagtgacagatgtgctgaagtgcctttgtgtggaaagtggcgttaggtggctctgagtgctggtgacaggagagcaggtgcctcgaggtaggaggggaggcagacaggatgatagagcattgggcattgggtggaaggcacaaggcaggaaattgagacaaaaggaaggagtgagctccaaaggcaatccgatgtttgccaagtggctgcattgagccttctagccttgctagtggttgatgctttttgtacctttcctctaaatcgcatcaatccttgttaagcaactggagatattttggaaaaatccacaagaaagagaaaaaacagaaaagcaacatgaggtgaaaagtgctaggaaaaaaacaggggtctgatgagtctagtccagtaagtcagggctgctcaaagattaatgtggactgaagattggctctgacccccaaaactctccccttccatctcccttcccaactcatttcaaagaagaaagagggtttattgtcccggctgtcttgaactctcttgatgctctttggatgaaacagaatagatcatatgagcctgtgcagcatagtaaggcaggatgcgactttctgccgttattgccgttggacatgcatggatgtttatctgtatggctgtatgtgtgtatgtagacagatgtgtgtatgcctgcataagaaatcacctttccagaggctcaatcctgttaattcatctagctgtcctggataacttaaaatatattttcttaataatgtcaaaactaatcttccaattccacttaaaagtcaatagcattgctgggtgtgatggctcatacttgtaatcccggcactttgggaggctgaggtgggcagatcacttgaggtcaggggttcgagaccagcctggccaacatggtgaaaccccatctctattagaaatacaaaaattagccgggcatggttgcgcacggctgtaatctcagctactcgggaggctgaggtacaagaattgctcgaactcgggaggtagaggttgcagtgagctgagatcgcaccactgcactccagcctgagtgatggagtgagactctgtgtccaaaaaaaaaaaaaaaaaggtaaaaaataaaataaaatacataaaaataaaaataaatagccagatgtggtggcacacatctgcggtcccagctagtcaggaggctgaggcaagaagattgcttatgcccaggaggtaaaggctgcagtgagccatgatcatgctactgcattccagcctgggtgacagagcaagaccttgtctcaaaaaaaaaaaaaaaaaaaaaaaaaaaggcaagagtgttagatcaagtatacaacaattttggctgatatgaaacacatgcacagcactcaaaagataaagctaaacctcttcagattgcacaggtatttatcaacctgagagacagcatttttggcatctagctttgttcagtagatcctgttatttctctgttattaaggaagagatcattttaaaggtagccatgatgtgagtctaagtgttggaagcgcaacctaaataaatgaaatgacagtttagcccccaatatcttttaaaccaatagttccatcttcttctccttgtaaacttactgctgaaactaatgaaaagtagaagaattgactaatttggctgtgcttttccttcccttccccatcagtgtctgatggagatgctataattagcaatgtaatgagaattgaagggtaaacaagaagaattattcccagaacacacatcaagggttagaagactggaacaggaaaaccagcctgagatgaaaatattttctctgcccaaccaacgggcatctatacctagagttctatatacagatctttctaggcaaagacaagggaaagagtggtggtcacattgctttcaggaaactggtttatgcctagactcttaacacctgttgctttgcaaaactagtgtgaaggattggttctctgtttatctgggattcaactgagcagaactcccaaatattaaatctgtatttttctgcacttaacttgtaaagataaataattggcaaatatgcttctattggaaacttatttttaaaaaaattagaatagttttaaaagatttagaggtagaaggctctttgcatacctaatgttagttcagtcgtcttcattttattcatgaagagaatgacactgagagaggtcacatcatttgttctaaatgtcggattaaagccaagattcctgagatccagcctagtactttttccagggaattcagtggacaaggaaacattattctgcctatatcagcaatactttatgataagaactgttcttcgtgaagagcctgacttcatgaagagagcctgtctaactcctgaagtgcttctgaatgttttactttttctccctaatctatttgttttttttaaaaaagtaactcttttttctgagctagctggaatattcatacctgacaccccatctcccaaccatcgaggatgaatggagattccctttacatgctccccactctcagcattgacatcatatgacttggttgatctgttcttagcagaaaccaacttgtcccttcaaagccagctcagaaggcaggatgtcttaggtccaggctatcaggatgtaccattgctcttccttttcactgtgttttaggtaaagtccacctcaagtaaaatttgtctaagcctttactttataactcctcgattgttactttttttttttttcttttgagacggagtcttgctctgtctcccaggctggagtgcagtggcgtgatctcggctcactgcaagctccgcctcccaggttcacgccattctcctgcctcagcctcccgagtagctgggactacaggtgcccaccaccatgcccagctaatttttttgtattttcagtagaaacggggtttcactgtgttagccaggatggtctcgatctcctgacctcgtgattcacccgcctcggcctcccaaagtgctgggattacaggcatgagccacggcgcctggccctcgattgttacttctgatggtattcttatgcttgcttggtttatgccaatatgagaaaataaaattttcaaatggttcacatgtgtcaatgattacttacgtacagggtgatagctatttttgttcttggtgatgaagcaaatgtttcagaaacccgactgagcttatataagaatcctgttaccagaatgcaactgttattaaaaatacagaaataatcagaatcactggagttaactctttctataattacagacaaggataaggaataaccctattgcctgcacacaagtagcctaaccaagtgttcttgagggttttcttgtttttgtgttttgagacagggtctcacaactgtcacctacccaggcttgaatgcagtggcacgatcatagctcactgcagccttgacctcttggactcaagcagttgtcttgcctcagcctcccgagaagctgggaccacaggcgtgcaccactacgcctggctaattttaattttttgtagagataggggtctactatgttacccaggctggtctcgaactcttgggcttaagcgatcctcccgccttagcctcccaaagtgctggggttacaggcaggagtcgccatgcccaatgaacatctttatttctaaagtacgatttttcatatttctttgattgtggattttctcccctgactgctgcaaagcagaaaaagaaagaaaaagaaaaaagatttgcgaagttaacattcatacattaacaactgccgcaaaccctcttggtgttctgcaaatgagacttctagtgtgaaatcattaattgtgaaccgaatttttttgtctttcagaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccaggtacgaatatgctctcatttctccttgtgtagctcgctctctaatgaacatcgaggaaagcaaacttactttctttgtaaaaggtaaaggatagcttagtggactgtgcatactatttagttgttctggatttctttggggccttgggaggaggaagccgggtgtagaaaacttctgcctgcaagctcagtcttctttgccaatacagcaagagaacaggaggccaggccagagaggaagggcctagagagtatgcagttccccaaaagagtgttcccatgttcaaccacaaacacatctaaacacatctaaagtgcagggaatgaaggggtattatctactgaggaaagcatggcaccaactaccgtgtaccctgaaagcacggagtgcttagcactgtgaatgaatgaagtaatgaatgaatgaatacacaaatacataaatgtattttcagggtaaaatagatcttacagatacagacttgtggtaactccttttccttaaaaagctgacattagggttttgtttctgctcttcttttttttttttttttttttttttttgagatggagtcttgctctgtcgcccaggctagagtgcagtggtgcgatcttggttcactgcaagctctgcctcccgggttcacaccattctcctgcctcagcctcctgagtagctgggactacaggcactggccaccatgcccggctaattttttgtatttttagtagagacggtgtttcatcgtgttacccaggatggtctcgatctcctgatctcgtgatccgcccacctcagcctcccaaagtgctgggattacaggcgtaagccactgcaccccggcctttttttttttttttttttttttggagatgggttattgctgtattacccaggctggagtgcagtagtgccatcatagctcactgcagcctagaaatcctgcactcaagatcctctcatctcagcctcctgactagctaggactacagacatgcagcaccatgcctggctcattttttatttttggtagtagagacggggtctttctctattgaccaggttggtcttgaactcctggcctcaagtgatcctcctgcttctgtctcccaaagtactagaattacaggcatgaaccactgtgcctggcatttttttcttttgaatcacagatgtgctccttctgcatgcgttgctttgtgctagctttctgtcttcacctacctgtttcctctggttattttgacagtcatatagacattacccaactgtggctagggatgtttttgtttcttggctgtgtgcaattacttttagcagatagagcaagtttggggtcacaggagatttgaggcctcctctaccgacctcactggcgagttaccagattgacctttgtgtatggagaatgtagggaaggaagcagaaagcacttaaccatatatgtgacgggtgggggtgggaaggagggcaggatgatattgatttccacacaagggaggaaagctcagtgttttaagtctgctgtcttcccagttaggtgcaaaaattatgtctaactcactcagcctttgattatccatggaaatggagattggcatcagcccgaataattgaaatctatactttattctcaatctcatattcttccttaaattcaatcttctcttctagagaatcattatctgagtggctaaaaatgtgaaacgtgctttatggacttcatgtttgctttttgttcacacttccaacagtcagtaaacccagaagaggagaaaagaaaaagaatcctggttgctataaggatgggctaatgattaattctttgataattttaaaaagactctgggcacagtggttcatgcctgtaatcccaacactttgggaagccaaggctagaggatcagttgaggccaggagcttgagaccagctgggtaacatagcgagaccccatctcaacaaaaaaatttaaaaaaattaactgggtgtggtggcacacacctgtagtcccagcttctcaggagactgaggtgggaagatcactgaagccccaaaatgagaccccgtctctaaaacaaaagtatcaattttgctgagaaatatagaaattggcctgtcaaaaatggtatatttttccatgtcaaaaataatgattattgttactcttcttatttgtagtgttataattattgttattgctgtaataatggtggctttggttaaaacaattacaagggaagcctaattataattaaggttgaaaggagtaatgaatatattttggtgttctcaagctctgatctgctgttacatacattgctagttctgccatggctggccagctgtcccttctctgataatgagggatgaacaagtcacattctatctttctgcctcttttgtactcgaagctgaccatccaaaaggagagagtttttaatgcatgaatctatgtatacatttttattctcttattaacaggaaaggggtcctgatccagaccccaagagagggttcttgggtctcgcacaagaaagaattcagggtgagttcataaagtgaaagcaagaattttgtttgtttgtttttgtttttgttttttgagatggagtctcgctctgttgcccaggctggagtacagtggcgcaatcttggctcactgcaacctccactcacttcaacctccacctctcaggttcaagtaattctcttgcctcagccccccagtagctgagattacaagtatgcaccaccacacccagctaatttttgtagttttagtagagacggtgttttaccatgttggccaggctggtctcgaactcctgacctcaggcgatccacctacctcggcctcccaaagtgctgggatcacaggtgtgagcccccatgctgacaaaaggaagtttattagcaaagtaaagaaataaaagaatggctactccatagagcagccctgagggctgctggttgcccatttttatggttatttcttgatgatatgctaaacaaggggtggattattcatgcctcccctttttagaccatataggataatttcctgacgttgccatggcatttgtaaactgtcatggcagtggtgggagtgtagcagtgaggaccaccagaggtcactcttgtggccatgttggtttggtaggttttggctggtgtctttactgtgacctgttttatcagtagggtctttatgatctgtatcttgtgatgacctcctatctcaccctgtgacttagaatgtcttaaccgtctgggaatgcagcccagtaggtctcagcctcattttacctagctcctatttaagatggagttgctctggttcaaacgcccctaacactgtcattgcccttctgcaagcaaaccccaaccagcattgtaaacaccagagatcggtgtagacatggcctatgaaattgctgcagacatcatctcatcttctgtcttttccactctttttctcctaccacccatttcctctttcctgtcttcctctctgcaatgccatttgttcctcctggaccttctcagtatggactatcccaggcttcctttgcaggaagattacacagccagctgtgagaaggaagtcagataacacacatctgatgctctcctccagatactgaggctcttaataccagatgctcttctggcagctgtttttctggcttcctctcagagaagtatccttgataagaagagagccaatcagcaagatagagaataagatgttgaaagtgatgtatctgccgtctaacatgaaatctcttaaaatctaggttcttttttttttttttttttggaagacagggtcttgctctgttgcccaggctagagtgcagtggcatgatcatggctcactgcagcctcaacctccgcggctcaagcaatcctcccaccccagcacccaccacccaccccgcccacccccagataactgggagtccaggagtgcttcatcatacccgactgaaaatctaggttctaatttcctgctattaaacataagaagaatgagagcatgccttatgtttccaaatctgacttcaaacactggaagattcacggttgcaaaacttctgtttgtctttaaaaaatatgttggtcaagagttttctttagtctaaaattattgaaaggctaagaggtcaccttaactcccttctacagtcttcaaaaaatgcgggtggcccttattgcaacataatgctgatctgcataatagtagctgtgatcgttaaggactcttatcagcataaccttagttgtgcagggcagtcaggctgtacagcctcattgcctggcagctaagggcttggtttggatgcaggtgggactcatcaggatccagccttcacaatatgctaattctatgatttgggctaatagcttaatctttctttcttttttctttcttttttttttgagacagagtctcactctttcagtcacccaggctggagtgcagtggtgcaatcttggctcactgcaacctccacctcctgggttaagccattcttgtgcctcaagcctcccgagtagctgggattacaggtgtgcaccaccatacaccatacccagccaatttttgtatttttagtagagatggggctagtctggaactcaagtgatctgcgtgcctcagcctcccaaagtgttgggattacaggtgtgagccactgcacccgaccttaatggcttaatctttctctgtttcagtttcctcgtttgtcaaaggaaaatagtatctacatcatggagcactgagaaatacaacgatggaatcttttactgtttcactggcagcttttagcgtgataatattctggtttttagtgtcccaaagaagagtctcagaggctcttatttttaaattagtacttaaaatcatttgacttttttttttttttttttttgagatggagtctcactctgtcacccaggctggagtgcagtggcgcagtctcggcttactgcaagctccgcctcccaggttcacgccattctcctgcctcagcctcccgagtagctgggactacaggcgcccaccaccacgcctagctaatattttgtatttttagtagagacggggttcactgtgttagccaggatggtctcgatctcctgacattgtgatctgcccgccttggcctcccaaagtgctgggattacaggcgtgagccaccatgcctggcccaatcatttgacttttttattttttcaagacaagatctcactcttgtttagagtgcagtggcgtgatcacagctcactgcagccttgaactcctgggctcaagtgatcctctcaccttagcctcctgagtagcaactacaggcacacgtcaccacttctggccagttttaaaaattatttgtagggacagggtcttgctgtgttgcccagattggtcttcaaagcctggcctcaagcgatcctctcgctttgacctcctaaagtgctgggatcatgagccactgcacctggcctcacttgacttttttgtcaacaaatatttgagcacctgaagaggttaattttttccattgttaaagaataactttattacatttctgaaactggtatttttctttcattcagtgcttagtattcatatttcttttatttatttatcccatatatatttatttggcacctaccatggtaaaggtatttgagaagaatgcaaaccattggacttaaccctgtcttcaattcagtaaaagaaataggcattcacatataaagaatagtctttccagatccagcccagatggcatgccttctgagatggtcataacattgcagtactgcagtacttacattgtagcatctaatcaggttgcattacatatattttttacatttctttttctcacctagaataatcttctggaggtagaaaccttgtcttaccacccatttcttctttcgcctctgtaaactcagcatttaaaggaatacacaacctagattaggctagatccaaaatttctgttgcgtgaaggaatgagccactatttctaatacagttagaatgtgatagatggtacagatagagaggggtacagagccacagaattcaatgattgattgcagtttgagcagtcagaaagaagagatttcttaactaagaagttaggaatggctaagtaattttcccctaagttaagaagtcaacatttgaaccagggccagaatttcctgtcctcagaggaggtctccaggaaaaaaaaaaagaatttccagtttatggtcttttcattcattatgggcctatggaccttggttttcttaaaggttttcttccacctctaatttttccaaagtttgttgacatcatgtacatcacattgggtcaagcaatagagccatagacatgacttccattgccgtttctttaaaaaggcaaatctgactgggtgcggtggctcacgcctgcagtcccaacactttgggaggctaaggcgggcagatcacgaggtcaggagatcgagaccatcctggctaacacggtgaaaccccgtctctactaaaaaaaaaaaaatacaaaaatacagaaaattagctgggcatggaggcacacgcctgtagtcccagctactctggaggctgaggtgggagaattgcttgaacccaggaggcagaggttgcagtgagccaagatcgcaccactgcactccagcctgggtgacagagcgagactccatctcaaaaaaaaaataataataataaataaataaaggcaaatcttactccattccagagcatattaaataaccaataaccatagaaaatagattcctatctgtattttatataaaaagaaagttgcttcttttaaaaactctgagttcagaaagatctgtagtccagcaatccctcacagttgtggtcactgtgtaactgcacagtttggaaatgctattttttatgtcttcattaatgaatagatgttgatggcttcttacttgcagaaaccaactttccactcctagtctcagaaaccattctgaaattaatttttcaatctttactcccagttattcacagaatttctacctaacttacttggtatatagaatctactctgtggtttcagttagtctatgtggattcttttatctgatgtgctcagatcataaaagaaacgaataatacattttaacctaaaaatctgacatgtccaacaaagagtaagagagatataaagggattattattattattattattatcattattttgagacagagtctcgctctgtcacccaggctggagtgcaatggcgcgatcttttctcactgcaacctctgcctcctgggttcaagcgattctcctgcctcagcctcccaagtagctgggattacaggggtccgccaccacacccagctaattttttgtatttttaatagagacagggtttcactatgttggccaggctgatctcaaactcctgacctcagatggtccacctgcctcggcctcccaaagtgttgggattacaggtgtgagccaccgcacctggtcgggattattctttaacatgaacattacagggggcaaaaataaggagataagaaaatgaacaccaatatgagcactttttttttcttttttttgagtcagagtcttgctctgttgcccaggctggagtgcagtggcgcaatcttggctcactgcaagctctgcctcctgggttcaggccattctcctgcctcagcctcccaagtagctgggactacaggcgcccgccaccatgcccggctaattttttgtatttttagtagagacggggtttcaccgtgttagtcaggatggtctcgagctcctggcctcatgatccacccacctcggcctcccaaagtgctgggattacaggcgtgagccactgcgcccggccaatatgagcatttgaaacagggtcagtgaggccaagaggtcattcttctggtttctcccatcagaccagggctttgctgctgtctgagtgcccctcaggcttccttagggtcccctcctcaaccatcccctcctttgaatgtgtttgtgtaaaaactgctctggagaccaggagagctggctcacacctataatctcaacacctagggaggctgaggtggatcacttaagtacaggaatttgagaccagcctgggcaacatgggaaagcccctactctacaaaaaatacaaaaattagatgggcatgatgactcgtgccagttggggggctgaggtgggaggatcaattgagcctgggagatcaaggctgcagtgagctgtgattgtaccactgcacttcaccctgggcagcagaacgagaccccttcttaaaacaacaacaacaaaaaatcaaatataggttatcataagaaagctgcaaagagaagtatgtcttaaagctgatgtattaatcaggattgtctattaggttggtgcaaaagtaattgcagtttttgccattacttttgcaccaacctaataggttatgctacttaacaaattaaccctgtgatttattaatatttgtggtattttctgatatgacagagaaacattttatttcttacacacacaaatcttattctcacaatgacttaggaattctggctacttccctcttgcgatcatgccatctcaacacatggattccaggtcaccatgacagagagagacagagctgatgggttgtatacacgctcttaaatatattggcctggaagtggcatatgtcacttcacttcatagtagcttcttggttctagtacccactgggatatttgttgtattcaggttttggctgtggaatctagcttaagactaaaatcttcctgctctagtttgtttcatcagctctcccaatgtaattgattattttatcaattttgttatacctagcactttatctgtacaatgacgtcattggcatttttacagaatataaacatattaacagatattcctatctgtaagtaatggcatctatgtctttgtgacttatttttgatgaatttaattgtatcaaatcaaattgcagaactccagcatggactatgctgtatgctgtagatctcagggagtcagtttatacctcagggaataaacgtactaccctctgttatgtgtgaaaaactccaaattcattagatatgcatctgtcatatttgtcttggctctgatctatatctgtctattcaaaatttacgtacatgcatctatatttatgaaggtaccttccagtgaaggctgaaaagtaaggctaattgaaattaagacacatgtatactatacactgttcagtaagtcgcagcctttggccacagtgaaggtctggatacaaggctaatgttgtagaaagtgtatgttttgaaaaactaggcatgttttgtaaataaataaataagtaaaaagtttagaaatggaactagactcagctaagaatttcctcttcagagctattaatttattctaatccaatggcgaaatgatgggagaatagccacatgtagtagaagcagctacttagttgtgtgaactaatgactgaatatgagtttacagagctgtttcttttttatttttattttgtttatttatttattcttttgagatagagtcttgcactgttacccaggctggagtgcaatggcacaatctcggctcactgcaacctccgcctcccgggttcaagcaagtctcctgcctcagcctcccaagtagctgggattacaggtgcccaccaccatgcctggctaatattttgtatttttagtagagacaaggtttcaccatattggccaggctggtctcaaactcctgaccttgtgatctacctgcctcccaaagtgctgggattacagtcatgagccactgtacccagcctcagagcagttttttacctaaacttttgggaggaaaggacataaattttttagcaattaagaaatctagtatactgtgtgcacagcaaataataatagcaccaaaatctcacaaatcaccggtgaagaacttactcatttaaccaaatactacctattcctcaaaaacgtatagaaataaaaaataaataaataaaatattaataagccacaataggaagagggaagaaatatccttatgcaaactatgaagaacacagagaaagccagtaacatgctcagtattttttttagcactgttttctcaacaaatatttataatggtggaaaagactgtaaggagaacgtattatttgccatcagctaaaattgctgtgctgtttctctttacatgtattacaggttgagtatcctttatctgaaatgcttgggaccagaaatatttcagatttcaatttttttggggggtggattttgaaatatctgcattatatacttactggttgagcatctctaatttgaaaatctgaaatccgaaatgctccaccatggcctttgagtgtcatgttggtacgcaaatatctcagattttggagcttttcagatattgaatttcaagattagggatgccgagcctgtagtgtagtccatcctctctacaactctgttgggtaggcactactatttgttttgtttttttttttttttttttttgagacagagtctcactctttcatccaggctggaatgcatcttggcaggtgcgatcttggctcacagcaatctctgcctcctgggttcaagcagttctcctgcctcagcctcccaagtacctgggattacaggtgcctgcaaccactcctggctaacttttgcatttttggctaacttttgcatttttagttgaaatgtggtttcaccatgttgcccaggctgatcttgaactcctggcctcaagtgatccacccaccttggcctcccaaagtgctgggattacaggtgtggggtaggcactactattaactatagttaacagaatgggaaactgaggcacaaagcagttcaggcttgtctgaggagacacagcaagtaagtggcagcaccagtatttaaatccagttatcttcctgtgggagccttgctcttaaattctagatcagaccacctctctgatgggggatgaaacagaaagatgttctgaaatgctaaggaaaagaaagactggactggggaccagtctgcctcgtgtcagtaagtgtgaatgagatttaacgctcatcctgcaatggatgaagtgccagcgtcctggttggatttgcctttaataatttgaagaagaaaaggagtttggcactgaagaagcagtagtgtgcctgcctgtagtcccagctacttgggaggctgagctggggggatcatccatgcccagaggtcaaggctgctgtgagctgagcagtgatcgtaccactgcactccagcctgggtaacggagtgcgactctgtctcaaaaataaataagtaaataataaagaagcagttgcatacatagtggtgagtacgcagaaagtgaaaactgagaaaaaaccattttcagagcaagcactgcacgtgaaaggagtatggtgtcataacagaatcacaagtcatagctggagaatttacaatattgtatgtgcgagtgtatatttaatggaatactggaggcccgtgagcaaagaatatgataggatcgaatcagtagaaaaacatctcttgtcctcagagaaattccagataatgttagatatgtctaaggaaaatcaggatgtggtcaatgatcaggaacaatagtcatttacatttggatatgatgaaaaacaaaagtaaaaaagaaaaaaaatgaacagaaagaagagcctaagatctaagagagatgatgttcctcaagggatgagatgaaggagctagcttggatgtgatacctggaggactgatttatttttcactcttgggtttttttttttttttgagatggagtccggctctctcacccaggctggagtgcagtggcatgatctcggctcactgcaacctccacctccggggttcagccttctgcctcagcctcccatatagctgggactacaggcatgtgccaccacgcctgagtaatctttgtattcttagtagagatggggtttcaccacgttggccagggtggtctcaaactcctgacctcaagcaaattcacctgccctggattcccaaagtgttgggattacaggcgtgagccactgcacgtggccgaggactgacactttgagttgtgactcaaaggtcgttgaagtacatctcagaagatttggaccattacatagtaggacatcttgcggcagagactgaacaattgaaaagactaaattcaggggttgtagttttacttgcaaaattgacgtacagttgacgttaatcacccagaatgcagaaaaacagcaaaggaatcctaaatggggatcattcataacacatcgcttttgatccatgtttaattgggtgccaccaacctcagcattagctttcattttaattagtgacatggaagagcaagagaacatatcttgagaacagtgctatattaaggaaagctctgcaagaaatcaaaataagattctactagaaaacctgctaaggagtgcccgggggtaggtggggaagtatggaaaggcaagaaccgaagtctagctaggcagtgtcaggagacacctggaaagtggtagtcagctagaggaaattgccacaaaattagatggaaattttcagtgttgagggatctaaaaaagaccaatgtgattcagtccagtgcatagatgcagaactcatactgcaaatgtccaaattgtccttcctgtcttttcttgtcaaacttgagcctttgccatttattcattcttcctgcagttatgttcttggattaattcattcaaatgcttatttatttattagggatctacatttcgaggttggcattgaacattatataaaaagtacaaggccgggcacagtggctcattaatcccagcactttgggaggctgaggcaggtggattgccagagctcaggagcaacatggtaaaaccttatctctacaaaaaaaaaaaaaaaaaaaaaaaaaaagaataaagaaaaattagccaggcatagtggtgtacacctacagtcccagatacttaggaggctgagatgggaggatcatttgagcctgggaagtcaaggctgcagtgagtcatgatcattccaccatactccagcctgggtgacaaagcaagaccctgtctcaataaaataaagaaataaaaataaaaagtacaaaacccaacatctgccctctcttagtccatttgtgatgcttccactcatgaccaaaaggggagcctctgtttgcagagatcacattgtctgagaggatgcaagagtgttgaagaggtgccaggctctttttaacaaccagttctcatgggaactaataaagtgagaactcattcacccctaagggagagcattcatcccattcatgagggatccaccagcctccataactcaaacacctcccattaggccccttcaactttggggatcaaatttcaacatgagatttggaggggacaaatatccaaaccatagcatgcactgccaaagagatatctctttagtggaaacagtacaaacctttgggtatgatttgagtatgggatgatccaggaatatttaatttagtattgaatttgcaagtagttgaggctatcattactcatttataattttgttagatgtgatcagagagtgcaatctctaaaattcttacttttaaatttcgcttaaagattggtttacaaagtttttcttagaataaaatacacaatcagtattgcatagatattcatggacatttatctattctgtattctatgcacatacatacgcacacatatatattgggtttgttgattgtattattcatttcttctcagtctttattttttaaggttgttcacttctgagcaaagtataacaaagtctcccatatcattgtatttttatctttttctccctgcgttcctaagaatttgtttcacaggtttttagttatgatcacaccttctctataagttatgtctttaacattaccagatgacctcttcattctgtttagtgtctgttaactttttaaaaatattatctctcttgatttacatttgtttgcatctgtcaggtatgccttatcattcattttcaatgtttttgtattaatacaggttgagtatccctaatctgaaaatccaaaatgaaatgttcccaaatctgaaactttttgagcaccaacatgatgctcaaaggtcatgctcatggaagcatttcagattttggatttttggattagggatgctcaactggtagctatgtactgcaaatattctaaaatccaaaaaaaaaaaaaaatctgaaacctgaaacacctctggtcccaagcattttggataacagttactcaacctgtaatgagcgtgtttattagaaactacatacatatatatcggccgggtgcggtggctcatgcctgtaatcccaacactttgggaggctaaggcaggcggatcacctgaggtcaggagttcgagaccagcctggccaatatggtgaaaccctgtctctactaaaaatgcaaaagttagctgggtgtggtgacgcatgcatatagtcccagctactcagagctgaggcagaattgcttgaacccaggaggcagaggttgcagtgagccgagatcatgccgctgcactccagcctgggtgacagagcaaaactgtctcaaaaaaaaaaaaaaaaaaaaaaagaaactacatacaaaaaacttggctttgctttttcagcctaattcgttaagtctgtttttaatgggaaattccgtccactagcatttagtgtaacaactgatggacttaattatattcctccatcttaatttgacagcaagtactgtatgtctattcttcttctctcttaaatgtggctcatgctatttaaatgcgaaacaatggcttgagtttaggtcttgacaagctgtatctgaaatgacagtggttgctccaagtgaaaatgactgttagacaattggagataaaataggactggaccctatgccaggaaacaagactagacagatacatgttggagggatcagctctattagtcacagttcttcagaatatcagagccaatagcagaattcctttttctttgggggacctcagtctttgcttctaaggtcttcaactgattaaatgaggtctactcacattatggtgggccatctgccttactccaagtctactgatttaaatgctaatcacacctaaaaaatacctttacagcaacatctacactggtgtttgaccgaacaactgggcaccataacctggccaagttgaaacatgaaattaaccatccccctctgcaccaacagttgacagaatgtgaatggataatttctaaaaacaagtaacaactacaatcaaacacagagccaaagatcaagggtttagcattagagaattaccacagttggggtccatgtttcattaaagaatccaagcattcttatcttttggtgatacttgtagtgtggtcttgacttacgaaatgtatatgtgttgttttctacctttttcatgtttgacagtttttctttagaccagaacttcggattgcagctatttcttaagagttgctatttcattagccttatcaacatcctagagatctgtttgccctggggttttgagggctaagccctgagttgtaatgcattaactctgttctgtgcagtccttctaggactaaatacagcctgcagctaaatacatactgcttctccaaggctgctgctgtgctgatgtttctgtctgaactaccccagactccagtaccgtctgttaactccgtatctcggaggatctgcagaaggtccgcgttgaccctttgcaatccagtatgcactttcaggctcatctactaaataaatcctttcagcatggcttcgtttagttaggctcttagtatcccaattatgagcaattttattaaactaggagtatcagtgcctggtagttaagtacaggtgttttgggtttaaatctcgggtcagcctgagttcaaatctcagctccaacacttaatagccatgtaaacttactgtaattacctaacctctctaaagctcaatttctccatttgtaaaatgggaataatgattgttcttacatcatactattgctgtgaggcttaaatgagataagggttggttatttgaatgataaaaaaattgatattttgcttgaaagaaagtattccttttctacctgacaacttccaattcatatttcttttctcttttcttttccattctttttctttttctttttttcgacggcgttttgctcttgttgcccaggctggagtgcaatgggcagtctcggctcactggaatctccgcctcccagattcaagcaattgtcctgcctcagcctcccaagtagttgggaataaaggcatgtgccaccacactcagctaatttttttgtatttagtaggtttcaccatgttgggcaggctggtctcaaactcctggcctcaggtgatccaccctactcagcctcccaaagtgcttggattataggcgtgagccactgcgctaggctcatgtttcttaagaaacaaaaattcaggccataaatagttaagtctaacctctttccccagctgtttgtgttcttttatctttgtgagctttttcagtgaggagtttttttttttgttttttttttgaggcatgttcttactcagttgcccaagctggaattcaggggtgcaaacatagctcactgcagcctcaaccttctgggctcaggcgttcctctcacctcaacctcccaagtagctgggactagaggcacacaccagcacgccgggctaatttttgcactgtttgtagagacggggtattgctatgttgcccaagctggtctcaaactcctgggctcaaaagatcctgctacctcagcctcccaaagtgctaggattacaggcatgagccactgctcctggcccgttttctacctctgctataaaacaggtttgttgaagcgaattcaagacagagagtcttatttgctctccaagtcaatcataggtacccatgatgttgctaaatttagaaaaaatagctcatctacatgcatttattgagctctgatttgattagtatgatgctaaggttgccatcaggcaaatcacaatgtcattaaggcttagtgagatgtttttctcattcagggatggtaggaaaaatcgtcactggactggccacctctaatcaactcttggcatttctgcccagccttcgtgtgttgtccttattgctgggatccttgttgccaaacactttcccagctctaagttgttcaagatctctctgtcttgatcataataatgtcaatgctggttacaaatttttctcttgggtttacctctgcctgtccactgaggaaacggttaatggagttgctttcccatctgaattctttctggactctctccatttgcctttacattctgactcttctcgctctcttttccaagcctgaattcaataagcaaaagctgagatactgtaatttcctaaataacccaaagggaagatctggcataatttataaccactctgactgctgaatcaacttgcacttgctcttctctctaatggaactttgaagaataactgtaattgaatagtgcctccaccccatcttcagatttgactgaatcaagcctagatctggttatatctggtttttgtttgtttcatgttgtgtttgtgccccactgagtataaagcccaagtgtgggcttcatctggatgtattttcatctcacagagacattaattgaatctctgacaatagtcttgcctccgaggagtgctccaactctggctgcggtattaaaccaaggtagttcttggttgccttcaaaggtaacctcccatctgttgacagtgaactacggcaatgcaacgcttacagaatcattggaggagaggatccaaagcgtttacaattccctgctatgcaaagagtcattctgagtttttttaacctatgattgctctctgtaaatacctgggtgcacccagcaaggtgtagaggttaatgtttgctctctgacctttgaagacagatgcactgaatatgttgcagtttgcaatgggatccgtggcaagttaacagcagactgctccttcagctactgctgtttccaaaactctgcagtgtcacatcttgctcgcggctgcctcctcagaagtgcttctcagcttccattcagctccctgctgagttcctctgaagaactttgtactgtggcatatgacagcgacctgataacattatgataaactcctatgggtttgaactcagtcctattcaaattttctggtgcctagtggtcagcagtcttagacctggggagtaagaggtgtgtctgcagtgaatttagaggtgagaagaaagagggctggactcagatattgagtatcttagagcctacggaccatttcccaaagcctagaatagatttcagcgtaattctggtaatttacataaactaggatagacatgcaaaatatctggatatgttaggaaggagttaaaaagttctccacaccttttcctaccacctctgcagccatagaagccgaggggaaatgcacacacacacacacatacacactctggcagggaacctgttttgcaagttttgctggtaaaaagttctaggaagggggctggtggagaacagagtggaaaagaagtatcaattgaaggtttttcaagacctgagttttcaaggtaactttatcctgcagagagagacacgcatggccgctgtaggtttttcttccaccaattaagtgcattgttagacagggaggggcagattaacgaacgcctataattttgatcattgttttttgcaaaacagctcaggctttgaaaatgaagccatcgttcccggctaagtttctgccaacagcacaaattatactgtgcagagatccaaagcccctaagaaggtttcattaatgaacaatttcagacgattgtttaagtcttcgcctgacaggtaatgttggcatgtcggcaggtggggttagggtttccatggagatttatgatgtcatgcttgaaagagcatgtcaagacagccgatttaacaagtagctactcaaaaagtcctataggctacaagtaggttttatgcaaatgacgagagtttcactgggaaaaactgcaaaagaaaacagcccagacatggaggggggttttacctgacagctccgaaggaagaccctggagtccgttccagacaaaaacttccagaagaattagattttctgctttaactgccgcctcacctgtggagctctgggtacaggtaaatatgcggggtttttttcttccaagtttttgccaaaaattatttggaaacatttcgctctgtttctcggcattgttctcttggcaggaagaagtgaatcaataagcccagctttcccatagcaatgttcgtgctaaagggctgtttttaagggcttttttttttttttttattgaatgaactgagatttttgaatagagctgaaaacaagcgatgcattgtgcgttctgctgattgtgcccggtgaatactgctataaaagtgccacagataagggttagatggacaatctgaaaattgagatgctccatgtatttcttatttattcccagatgtgtgtgtgtgtgtgtgtgtgtttgtgtgtgtgtgtgtgtgtgttcttttactcttacgacaaacctgaaattgagactatgggtagttttgtattttcacattgtaaaaatgccaaaaataaaatccatggaatgttgcagaaataatctttgaatcaggtttatgaacattgcacttttttaaaagtatgtatctgatgcttttctcaccgaggcatttttcccagactagaaaaaaacagtcctgatagagacatccagtttttgagcttttagggaagcaggatttctaaattccaagaagatagataaagacttcttggaggaaggtggggtgtgggtgataaaggtagtttttaaagcatggtttaaaagaaaatactggtcacttgggagtatgagggttttttttgtttgcttcggctgccagtgaggataagtaaacagtcttgccagccatttggatgtgatagcaatcactggatgcggctgtggatctgtgagttagctgaaaggggttagttcagaggcatcagttgccctgtgagtagttagttccaccaagcttaaaaagaacacaaagaaagcctattgtttcttccacacagtgcatggcagcgtgtgaggttaaagcggagttcagaatcatcgaaagatacctgtgaaatgggaatttggacttttgaaactaaaactacttaggaataagtggataggctttcaaaatgttttaagaactgcctcatgtgtgagaatgagacctcctgaaattttgcagttagataatgtggattaatgccagaactcacattcatattaaattgttaccacagttattgcaaaacagtgagtgacaaagaactgtgcctccaacatcggaagttctgggcgttgagttctggcttcaccacttagtggctgtataactagaggaaagtaaattcatgtccttaggcctcagtcatcatgtccataaaatgggatgccagtagctagctgtgttgtgaggattaaataacaaaacagacgtagcacagttctaagcattcatgttccaaatgttaatgattgtttttattgactgctgaaatggcattggatatttagaaagtgtttttatattctttacttcctcttatcattacaagtaatgactagcagtcaagtaaggctagtagtctttttttttttaaaaaaaaaagacagggtctcactctgccacctaggctgaagtgcagtggcgcgatcttggctcactgcaacctctgcctcccggctaaagcaatcctcccacctcagcctcctgactactggtgcatgccactgtgccaggctaattttttgtatttttggtagagatggggtttcaccatgatgcccaggctggtctcaaactcctgggctcaagtgatctacccaccttggcctcccgaaatgctgggattacaggcttgagccactgcacccggccttggctagcagtctatttccactttacagatgcagaaactgtggctcagagagttactgggaaatacgacataataaactatcctatactgcctgcactttttctcattttaggaggcatagaaaaaaaatgaatgtgttattgaaataactcccagcagcagcaatgattctgtaaagtaattaaaatacaaaatgttaagtatgccaaaggagccagggtatttatatttttatattaattatgcttttgccacttttttctagacaggctacagaagtgatattaatttactttttactggtacctactgataggagctccagtactgcacagacttaaaattttaaattctacctgcctgaaatttttcttggccatacaagtagagtcggattttaatgttacaggtattttcggagtgagaacccaagtcaccaaggggctgtggttgctacagggtgcagaaggagcctaggagtcgaatatactgtcctttattccttctgtattctagacgttggcacttcctcccttgcctctatcccagacagaaacacagcccataattatatcctacatccattgtatgtaagagacaaatatgtttttcattgtgctatttttagccacagtgtttctagctggggaaaacactctcttcattccagggttttcttaacaatttttccagtttttccatgtcagactattcagaattattcaggttccacactcctgggagaaggctcttaatgaagtattgagtaggctcatcgagggggattctagagggattttggcatctgagctgctgagcctgaactcattctatgacagatgatgtctgtggtcccatgaattaggctgcattgaggactctcattcccagcactgtttgggggcactgggaaaaggttgagttaccttatcccaagggtagatctataaggagaaaagcaaatatttatttatttgttttaaatttctgcttttatttttagatataggaggtacatgtataggattgttgcatgggtatactggatccagataatgagcatagtacccaataggtagttttttaacccacatcccacctccatccccactctagtagtccccagtgtattttgttcccatgtttacatccatgtgtgctccatgtttagcccccacttgtaagtgagaacatgtggtattgggttttctatttctgcattaatttgctaggaaaatggtattcagctccatccatgttgctgccaaagaaatgatttcattcttttttatggctttatagaattccatggtgaacatgtaccacattttctttatccagtccaccattgacggacacctaggttgattccatgtctttgtggatagcacggtgatgaacatagaagtgcatgtgtcttctcggtataatgatctatattcccttgggtatatacccaataatggcattactgagtcaaatggtagttctgttttaagctctttgagaaatctccacactgccttccacggtggctgaactaatttcactcccaccagcaatgtataagcactccctttcctccacagcctcaccagcatgttattttttgactttttaataacaaccattctgaccggtgtgagatggtatctcattgtggttttgatttgcatatctctgatgattagtgacgtggagcattttttcatatgtttgttggcttcttgtatgtcttcttttcagaattgtctgtttatgtcttttgtccactttttaatggggttgttttttgcttgttgatttaagttctttacatattctggacattagacctttgttggatgcattctttgtgaatattttctcccattctgtaggttgtttgctctgttgatggtttcttttggtgtacagaagctcttcagtttaattaggtcccacttgacaatttttttattgttgcaattgaaagcaaatatttatttcattcaaagttttagtttcaaatatgaatcacaaagctgcaattttagggtagaaaagagttttgaactcaaacatggtgccaaaactccaaataggttttgagtcactgatgaaatgtttcttaaattttattttattttcttttagattcagggggtacatgtgcatgtttgtttcatgggtacattgcctactggtggggactgggcttctagtgcacccattattcaactagtgaacatcataacccataggtaatttttcaaccctcacccccttcccaccctccctccttttgcagtccccagggtccattatttccatctttatgttcatatataccaattgtttaactcccgcttaataagtgagaatatgcagtatttgttttttttgtttctgagctagttcacttaggataatggcctccagctccaaccatgttactacaaaagacgtgtttcattcttttttatggctgtgtagaatattcacatatatacaggaatatatatatatatatacacatctatgaatgtgtagaatattcatatgtatgaatacatacgaatgaatatatatgtgtgtttgtgtgtatatataggactatatatacacatctatgaatgtatacaatattcatatatatgaatatataagaatgaatatatatgagtttgtgtatgtatatatacatatagatcctgttttagaagcccagtgaagctttttattacacttaattgtcgtagcgttcagagattatctttgatcaataagtagcgatcgcattgagcagagcactttacacctagtgggttttagcaaaggcttgtaaatcagatgggctgcgtgcagtgactgaagaagtctcctgcctggattcggatcctgccttcattacttgctcgtagcacaggctttccactgaagagcatatgaagttttgttcatattccaaataaaatagagcatctgaatttccaatgcctcttgataaaggaattagtggtctttaagtattacattattctctttgaatgtcatttttggaattttcacagaaatgatttcttcagaaagaaaggcactgaaaatttaactggaagttcctctcggctggctaccggggaggtagagagcagagagttctcctgggtgggagggatttctagaagctctttacagctgaggcccttttcatcgctatttattaatttgacttgatcagaagcaatccagttttgaaggtgtagtttctaaaatctctttatttcaaagaaagtcatcctgaagaatggtgtcatcccagatgaccttgctttttctcttcagatgtctggccacagaagggatcagcaggtagaatgggaaggctgttttcatccttgggcattaattgggcttccctcttttctttctttcttttttttttttttttttttttgagacatgtcttactctgtcacccaggcgggagtgcagtggcgagatgtccgcttattgcaacctccgcctcccggattcaagtgattctcctgcctcagcctcccgagtagctgagattataggcatgtgctaccatgccctgctaatttttctaattttagtagagacagggttttgccgtgttacccaggctgatctcgaactcccggcctcaagtgatccgcctgcctcatcctctcaaagtgctgggatgacagacatgagccagtgcttccggccagcttatcctaacggcaggaagctttgatacttttacttcctgaccacagacttagtaggcagcaggaacagtcttcaacttcctggttgtataattacaagagccaatgtgaaatattatgcatttggagaagcccttctctagagctcttatagaaaaggaatgtacagccaagtttatgggaagcatgaggatggtgagtccaaagtcaaggtaggtgatagcattggtggccccttgcagcaccgggagtctatatggcggtctaacttcgcaccccctatttgtcacttcatagcactcttcactttcactccgtttcacttgctcatgattaagcaacaaacgtggtaatggtgtttcctactctgagtttcactagatttagtaaacgcacatgatcatgctggtcccgtcgaagtgacgataggagtcctcggagctgtggtctccgccctggctggttgcacctgctctgtgctctgctcagatcatacaagatggagagagcagagaccccatcagagagaggcttctgttggctgcagtgtgacactgtagacttgccagaaagggctctctttggacctactacttgccactcagaagcaaatgggctgcagcctcatacgtttttggagtgaataagagaactaagattctgatggacccttggtgattttctctcttcaatattatgaatgttcatgaatgcccctcagaaggtcacagggatgtcagatctcattttctccccttccccttccccttccttttcctttccgagacaaggtctctctttatcactcaggctggagtgtagtggtacaatcatgtctcactgcagcctcaacctcccgggctcaagcaatcctcctgcctctgtctcccaagtagctgggactgcaggcatgtaccatcacaccaactaattttttttttttttcttttaggtagagccagggtctcactttgttacttaggctggtctcagactcctgggctcaaacaatcctcccactttagtctccccaaaagtttagatcaaaggtgtcaaccactgcacctggccaggtctcattttcatagcagtcactggtagtaaggtaaatgtgctgcagataatcgtttggcctgtgttttggagggacctttttgttttttaattgtctctttgaattttgcacaaagaagggttgcacgggctccgttcatctttaacttattatttgcatccttttttatgataagttttaagactactgaagaaagcagctccggtaaagagcctcacaaaggccaattttcaatttctcccttgtgggctgtgtgtgtgtttatgacggtcagaagaagacagactctcatttaaaactattctctcttcaaagcaattataaagtggccccatcatagataaacttgaccccttttaattgctggttagattgcttcttttttctctccctgttgtgaacaggactgcagtgaccatccttgtatctgtgcatgtgggaacgaatctgaaggacaaatttctagaatgtcaagttggattgctagttttggaaggtattgcccaaactttttctcaaaaacactcagtttattctgtcgatatgaatgttgcaggggatattatggtacgttcagagaatacagttcactacagtgatgccaatgtgtgaaatacacttgacatgtgggtaggaacacataaccaagttatatttagtaaacaatctaccgagcagtagagttaatatgatcccatttattattttattttctaacaattactagtgatactttagtttggttcttgcttttctaaactgttaaccgtgaacatgtaactatttaaaacttatgctgggtttgctgggtcatgtctgtaatcccatcttggaagccaaggcaggaggatcagttgaggccaggagtttgagaccagcctggccaacatggcgaaacccgatctctactaaaaatataaaaattagctgcacacggtggtgcgcatctgcaattccagctacttaggaggctgaggcaggagaatcactggaacccgatggcggaggctgcagtgaacggagatcacaccactgcactccagcctaggtgacagagcaaggctctgtctcaaaaaaaaaaacaaccatatattattcattaaatgcatgttcatgcttacttaaccaacagtatggccctttggcttagtctcatagtctatctgacccttattttcttttcttttttttttttttcaaatgcccctttcattatgaaactcttttttaacttttaatttaagttcaggggtatgtgtgcagatttgttacataggtaaacttgtgtcatggggctttgttgtacagattgtttcatcacccaggtattattttattttcattttagttttttaaatttctttttagaggcggggtctcactgtgttttgcccaggctggtctcgaactcctcctggtctcaagcaatcctctcgcctctgcctccccaagtgttgggattataggcatgagctactgcactcagcccaccatttgttttaaaaagggtggatcctatttgtataaaaagccatgtgcattttctgtgtacttgtctacacattaatttccaggctgggcgtggtggctcacgcttgtaatcccagcactttgggaggccaaggggaggcagatcatgaggttaggagatcgaaaccatcctggctaacacggtgaaaccccgtctctactaaaaatacaaaaacaaaattagcagggtgttgtggcgggcgcctgtagtcccagctactcaggaggctgaggcaggagaatggcatgaacccgggaggtggagcttgcagtgagctgagattgcgccactgccctccagcctggacaacagagtgaggctccgtcttaaaggaaaaaaatttctggaatgatgtccaataaatcagagagagggactagaagactaatgaggacagaagcttttattcttaacacctatattttgctaccatttatattgtcatcatatgcatataacattttaacatttaaaaactagtttaaacagaaatggttgccctggaatgtggcctgtgttctttcaagggaggccagcagtttctacagtggctgagatggtaccttcatctcacacacctacgcaggagtgcatttgtgctttgatgtggttgtcccttgaagaaggaagcagttctctttttcttttttcccttttccattataggatcagtcacttcttggggcattagtagtctcatttccagtggcatcttcccttggcaaaaggaatcccagataggacctcatctttctaaacaaatgctgttttgggtcctaaccatcccatgtttgctttgaatatgtttaagttgcctggaattatcaacaaaagaattaaatttattgtaggtcagggcatcttttgactcattgtataaaacattcactttaaatgtataccgaaatgtcctttaggccgggcgcagtggctcatgcctgtaatcccagcactttgggaggccaaggcaggtggatcacctgaggtcaggagttcaagaccagcctggccaacatggtgaaatcccgtctctactaaaaatataaaaattagccgggcatggtggcgggtgcctgtaatcccagctactaggggggctgagacaggagaatcgcttgaacttgggaggcggaggttgcagtgagccgagatcactccactgccctccagcctgggcaacaaagcaagactccatctcaaaaaaaaaaaaaaaaaaaaaaaaaaatgtccctcatacctaaaccttacctcttgctaatttgctgagggttcattttagataaaaggtgtttaggttttcatattatgtttgtaactgtatagctatgattcagtttcctaaatgaaaaaagaaactgttttaatgtacagactatttagatttgaaaagactgtgagagctttttcttttatagcaagacaagtcaagaatagaaggcacactgcgagagggatgtcttttgaaagaaaagaaacactactttttatattctcaaatcactgaagaaagctttagacataatttcaaacactagctcctgtttaattcagatgcacagaatgcattaaaaccacgagtgtagtggacgtgatttatacattctcttagcacaaatcagtacctatcttcactgtaattagacttttcttcctttctccttctcaaaagctacttttgaaaccttatgttttccctggacatattttctgtacttcataaaatagctcagttctgcaactaactgcaaatatttgcaaaagggaacaaatgtaaaataaacgtcccctaatgcagtgtttggtgaagaaacatatgtctgacattagttggttaacctgaaaaatagtaagaaacaactctacttaggggaaagggggtagaattgagcccgtactgtgcaaatcaagagaaagctataatttacgcaatttttattaaagagaatacaagtgctgtaggcttggggtggtgctaggtcatatttaagcctaattgagctttttctatatcattagaaaaatgggccaagtttcctatattatagggtaaatacaacattttcttcctgcaaatattaaataccactggctttttaagacgtaaacatccaaatctcaaatgtctttattcatgccaatgcaatacaataaaaatattccccatatacacttaaatcactgcaagtaagccttagaatccccacaagtattattacttactatatctcagaaactttcacacacattatttcaaatatagttctcccaaaaaaaccctgcggagagatacctgtaaaccaaggctgagactagcctagacagttcgttctttagacaacaggagtggagatttgaacccagctattgtgactcaagcaagcctagggcatgtttctgagatctctaaggtgtgcgctgtgaaaccggtggctcattttatgggttggatttccaaacacgactatcacaatcatgccaggaatcaatgactgacttcttgcctccgtggcctgaagttctcctctgcacctcctacctttttgccatttcagtgatgcaccaaagggtggagttgaagaacatcagttttgctgctgcttgttggcaatactctcaaaaaggcgtggggagggagaggtgtaactcacccctgaagtcaagcctggagattacttgtcaggaatgtcaaaagcatttgttaagcaaccttcttcctggcattttaagaagaaagccgcatacatagatcaaatcccttccttcagaaacctgtactctctgaacagagccttggaattcagcctagagaaagaatacttggtggttcatagaacttggttcacaaaagagtgcttgctgcccacgcattttgcacaatgactcccaaacacacagaatgcacattggcaacaattttacgcgtgtttccaaaagtgctgactggaattgaagggacacatttggcactttttttttttgaaatggggtctctctctgtcacccaggctggagtgcagtggcgcaatctcggctcactgcaacctccacctcccaggttcaagcgattctcctgcttcagcctctggagtaactgggactacatgtgcctgccaccacgccttgctaattttttttttttttgtattgttaatagagacggagtttcgccatgatggccaagctggtctcaaactcctgacctcaagtgatctgcccaccccccgcccctcggcctcacaaagtgctgggattacaggcgtgagccactgtgcctggccacatttgtcaactttcattggtcaatgattgatgcaagccagaataagaatagattgggccgggtgcagtggctcacacctgtaatcccagcacttaaggaggtcgagagagcagattgcttgagaccagcaatctgagatcagcctgagcaacacaggaagaccctgtcttcacagaaaaatgaaaaaaattaggccaggtgctatggctcacacctgtaatcacagcactttgggaggctgaggtgggtggatcacctgaggtcaggggtttgagaccagcctgggcaacatgatgaaacctgtgtctactaaaaatacaaaaaatagctgggtgtggtggtgcacccctgtaatcctagctactcaggaggctgaggcatgagaatcacttgaacccaggaggcggaggttgcagtgagccgagatcacaccactgcactccagcctgggcgacagagtgagactatgtctcaaaaaaattaaattaaaattaaaattgagcctgatgtggtggcacatgcctgtagttccagctatgcaggaagttaagatgggaggatcccttgagcttgggagatcaaggctgcagtgagctgtgattgtaactactgcattctagcctaagaaacagaaagagacactgtctcaaaaaaaaaaaaaaaaaaaaaacaagaaaaaaaaagaaagaaaaaaacagatcagaggccctggcctggggtcagtttctccagaaaggcctgcacaatggagttttcatgtaaaaaatttcttacatcctgattttaaaaaatcagatgatcaggaaacattgagttccgattcctttgttacaacctccactaaagctaagtaacagctgctgtattaagatggggctccccctctccatcccacacctgcctcccttacatgcctaactcctgttgtaaatagggaccctaatctgatgtttttgtagtccctttcctaggggcactgtggggaggtggaaggaatttcacctttgttgttggacagacttagatttgagaactggttctactacttactgtttgtgtggtctgggacaagtcacttggtccaagtaagcttctgcatctgttaaaaaaaaaaaaaaaaaaaaaaaaggggcggggagctaagaattcctgcccagcaagttggtttgcagatcagaggcagtgtgtgagaagtacttaacccagcacctggcatatagtagatgttcaggacatcgtagcaggaataagggagacatctcacaaaacattttgtgagaaaggatcagtttctatctagtcaatgtcttaaacattcataggttgttcatggtgggagctgctcgaggaatcatcctagttttatggaggaggaatctgaagctggaggaattgtctccttcaagattacttagttaaaggcaaacaggttcatagccagtggctcttcaccaacccacaaaaaggcctcagattataattttgaagattaagtatatgaaagtgctatttgagtgattaagtgtaagcatcagatcattttgaactggtgagatggctcacacctggaattccagcactttgggaggcccaagagggaggattgtttgagcccaggagttcaagaccaacctgggcaacattgtgagagcctgtccctacaaaaaataaaaaaaaattagccaggcatgctggcacacacctgtggtcctagctactctagaagccgaggccaaaggattgcttgaggccagaaggttgagcctgaaatgagctctgattgcgccactgtgccacaagctgggcgacagcaagacactgtgtccaaaaaagaaagataattttgattagcacaaagatgggacagctacatgtgatcagatttggaaaaaaaaaataaccattcattcattcattcatttactcggcactgattgagtctagtttggacaggtattgccctagtctctgggatgacagcgagaggcaaaacacagacactcactgcctgcatagagctcagaatgtaatggtgggaaggcagaggaggaaacagatatacagataattttagatggagatacctgccatgaaggaagtagaggaaggccaggtgcagtggctcatgcttgtaatcccagcactttcccagcactttgggaggctgaggcagaaagatcgattgagcccgggagtttgagaccagcctgggtaatatagcgagaccccgcctctacaaataattaaaaaaaaaaaaaagaaataggattacctgaaaaggagccagtcttgcaaacagccgggcaaagagtgagcaagagttttttgggaagaggtgcacacagcaagtgctgagacccagaggaaggaaggggcttgtctgctgaaggacccaggtgccctgggagaggtagccagaggcgcttagtaagcttcaatcaggattttaatcttaatatagtgctgagggttttaagcagaagagtgatagaagagagttagcttttgtgcaagcactattattcatggaagtcccctttcgatggggtagtggggactcctcactaagctgtccttctatctctgtggctgtctcagagaagcactgtggaactccagggtgctacgtagctcaccacggtgacccccaatgcaggccacttacagaagcttgaagatctgtgatttgctcacccaggctcccatgccgagtgttcttgtcattaactcaaaagccaaatgctggtatttctgttcttacttgcttgattgtttgtttaccagttctcaacatcttcagtgtccacttggttactaaaatgtttactccttagcccagtgtgtaggcatgtgcctgtaatcccagctactcaggaggctgaggcagaagaatctcttgaacctgggaggtagagattgaagtgagccaagattgtgccactgcaatccagcctgggcaacacagcgggactctgtctccaaagaaaaaaaaaaaagaaaaggaaagaaaaaattatccaggcatagtggtactcacctgtagtcccagctgctcgggaggttgaagcgggaggatcacctgagcccaggaggttgaggctgcagtgagccatgatcaggccactgcactccagcctgggtgacagagtgagactctgtctcaaaaagaatataaaaataataaaaataaaataaaatgtttcctcttgatcacaaaaaaaaggatatagttctatgcaatcatgtctgaaacaggatacgtgtgtcatgcatccctgagttcgggttacctcaatgacatgaccatttacctaatctttgctttttcatctgctctcaattgaaaagaaagaaaccattaattatattgaaagatgctgacttgtaagcttctcccctctcctggctcaggtcagttgctcagaatgcacccagcaaagattggctgaacaaagacagggagatgttgtgagtcccactgatgcccttaacaccgggcattgttcaacttggggtcatttgtgaaaatgatgggaatgcaacttcctcactttacagatgagaaaacagcctcagagaaatgctgggatatgggatatgagttggtctcatagcctgtgagtgccagagccagctcgaatccaagtttctgactcacagtgactcttatccagcaggacgtattcttcagaggccatgtgttgaaaacagttaggtgggttgggggctgcaggccataccattaggaaatggggggcatgtcctctgggtggttcctaagcatttggatgttacagccctgcctttctttattctgttgttctagaagctccaacctggtatgcttttaaggcagatatggccacaaatgaagcacattcacatgactgcactgcctttctggatgaaacaatttgaccaaacactggtgttgagacagttggtgatttgggctttgccacgtggtgggaatgacacaataaatatattttgatatgaattaggtaaagatctgtctctaaccttgggctatatgtgaacattaactgcccattggatactggggaactataaatgtctccgtccaactctgttcaactctaatttttttttttttttgagacggagtcttactctgtcacccaggctggagtgcaatgacgtaatcttggctcacagcaacctctgcctcctgggttcaagtgattctcctgcctcagcctcccaagtagctgggattacaggagcccgccaccatgcccagctaatttttgtattttttagtagacacagggtttcaccatgttggccaggctggtctcgaactcctgacctcaagccatccacctccctcggcttcccagagtgctgggattacaggcatgagccatgacacccggcctgtaattttctttaaagactgccactgggtggaacccactgggcccagtgagaactacggaaaagagacccattcttgccctcattgttagtgtccacatccggatttacctaaaccccacccaggtggcatttgcatagtaatgaaaaaccggtattttctagctgtgaatcacacttcaaatcctgagcggctgactgtcaggggtgcgtcaggcctgcttgctgggagaatggacgagctggttgtggagcgggcgggtcccgccacccgtgggctcagcactggactgctcccagaacattaaaggtctggctgatgttccatgccacatctggacatgaagacccatgtctgcccttctgtagaagggccaaagaagaaaggaggcatcacatgtttctgctgtggggggcccttccgagcagcagacaggagcaaggtacaggagtggcctgattctggggtttccctgccccccctggggtccctaaactgctgtgtgatatgtttctaactatctggacagctcacccaagagtcagttgttcccagtcgcttcttgctgaggataagccaaaagagggccgggggccaatctggtttctttcaagtgaaattatgcttctcaagcagagaatgattgcccacagcagttaaaccttgtttaatggtaattaaattgcttttcttcactttgaaaaatctcttaattttctgtacaaaggcaggaagcatttttctttgattctacaggatgtttctaagtatggtgtaatcagttcatcttaccttgccgggctctgaaagaatgagtgtgtgggatcagatttagaaatgcctcaaaggttagaaagccgagtgctgccgattaactcaagctcagatgaccaaaaaaaaaaaaaaaaaaaaaaagctgcttttcccctcacttctccctctggttctgcctcagtactttgcttaggagtttctaaaagcaggcacagttgcctgcggggctggtgtgtgtcaccttcgcaaagtgcagatgaggtctggcatgtcccatcttgttcctgcctgactacaactctgcacacagacagtgttgatctggcttggagcccatagtggcaatccttggagtggaggcagcagagatctcagttcttcctagtgcttgagaagttaactaactgtctttcccatgaggaaaatgttttgagactgtagaagcagagaagagacttcgccaaagcccatagaaaataaaaagcaaaccctcaagcatgaaaatccctggccctggagtaagtgcaggtgataaggcttgctatctgatgcctcattccatgtctctggcttcccattgcctaaattaagatgtcctgaaagaaaccttgggaaaaaaaaagcacagtccccacatttgaagtagaaatagaattaaggagaaattgtgattttcctgaaggaacagaaccaacactggttttcaaaagccttagttttacattttagtagaaactgttagcagtaggaggatttgctttgtgtgtgtgtgtgtctgtctgctttgccttattttggttctgaccataccactgctatctcagtcttagaggctgattttgtggcccagagtgtttcgttcagatatctttgtgttgaggtgatattgagccagcagccaaagaaatgcatggccaagatatggaatatctggtcaacagagaataacaacaaagtgggacgcatcataaggtcataggtcagtgaaaacagctgctagccatttatatgcaggagagaaagaaggcccagggagttggaaagactgaaggtattttggactgagcagagcaaagggatttggggacatataaatgtatgaaacaagatggtcaggaaaacaatttttttcaaaggtagcatgaatagagtgaggtaaggaaacccatggccatggtactggtggcctaatgggaaaaggcagtgtaatgacttctacatggagacttcagttctgcccctcgtactgttgaagaatattctgtccagagaggctcttcagtttctacctggttttctaatggctttaaaaaactttggtgtattgggggaatggaaacaaagatatttactagagaagtgtttggcaaaaagtgccaagcttattcctgagaaaggatggaacggcgtggggggtggagggagggttggaaccatactccaaattcccctgaggcccacacgtgttcaccagacatctgtggggagcccggatgagatgtggggcccttcccctttctcattttcttttttacttttagatcctggatcaaaatgagtccttgattccctcatcccatcccaggacccttttttagttgcattaccacctagtgaagtctaccaagtcttgatttgagaatcaaaacaaactcagatcaaagtcaacctcagggaatcagagaacacagaagctgaaagatgtatccagccttccctaaatggcagatgaggacactgaggccaggaagctcaggtgacttatccaggagcgtgccagtacttagccaaagatctggaactgggactgatgcttcctgaaaacagattcctgcctggagtgcatgaccctgcttgagaaagtgcagagggacagtgacaaggcgggataacgtagcagtcccagcgacttgggcacccatcctgatgcttcccctaggccccagtgttttattttctggtaaggccagacctgagtcaggtcctgcctcctaactcctttctcttccttcagtgggcaacaaagatggccacagaagcagagaggggttcctcccaggtacatatttaccagtacttgtaccttgcgcttttaaaaactctttagccagggatagtggtgcatacctataatcccagctacttgggaggctgaggtgggaggatcacttgagcccaagaggtcaaggctgccgtgagccgtgattatatcattgcattccagcctgggtggcagaatgagaccctgtcccctcaacctaactctgatgaggactatattacaagtgttatataccagattctggatggagaagggaaagtgattgtagacaagagaatattatacttggttgctgtgttctccaaacccaaacgcatagatacacacagacccacagacacacacacacagacatgagcgggacatatttgaaatcctcactggttttgaaaatctgaggctaatagttggaggaagtgaggggtgactgtgagagaacaaatgtgtaacagatacaccctgagaatcagggctcataaataaggagtagagtctattgcacctaagccttactactagcctaagccttcatactagagcaaaaccgtgggcagacagcacacaaaagcagcccctgtcactcaggggcttacttcttttttttttttttttctttttttgagacggagtctcgctctgtcacccaggctggagtgcagtggcgcgatctcggctcattgcaagctccacctcccgggttcacgccattctcctgcctcaccctctcaagtagctggcactacaggcgcccgccaccaagcccggctaattttttgtattttttagtagagacggggtttcaccgtgttagccaggatggtctcgatctcctgacctcgtgatccgcccgcctgggcctcccaaagtgctgggattacaggcgtgagccaccgcgcccggccggcttacatcttaatgagcccacagctgcctgttgacctggtgtcatcacgagggtgatcactatttccagcaagctctttgtccctcaaagcccagggatcaggggcagcccgtggaagacgagccactggttccagcgaggcacaaggagagaggttaagctgcttctaccctgttcaactgtgatgagattccagcgaaaatcagcattgagggcctcaggtgtttgcagggggctctggtatgttagaaaaactagagggaggggtctgcctttgtgtctgtttgtgagcgtgtctactcaagtaggaaaggggagcacagatttttacaaaatagatgtgggcggtttcttgtagtcttgcctaactgaaaccatgtttgccagagattacttggaattaccctaataggtgctttgtcaaaatacttggtgctggccagatgtggttcatatacctgtaacttcagtgctttgggaggctgagacaggaggattgcttgcggccaggagtgcaaaaccagcctaggcaacatagtgagaccctgtctttacaaaaacaacaacaaaattacctggctgtggtggtatgtgcttgtggtccccactactccagaggctaaggtgggaggattgcttaagccctggtggttgcagatgcgatgagctatgattgcatcactgcagtccagccagggcaacagagcaaaatcttgtgtctaaaaaagaaagcaatacttgacggtgaaagcgagtcctgctcaggggtcccttctggaaagtcctggagcctggaactgaactccgtgattcccctgtgccttccccctgggagcctgagcccccttgaaggtgacagacacgggggaacctgtgtcctgtgggatcactcctctcagtccttctctaccacatagagaaagggatggatggcaaagtaaagccaacaaacctccacttccttcctcctccccactgccagagtggagattcttctttattctgtggaactggattctgaaatgccaaaccattccatctgttgtgttttggcacaagtgctcaaaagagctcaggtgtctccctttgcaatttccccatggcttaaaattcagtcctggagatctgtctcttgtaggaaatggaggggctttccttatgcttgtttttctctgtaaagaagcataaaggtttaagttttcgttgggagggcctaaattaggaaggaaagattatttaaatcaaagcactctcattgtagagtcataagcttggattttgtgtgcatgccatgctagctcaaaaaacaaagttgagagtcagagctctttgaaggatgaggaaggggacccgggaatgagtggctctgcttcaggaagcatgttttaatgtgtgttcctaaaaaagcctctggaaaagtggtttaggaagcttctgggctaggagagacaccatgaaaaacaaaacacaaagtatgtgagtcagttatgatcaattgtgccataatcgacatttcagttgtatagtagttacactatgaaaagcacagacatatttaaaaagacaattttgaggccaggcatggtggctcatgcctgtaatcctagcactttgggaggctgagtcagaaggatcaattgagtccagaagctcgagacgatcctgggcaactttgtgagacctcatctctacaaaaaaaaaaaaaaaaaaaaagccaagtatgctggcacatcccagctccttgggaagctgaggcgggaggatcacttgagcccaggagttcgaggctgcagtgagctatgattgagccactgccctccagcctgggcaacagaatgagatcatctcttaaaaaaaaaaggagaaagataattttgagattcaacatagcccactaacagcttcatttagacatcataccttttgtctagacttgacagaatttgttaaatactggaaagttgtattttttatcttgtttcccctgttctgtctgtgaatagagacgtttgttctttacctagtttataggactgtcatgaggaaaggtgacataataatgggttcacagtattggaagggggaggacaaaatgcctgtttacaagagacccagttacagagctatgtgaagtaaatactgaatgtcaattctaggtaacgatcctcaatgtcacaggtacttcacgtattaatacctctttgccattatacatatgtccttctccaaatgatggctctttgctgtaaaagtttgtcttctaagctggttgtgtggaatttggcccctaccttccacattgtcttataggagtgcatttaggccaggtgtggtggctcatgactctaattacagcactctgggaggctgaggcaggtggattacttgaggtcaggcgtttgagaccagcctggccaacatggtgaaaccccttttctacaaaaatacaaaaattagctggacctagtggtgggcgtctgtaatctcagctacttgggaggctgaggcaggagaatccttgaacctgggaggcagaggctacagtgagccgagattgcaccactgcactccagactgggtggtagagcaagactctgtctcagacaaaaaaaaaaaaaaagcatttaatctggtgctgagctgacctcttgtactctgattttttcattgtttagattggaaataggtcctgagttctaattctgtatttgggacttggtgactgcttctatcccagtctttgatggtttagacagtggaaccctccatgggggcatgtgggtgatcctcttgtcggggaaaaaagagggtgagtgactagggggtgggctaccgtaaccaggactctgaggataggtgcagggtcactgatgactgggaagagttgtaggtcctgccaccatctattttgcatgggaaggacatttgcctgagctaagccatgggaaaaatctaaatttagatacctgagctctccacagcaactaagccaagacacagtagacagaatgttttggcctttcagaatcagtattttacatacaaggactcgatttcacagaaaacccttctcaatgcttatgtgtatatgaaaagaaagtttgacctgcaggaatcattgtaatgtatcagatccatatcacagctcaattattcccaaggattcagggaggaaaagccaacaaaaacaaaaaaaggaataaaggaattgggttgttatggaagagaaagctaaaggggatttatttgaggtctggaaggctacgacgggttgcattcagatgtcatccacatgtccacagagaaccgcacaaggacttcaaggtgaaatagtggctgatcaagtcctaggagtctgagcaatcaaacattggcatgtgttaccaattaagtagagaggtggctgctgttttagaggcttgatgattgtctgtctttaagagtcaatattggccgggcgtggtggctcacacctgtaatcccagcactttgggaggccgaggtgggtggatcacaaggtcaggagatagagaccatcctggctaatacggtgaaactccgtgtctactaaaaatacaaaaaattagccgggcgaggtggcgggcaactgtaatcccagcttttcgggaggctgaagcaggagaatggcgtgaacccaggaggcggagcttgcagtgagcccagatcacacaactgcactccagcctgggtgacagcgagactccgtctcaaagaaaaaaaaaaaaaaaaagagtcaatatttgtgggagtctcaatttaaggtgctaggtaaattgggagttccatctgaggtttctttcaagataaaatgccttataaaagtactgtaagtccacctggccaacatggcgaaacctcatctctgctaaatatacaaaaaaattagctgggcacaatggtggctcatacctgtaatgccagctacttgggaggctgaggtgggaggattctgtgaatctgggaggtggaggctgcagtgagccagtatcgcaccactgcactccagtctgggtaacagcaagaccctgtctcaaaaaaaaaaaaaaaagagaaaagtattgtaagtcacttcagtattagggatgggggccaaagtccactcacgtataaaaatatccctcagaggaagacttctatgtgtgtctcatgcaaccactttatgctgtctctgaggttgttcattccagttttcctgcttttctgttccagacttgggctgataccagagagtgtggattgcctgcagggcttcatgcgcatttctctgtgtatttaaatactcacggaagattagcaactatgcataaactttccagttgtacttccttaataatgattactgctactctttgttggtagctaagggaagcgtctgcatggaggtggcttagaattgacaatgtgcaaaattctgggtcgtttcatgggggctgggggaaggcttggaaataaaggcttgggtcattcccttgtgtttagctcttgcaggaaactcttgcaacaccatgctgttgtgttatcatctgcctgggtttcgtccccaggacagaacggcatgaatgatgtctttagtgtctcacagaaggaacactgggttcttgagtgcctgccatctctgtctcatcttgactccaaggacattttaacctctcaatgccttgttttgcagccaaaggtatattatctgtctcccatatgcgttctgggagattaaccactaagcattttgctttttaggtgtgaggcgctgtttccttctaagaccagtattgtttctgactaactttatccagttgagtggggttgtgtctctatttcatgttacgagatgcctctaacatttttattatgaaaataatttttgtgtccattgaaaaggtttgggaggagtatttaagttttgtaggataattatagatactctatcagtcatacattctatcttttttatttttttttgagacagaatctcgctctgtcaacccaggctggagtgcagtggtgcgatcttggctcactgcaacccctgcctcccaggttcaagtgattcccctgccttagcctcccgaggagctgggactacaggcacgtgccaccacaccaagctattttttgtattttttagtagagatggggtttcgccacgttggccaggctggtatcgaattcctgtcctcaggtgatccgcccacctcggcctcccaaagtgctgggattacaggtgtgagccaccgctcccagcccatcacacactctaaatccatacaacgagtacagcgggacttttctttctgtgttttgtggcaaataagttggtagaaatattatcaaataaaggccaaaactgtgttcagagacctggaagttcattcttttcctggttttgttgtatgtctgagacatgcagagggacagacaaaaagatgcatttaaaaaagagctgccagggaacacataccaaaatggaaatttgggaaggggatggacaagatgagacaaagcagacagacacagattttctcaggtcaacaaagttgtgtcagactagtaagaccagctttagagtttaaaaaaaaagaagaggaaaaagaaaagaaaaaatacacacacaaacagaggtgcacagaacattccaggaaaccattgaactgtgagtgataacgtgtttccttctattccttcaaagatttgttttagaggatagctgggtaagaacttgtgctgaaaaaacaatgcaagggatttgtaaagaaacagggaaatgaatgatctgacaggccgtttgttaccaccaacatttttcttaatttaacctgaacttacttgctcttgtggtggtcggtcggtctttctctctctctctctctctctctctctctctctctctcattctctctttctctctctctctccctttctccctttctctctttctctgtctctctttctctctttctttcttgtctcattctgttgccctggctagagtacaatggcacaatcctagctcactgcagcctcaacttctgggctcaggtgatcctcccacctcaacctcctgagtagctgggactacaagtgtgtgccactacccaccacaccctgctaaatttttgttgttgttgttttgaggagaccaggttttaccatgttacccaggctggtctcgaactcctgggctcaagcaatccgcccaccttggccacccaaagtgatgagtgctaagattacaggcatgagcctctgtgcccagcttggatatttcaaagacattagccatggccttcatgtttatctggacttgagggcttcatatctttgaccatagatgatgcttaagttggtctttcacgtggtttcagatccacagacattttgattaggtcaaataacaatcgtcttcataatgccaccatgtatgtatgtagtcctttggagactattttgacatcatttataactgacaacactgtgactttcatcctcctcttagctcacatgccttaatcccacatgtactgccctgtagagaaatattcctccttcctcttggcttgctttcttagctttgtctctatcccaggacaataactgaacaaaggctcttcattcttggtgcaactcagagttggaagagtcaagggtgaaggggcattgggcagccggccatagctgtcttcttcctctcttaatgtctttgtctctcccatcttcatgtggacattttctctctccttcttctctttttcctcccctcgctgaaaaaaataggattactgttttgaaccgggcattatgctagatgatagatgtacaggggtcagcaagatgggcaaggtttccatcttcatgtatattaaagtttggagggaataaaacattaaaataaatagttacaagggtggtgagtagtaagaaaagataaggaatgcttagcaagggggactgaaatagtgtagaggtgggatgaggagtcagcgaagtctgagtaagtaaattcagagagaaacaaaagaactacactctagatttccctttaaaggaaaggaaggggaaagaaataaaattccaaagagaaaagggcagaaagatactttgttttatacagaacactggaggccccagtgtaatcaacatcaaatttgtgtatctgcaaaggctgatcttttttttttttttttgagacggagtctcaccctgtcgcccaggttggagtgcagtggtgcaatcttagctcactgcaacctctgcctcccgggttcaagcaattctcctgcctcagcctcctgagtagctaggattacagacatgcactaccacacctggctaatttttgtatttttagtagagacagggtttcaccatgttgaccaggctggtctccagctcctgacctcaggtgatccgccagcctcagcctcccaaagttctgcaattacaggcgtgagccaccatgctcgacctaaagactgatcattttttatcagttgtccaaagacttcatcttttctccttccctgataccattgcattcagccatggtgctgagaggtgaagccagctggacttcctgggtagaatggggacttggagagcttttctgtcttataagaggattgtaaaacacaccaatcagcactctagttaggaatgtaaaacgcaccaatcagcgctctgtagctagcaagaggatggtaaaatgcaccaattagtgctctgtaaaacacaccaatcagcgctctgtaaaatgcactaatcagcactctgtaaaacgcaccaatcagcaggagtctaaaagtagccagttgtggaggattaaaaaaagggcattctgataggacagaaatcgaatttgggaggggacaaataagggaataaatgctggccaccccagccagtagtggcaacccgctcggtccccttccacgatgtggaagctttgtcctttgcttttcgcaataaatccttgctactgctcacgctttgggtcggtgccatctttaaaagctgtaacactcaggactgcgaaggtccgcagcttcattcttgaagtcagcgagaccacgaacccaccagaaggaaccagacacagtgccacctacccacatcttcccctatggctagatggcaggaatccacaaacacctgccaagatagtattgtgatcatgttaccagctataattggaggtgaggagtttggagtagaaatttgtctgtttttataataacgaggttgaattatttatagctttgtgtctttcctcttctccataagtataattaattttattaggcatctattcctaagagccaggaattcacatagctgctgggaagatgaagacttataaagaccacttgtggtctctcaaggagtctgttggcagagactggcatacataaaacaaatggaataaatattctatcaggaatatgggtaaggtcttacagaaacccagaagaggaaagagttctcccaaggtaagggaacctagaaaaagttacaaaacggaaagagctatccatctatctgtatctgtatctataactatatatctacatctatacctatatctgtagagatgggatcttgccatgttgcccacgctagtcttgaactcctggcctcaaatgatcttcctttctcagcctcccaaagagctgggattacaggcatgagccaccatgcctggccccaagaagggatatttgagttgatcctaagagaatgatagactgctgataaagctaaatagacttttttagagtgttccattatttttgtattttgtagttaatgcttaatatgagtaatcatgctttagaaagagaaagcaccaatcaaaacaagcctattttcttttcacctaggcatagtacttggtatgagttggcctagaaacaactgcatattctactcacactgctgcatggtttgcctaagagtactccatagatggactattgaaatttgggtgtgggttaaattttcataaatcaaatttcatttcccattatcttacacctaattaaagagataatgtgccttctgatgaccctgtaattggcagttgtaactggccctttaactttgtttccctgcgctgcagctcctgtctccagcagttagttcatcatctgtacactaacagtaagctacgcgggcaggcactattttaaaaaacacacacaaagctgtctgtgaatggcaaaggaatcagagcaagtcattactctctagttcatttggctagaaaggtcaggtcgcctatattgacttttcatgaaaactaggcgaactagtagttttcatgcacaatatgtcaacaacctgttatatttgaaattctttttaaattaggtgggtgaatggtgtaaaacttcactatattttctccctgcctgttaattgacttgctaatctcctgccaatatatgtccattttaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgaggtatcatctcacaccagttagaatggcaatcattaaaaagtcaggaaacaacaggtgctggagaggatgtggagaaataggaacacttttacactgttggtgggactgtaaactagttcaaccattgtggaagtcagcgtggagattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcatatatacaccatggaatactatgcagccataaaaaatgatgagttcatgtcctttgtagggacatggatgaaattggaaatcatcattctcagtaaactatcgcaaggacaaaaaaccaaacaccgcatattctcactcataggtgggaattgaacaatgagatcacatggacacaggaaggggaatatcacactctggggactgtggtggggtggggggaggggggaaggatagcattgggagatatacctaatgctagatgacgagttagtgggtgcagcgcaccagcatggcacatgtatacatatgtaactaacctgcacaatgtgcacatgtaccctaaaagttaaagtataattaaaaaaaaaaaaaaaaaaaaaaaggattgtggcctggcgcagtggttcacacttgtaatctcaacagtttgggagaccgaggtgagaagatcactggaggccaggagtttgagaccaccctgggcaacagagcaagatcctttctctacaaaaaagtaaaacatatgaggcggcctgttggcacacatttgtagtcctagctactcgggaggctgaggtggaaggatggcttgagccctggagtttgaggctgctgtgagccatgaccgtgccactgtactccagcttgggcaacagagtgattccctgacttaaaaaacaaaaagattgctttaaacattcatcaaaaaacagagcaaattacactttggcagaaacatgaaggctaatacttgaatccaagcacccattccctctgggcttaccacactgaaggcaaaatgagtggggttggtttttctcctcaagaaatgttgttctgggacagtgagtcattggtttttgttcttgcaacccttcatcatctaacaggtttggttaactcaagaagttctaggaaatgttcaaacactgcagatatttatcaaggggcatttttaggagtagcagagtgtcaagaactcaaattgacatctagtggcaacacttctaaagattggggccccgtactatatacaatgctaaatttccaatgctgtgattggaaaagactatgagaaggcctctagtctcttcccactaccatcatctgcagcaggcccacaccacccaaatcaacacaggtatggaagaatcgccccctgccacaggagtgggcagtaagcgttagaacacagattgccgagttctggttctcagtccacccaagtctggtctgtttccctaactgtagaaggaaggtgttagaaatggaaaatccttaatatattctttgattttttcaaaacagaataattgatttttatcatctttcttagtatacctttcacgttctgcacaattattctagattcaaactgaagattgtggttcatgtcaagagtcagtttggtcactgaacactgtctcatccagctgtgggacactcatatgagcttggtcataggtggctcatcttcccccacttactgggtttccataatgccattctcttgggctgttagataaaatatttacaacccatccctccatcatcatcaaagcaatttatttgcacaaactccactgtcactaaatcacatgaatgcatccatctttcttattttcatctttttgaaaattagccagcatgaaaaataacagcaatcgattaagctattgcattgtgaagagtagcttagatttctttctttctttttttcaccctgttgcccaggctggagtgcagtggtgcgatttcagctcactgcaacctctgcctcccaggttcaagagattctcctgcctcagccgcctaagtaactgagattacgggcgcctgcctccacacccagctaatttttgttttattttttttagtagttatggggtttcaccatgttacccaggctggtctcgaactcctgacctcaagtaatccacctgccttggcctcccaaggtgatgggatcataggcatgagccactgcacccagccagatttctttcttttgatgatatttgggagtaactgtggaatgtgtccccccacctatatcatacagcaatatttttttgatctacaaagcacaccatatacttcactatttattctgctgaggggaaatgggtgagactgccagatttctatgagaattacagggttttcaagtcattatggagaaaatgattgaggttcagtgtcattggaaaaagcatattcttaatttgtctataatttttcctttaattggtagtttggctccattttcaaagtacttttgaagctttcttttccaatttggcatcaaagttatttttctaagtgccattcaatttgggacttattttctattttgattgacataaaatatgtcattctgaaaggaaaaatatcaacacagtttttgagtaagaaactcagtaacattgaacttagtaatcacctccctaggagtgaaatttcatggtcatatatattgaaaaaacctcacaatataaccaacatgctatctgaatcttgattgagattccacatcataagtgctaatttcagttctgactataaccaatttgttagtttatacttactctttactaaaggaaagaagagtaggaataggatggtgcggtggctcacacctgtaattctagcactttgggaggccgaggtgggtagatcacatgaacccaggagttcaagaccagcgtgggcaacgtggcaaaaccccatctctgcaaaaaattataataattagccaggcgtggtggcatgtacttgtagtcccaggtactggagaggctgaggtggaaggatcacctgagcctggggaggttgaggctgcagtgtgtcgagattgtgccactgcacttcagcctgggtgacagagtgagaccctgtcttaaaaaaaaaaaagagtgagaataatgaaactgtgcacacgcaggccttttaataaactttccccctgtacgcagcccattctagctatatatatttcttggtcccagcctcttcaaataaaaattgttttattcaaaagtatgacctagccttatacaagataagatagcccacttaaaagtggcataaaaggccacttttatgcatctccattttaggttggttacaagaggcacagagagaccaaagcccatgggatgctcgtgagagtaggaaattgggtgggaagggtggactcgggagacaacctgacatctctctacttgaagcctagcaataaggttcaaaggttcctcatgccttgttttcccttctctctacatgattaagatcccattcctgtaacagatagcaatgtgtttatgcagtaaaattagataagggagattactagggaagtcactactcagttagggatgtcagtggtgctcactgcaggtccaggttagtaataagaactctggactagtagctaggagtgcttgaatctagattagttctactttctaactcgatgtgtgacattttttccacttaatttttttggccttggttatcttattggaaaaaatattcaagttgcacaaataactaaatgatgcctgagttttcattcagttctaaaacttctcaactgagcaatctgttgttgaaaggagagtacgagttctaaaagctactctagggagctctgcattcaccaagccgctccatcattgttgggaagaaaatactaaggttgactcattgtcaaagccacattctactcaaactcaatgtacataactcgaattctagccacattccagccaaattgagatagctgttcaaatagtcatggatttatttaataactgacttcgaaattctttacttctttcaaggtggcattaacaagtatttcggaatttcaacagagatcggttttcacgtgctcttcaatgatccctgtgaaataaatcatattcaagggtttttttccccttatgagttattcgcctgaaggaagaattcttcatttctttttcttttaaatgcatgttggaataaagtcttctttgaaaagtcttaatgaaaagagcaaacgtggaatagcatccaccccagttctttctctggtccttgcactctgagaatgaagtcttagacagcagaatgtcaggggactctcattgcgtaaaagtctgtgcccttctgcgccttggacagttatggacagaagcctttaagaagaagaaaattaaaactagttaattttttagttaattttagcaacactacatatatgagagagagaaaagatggcattttctgaatgaatgagatgcctctgcattttgcccaactcattggagactcaggatagagaaaagggagaaattatgtttagaggctgataaatttccctatggttactatcaagagatcagactcttattaacatttgcaaagtgtgagcagagaagagcatttgaacaataagcatagattaagtactcctctttccttcattcccttttctctagtcatattctcagacagtccaggctaagtattaatgatcttctttgaagttaaacatacccttgctactttcattacattattatttttatgttcttccttttggagtactcaaggtaaatgacatggcagaatctgtcccagtccagtgagggtgtcacataagaggcccttggcttacctctatgcataactggcccacgtcacatctttaattagaagtccaagttattggctggacgccatggctcatgcctgtaatccaagcactttgggaggccaaggtgggtggatcacctgaggtcaggagttcgagaccagcctggccaacatagtgaaaccctgtctctactaaaaatgcaaatatcagccgggtgtggtggcacatgcctgtaatcacagctactcgggaggcttgaggctggagaatcgcctgagcacacgagatggaggttgcagtgagccgagatcgtgccactgtgttctagcctgggcgacagaacaagactctgtctcaaaaaaaaaaaaaaagtccaagttactgttgcagggattgggacatcttgcctttctcaagttgagcaatattcccaaatataaaaatgtaggatcttagtccaatcagagcagatatttggtgtagggcattttctaatgtagtaccaataaattagacgcatacctcaaccaaaaaacagcccatatccagtaagtaataaggcaatgatttacatttcacatattaccagagtaatgactaatagcatacatgtataaactgaaaagtgactgatgcttattttcagatgggtccaaatttattggataattatggagaataatgtatgttttctgagagttggtagtaagaaaatattgccattgctggccaggcacaatggctcacacctataatcccagcattttgggagacttgaggtcaggagttcatgaccagccacctcagcctcccaagtaactagaactactggtgcatgccaccaagtccagctaatttttttttttttttgagacggaatattgctctgtcacccagattggctgtgttctccattctaagtccagtggttagaaattgtcaagttctcacatctgcaaaaaaagtaaaaaagatgaacctgctacatctaaatatactttgttgtcttcctacaagtcctattttacatacttatggcatttttactgcagtttgaaaatacagtcaattcttgttattcacagtattgatgttctataaacttgccctaaatactgcattagtgagtcctgaatttattagttaatactgaatttcctaggggaaatacagggttaggttcctgtgagtctttggttacctttttatcaaccaatcaacaaaaatccttattttacctgtgtttttgtttgaagacaccttttaaaatatatattattgattcattagcattgaactaagcttatctaatgcacttattttttgtgtaaggtgtatcacagccttcttgagcctaggaatgccaaatagtacttccacaccatacttaagggccatttcattttatttcttatttttaaaatttattctcttttcttatttaaagaaaaaatttgtagatgccgggtctcgccctcttgaccaggctggagtgcagtgacacaatcacaactcactggagcctcaaactcctgggctcaagtgatcttcccacctcagcctcccaaatatctgggactacaggcacacgccaccatgcccagctaattttttaattttatttttttgtagaggcagggtctggctatgtttttgaggtcttaattccccaatgaacatgactagtatattccaggctggtcttgaactcctgtcacaaagcaattctcttgccttagcctcccaaagtgctgggatttcaggcatgagccactgcacctggcttggaccattttaaatagtgaagtcactcacacacacatacacgcatgcaggtgcacacacagacacaaaaagacacaaaaatgcgaaacttgtggcactaaaaagactgtggaaagggtgcttccttacagtatgaaaactgaaacaaaaaagcagagtgttgtttagttagacgccacctgggaacgtgcttgttgggaaactccagttgtccactgtcctgccatgtctatgatgactgcaaacatttgggagtattaatttgagggtcacaaacagattttaggtgatgggcatatttacaaatacagaatctgctagtaatgaggactgactgtataatgctttagtagtctcaagtatgttttttttctcattaagcctttgcttaagatgcaggcaagattgatgctgttggtttggtgcaaaagtaattgcagtgcttcccatttaaaagtaatggcacacactgcaattacttttgctccaacttaatacttggctttattgacttttagcatcagtgcagtttggttaatgataaaattttccaaagcagtgtctcatctgcaggagcaaactatagcaagggccctggccatcagttctcccttctggtcctgatattcctttttaaactgtctttccatacccctccctccagtgggcttggcgatgttgcattaaatagcaaagagaaggaaactcctccccagtcctcactgaccatttctttttccactcagtcctgctcagaatgtagaagagaagttgaatttaattcataaattcagcagcttgaggactgtcagttttgtcgttatttagtgaaatagtaattgaattgggctacaaggtcattggaatctgctgtttcatttcatatcattttacgtgttattattctaataagaatacaaatggagtttgatgccatttgctgatcatccatcttattgatgccattgaacagaacgcagaaacacaaagggatttataaggcatttcagttttgatgtcctttgaaaaatgaaagtcttttcagaaatgcaaaagacaaaatgacttagaattccatctcgttctgcccggtttgagggcatcccttcctattccttagatagctgttaataagagtcctgaggaaaactgggtttgaatttaaaaacaaaaaatttttaagagacagggtctcgctttgtcacccaggctggagtgcagtggcacaatcatagcccctgtaaccttgaagtcctggactcaagtgatgctcccacctcagcctccctagtagctggaactactggcacatgccatcaagtccagctttttttttttttttttctgagatggaatctcactttgtcaccgaggccgtagtgcagtggcgcgatctcggctcacagcaacctctgtctctcaagttcaagtgattgtcctgcctcagcctcctgagtagctgggactacaagcatgtgctactacgcccagctaatttttgtatttttagtagagacagggtttcaccatattggccaggctggtctggaactcctgaccttgtgatccgtccgcctcagcctctcaaagtgctgggattacaggcatgagccaccacacccagccaagtccagctaattaaaaaaaaaataaaaatcgtagagatggggtctccccgtgttgcccaagctggtgtcaaattcctgacctcaagcaatcctcccacctcggcctcccaaagctctatgattatagatgtgagctgccatgcctggccttaaatttttcaaaagcttttaaaccaatcttaaaatgttttatcctcttagaatcatgtccctagttttatagcttggaaattcttgctcttttcaaattgctctttaactctggcctgattggaaggtggcagcttttcaaatacaggtcatggcagcgctcaacctggattcctcagttgcagaagactgcttttgctagactgctgaatttacttccaacttttcagatgtttctgaggttgaccctggtgtggttcccactcaaagtggagcaagcaggtgggtggcaggtctcttcttagcggcttcctagagggaagcctcgtgagtgggatgggggacaggttgccctgggggagcccaggaatggggagacaaggccacctgctatgcagatgatatagtttggctgtgtacccacccacttctcatcttgaattgtagttcccataatccccacatgttgtgggaggaacctggtgggaggtaattgaatcatgggggcggttttccccatgctattttcataatagtgagtgagttctcatgaaagctgatggttttataaggggctttccctttcactgggcactcattcttctccttgctgctgccatgtgaagaaggacgtgtttgcttccccttcaaccatgattgtaagtttcctgaggcctccccagccctgcagaactgtgagtcaattaaacctctttcctttataaattacccaatctcaggtttgtcctaatcgcagcatgagaatggcctaatacagtaggttttcctgagtcctctctctgactcaccctctgacgggcaaaagacagtggcagcactgccagcaatcagctgggaacttctcccctgtgatagaaagcagtgcttgctggcttccctttgtgatgcttttggacagcagctctatggacctatgccttttgtcctttgaggacggacgcacagtctgtgcagctcgaggacgccgtcatgggtgagatgctgtggagtgtgatgacgccacctcttaggctgtgtgtgaaagtagcgaggagaggcagggtctgcatgagccactttggagcaggccaaaacactgtggagaagcacattacagccacagtggcggtgtaaagggtcagactgaccactggcttctggaaagtcttcatttctgaaagactgtcaggtagaagatggatgagagttactctgtgaggccggaaacctagaactcagaccattgtgtgcagaccagggagaggcagtgtttggagtgagataagcaggaattttgaaattacacagacccggttttgaatttactcatgagctgtgtggcttagagaaagctgtttaatcccactgaccttcatctgtgaagtgtccaaaaataatacagagcttgcagagttgtgtggataagggataatctatcgaaagcatgtggcaagtggcagacacaatgtgggcactaggcaagtggcaagtcccttgtattgagtcttatttgtctattcagtgaatatttggataccaactctgctgttctgggcatgatgttagccactggggagacagaaggaatgaaagagatgagtaacctaatgtgtgctgtctagtggggactgcaaataaagtgggtgttaccactagcgtgctctacagtgttatgctagagagaaatttacttcctttggccactcacttccttgtttttaaataagaactgagttaaagttgctaactgtgaagactgagtaatttgaatctgctgttggtgtactcagattacttttttttttttttttcttggagacagagtctcactctgttgctcaggctggagtgcagcggcccaatctcagctcactgcaacctctgcctcccaggctcaagcgattctcatgcctcagcctcctgagtagctgggattacagtcacgggccaccactaatttttgtatttatagtagagacagggtttgccaggctggtcttgaactcccaacctcaggtgatccgcacatcttggcctcccaaagtactgggattgcaggcataagccaccacacccagctcagattactgtttactcaaattaatggggatgattgaggatgaaacagtgcagggattccccattgttttgttttcttctttgcatttctagtgtctgtttttttttttgttggtggtggtggtgtttttgtttgtttgtttttttttttaaaaaaagatctgcagaggctattgtgtcctttgcataacccaagtccagtagcatccttgacttcaaagtctgttggcattgatggcatctgactcagtcataactatctttaatacatcattataaaatctacaatattgctcaagtgaagatattatcatgtaactgggagatattactaattaatgagtatgtggaaaattttccctagaaaatgaagtgtttgtgaaagggactgaaggatttttgcagaagagtctatgagaaagttattataaaccaaagggttatgaattctgcatatgaaacataaatagctattaaatattttatttcaatcaaaaagtgtaatgaaattagagcttctcattatgaatctgggatttatatggaaacttataaaactaaaaggtaatacattcaaaatagaagcacagatttaccaattaactggagttaaaactttttacttctctttacagtgacaggagaaaaatacatcctaaatatgttattatggtaaaaaaataatattgctagtggacagaaaaaatagtcgttaagagggtacaagttcatctgatagttgcaactaacattctaagggggttctctaagtttagtgtttgattttcttaaaaaccgatttgaaaattcatggtgcatggaactcagtgaaggctcctctgttgaagaaataactctctgaaataaaatgaacatataggccctttatcttttttaatgggatggcgtgcttaggcccatgaggatcggtttggtagaggttgatgttcttcctttatccttaatcattgatgcctctctagaaaagaaatgctcatgtcttttaggtggaaccataggatattggtgattacgtatgtcaaaaacagtcaaatatctgcagtttcatgtcattcatgctaatgaattctaaattggatgaagaccttgactcaccagatttggcaaggaataggggtccgtattttaaggacaaaaggctagaagcctgtttgcaaaactctaacaaacatttttgcttttctaagatttctgaaataatctggagtacacacaggtgaataatgtaagtgaaggaaagtgaaagggtgctataaagtaaaatgaaaagatgctgaatttcagcactaatttgaatatacctagattctagattgaaaatgaccttttccgcacaggtaaataaaatgtttccataaaggaataaacctggccgggcgtggtgactcatgcctgtaatcccagcactttgggaggcggaggcgggtggattgcgaggtcaggagatcgagaccatcctggctaacatggtgaaaccccatctctactaaaaaacaaaaaattagccaagcatggtcacaggcgcctgtagtcccagctactcaggaggctgaagcaggagaatgcagtgaacctgggaggcggagcttgcagtgagcagagattgcgccactgcactccagcctgggcaacagagcgagactccgtctcaaaaaaaaaaaaaaaaagaataaacctaattatacttcttcaacttaagatggacatttctctacctaagaatataaaattatcaaatactctagagaaagttgggtttatattcaaatagcacaatatcaacacatgtgaaggtcagtattccatagatggggatgttgatagctaatttcaaatcagtgtgttttgtttattaaagctagactgctgataggcaatatttgctagaaaataatgtaatttttaaaactttgatgtgtatttaaaataaagttttcattttagaacagtttgagatttacagaaaaattgtgaagatagcacagagctcccacatacaatgtatgcagtctactctagtattagcatcttacatcaatatggtacatttgttatgattaatgaaccaatattaacacagttattatctaaagttcatattcatttttttgccatcgtttttacctatgtgtgatgtaagtaatcattccatttcagtatacatgaattacaagatcagaattgttaacccatgccctgtgggaaagaactttatcaattagggtacagtgtgtttggacagtttcttttgtcttttgtcttacagaaatagtttgtttccaacattaattaggtcagcatcttctccccatcacctttccacatacacttaccctcagtgagactgtttcatatatttatgatacagttagattgcttggtaagatctgttccttaggctcttggctatgacagtttctcagactctccttgtttttaatgaccttgacaatttggaggagtactggtgagttattttgtagaatctccttcaattgagacttgtctgatgattttatcatgagtagactagggttaatatgtttttggaaggaagatcacagaaatgaaaagccattctcattatatcattatatcatatcaagagtaacaataatcggccgggctcggtggctcacgcctgtaatcccagcactttgggagaccaagacaggcagatcatgaggtcagatcgagaccagcatggctaacacggtgaaatcccatctctactaaaaatacaaaaaattagccaggtgtggtggcgggtgcctgtagtcccagctactcaggaggctgaggcaggagaatggtgtgaacccaggaggcggagcttgcagtgagcggagatcacaccactgcactccagcctgggtgacagagcgagactccatctcaacaacaacaaaaaaagtaccaataatctggccaggcatggtggcttatgcctataatcccagtactttgggaggctaaggcaggaggagctcttgaagccaagggttcaagaccagcctgggcaacatagagacctcacctctacaaaatttttttttcaaaaaagaatactaataatctatatgatttattgctataaatattagctttcatcacgaggctgaggagtctttttcaggtttctccactgtaaggtcacacacacccccacctcttttctatgttgtcttctttggaaagaagtcactacgtgttatccacacttgaggagtgtgctatgttccccctccttcagggtggagaatctgcataaattatttggaattctctgcataagaaatttgtgtttatttatccccctgtgtttatttattcaatcattcgtttataacagtatagactcatggatatttattttcactttgggtttgaatccagtattacttgattgttgctgacattcatccagctttggccactgggagccctttcagttgacccctgtgttcctttgatataccctcttcccctcttctttgtggtttgtgggttctttgttttttgttgttgttttgtggctcttctttatggcactgaaagatactccaggctcatcttctacatttcctgccacaatcctaaaatcaaccatctctctaaggagttctaaaccaagatgtgttctttgctactgaggtgttgcttctttttttttttttttttttttttttttcagacggagtttcattcttgttgcccaggctggagtgcaatggcgcaatctcggctcactgcaacctccgccttccaggttcaagcaattctcctgccttagcctcccgagtaactgggattacagacgtgttccatgatgcctggataattttgtatttttagtagagacggggtttctccatgttggtctggctggtcttgaactcccaacctcaggtgatccacccacctcgtcctcccaaagtgctgggattacaggcatgagccaccgcaaccagcctgaggtgttgctacttttagggcctttgactgatagagcaaagaaatatatgtgtggatactaaaccatgcatagacacatatctatatttccttctttcttttgcctttcccagaatgtcatataattagaattgtacaatatgtagccttttcagagtggcttcttccacttggcaatatgcatttaagattcgtccatgtctttttgttgcttaagaacttttcattgcttcataagaaactgacaaactggctgggatggtggcttacgcctgtaatcccagcactttgggaggccaaggtgagcagatcacttgaggtcaggagttcaggaacagcctggtcaacatggcaaaatcccatgtctactaaaaattcaaaaattagccagaagtggtggtgtatgcctgtagtcccagctactcaggaggccgagcatgagaatcacttgaacacaggaggtggaggttgcagtgagccaatgttgtgccaccgcacttcagcctgaggaacaaagcgacactccatctcaaaaaaataattaaaaaaagaaaagaaactgatgaactgtcctctaaatttgctgtaccatttttgcatttccattatcaatgaatgagagttcctgttgctctgcatcctggtcagcatttgatattatcattttctggattttagtcattatagtagtgtgtagtagtatcacattgttgttttaatttgcaattccttaataacaaatgatattgagcatctcttcttttcttttcctttattttttttttatgtttttgagacggagtctcactctgtcacccaggctggagtgcattggtgcgatctcagctcactgcagcctccacctcctgggttcaagcaattctcctgcctcagcctcccgagtagcaggaactataggcacaggtgaccacacctggctaatttttgtattttcaatagagacagggtttcagcatgttggccaggctggtctccatctcctgacttcgagatccacccactttggcctcctaaagtgctgggattataggtgtgagctaccgtacccagctgagcatcttttcttttttaaaagaaattttaattttagattcagggggtacatgtgcagatttgttacaagggtatactgtatgatgctgaggtttgggcttctataaaacctgtcacccagatagtgaacacagcactcaataggaagtttttcagtctttgttcctctccctcccactcttcccccttttggagtccccagtgtctgttgttcccatatttatgtccgtgtgtttattagctcctacttacaagtaagaacatatgatatctgattttatttctgtgctaattcacttaggataatggcctccagctgcatccatgttgctgcaaaggacacgattttggttttttaaaaatgactgcgtagtattccatggtgtaaatgtaccacattttctctatccattccaccactgatgggcccctaggttgattccatgtctttgctgagttctgtgtctttgtcaatagtgttgcaataaacatacaagtgcaggtgtctttttggtagaatgatttattttcttttgggtatatacccaataaggagattgctaggtcaaatggtaattctgtttttagttctttatgaaatctccaaactgctttccacagggactgaactaatttccaatccgaccaacagtatatgagtgttcccttttttccacagcttcgccaacttgttactttttggctttttagtaataaccattctgactggtgtgagatggtttctcattgtggttttgatttgcatttaatgatcaatgatgattagctttttttcatatgcttgttggccttacgtatgtattcttttgagaagtgtctgttgacgtcttttgcttactttttaatggggtggttttattcttgttgaattgtttaagtttcttatagatactggatattagttcttgttagaggcatagtttgcaaatattttctctcattctgtaggttgttcagcctgttgatagtatcttttgctgtgcagaagctcttcagtttaattaggttctacttgtcaatttttgcctttgttgcaattgcttttgaagacttaatcataaactctttgcctaggccaatgtctgaggggtattccctcggttttcttctaggatttttatagtgtgaggtcttacatttaagtctttaatccatcttggggtaatttttgtatatggtgataagtagagatccagtttcattcctccgcttatggctagccagtttccccagcagggagtcctttccccatggcttagtcttattgactttgttgaagatcagttggttgttgctgtgtggctttatttgtgggtttatttcttattctgttggtctatgtgtctatttttgtaccagcaccatgctattttggttactgtagccttgtagtatagtttgaagtcaggtaatatgtttgttctttttgtttaaggttactttagctattcatgctcttttgtggttccagaattttagaatactttttcttctaattctatgaaaaatgacattcacaatttgataggaatagtgttgaatctttagattgctttgggcagtatggacattttaataatattgattcttccaatccatgagcatggaatgtttttccatttgcttgtgttgtccatgatttctttcagcagtgttttatagttcccttacagagatctttcacctctttggttagatatattaatatttctgggtattttattatcgtgtgtgtgtgtggctattgttaatgaaatagcattcttcatttggctctcagcttgaatgttgttgctatatagaaatgctactgatttttgtatgttgatttcatatcctgaagccttagtgaagttgtttatcaggtctaggagccttttggcaaagtctaggtttttctaagtgtagaattgtgtatcttttcatatgtttatatgcatctgtttgtgttctttggtgaggtggttgttcagatcttttgcccatttttttaattggttttttaaaaattgaattttaagagttctttgtataactttacttatttttcacacccaaattttctaagtattttgagagaccttaaatgtgatcatcaacttcttaacttcatagattttaaaagttagttcagaataaagtttacccttcctcattaatacacttaataatgcttagttttaacaaattatatacatacacacacacacacgcatatatatatatacacacacacacacacatacacatacacacacacatacacacaatcactccttaaatgtgcaagaccgggacttgactttgagaaatttcaattcaggaaggaaaattcaatgggaggtattattatagatttaatttgatgggaaacgaggcagaaaatttcaaggacattatcccctttatattctcttcatcctttgctgattctggctttaaaagacttcagaagtcttccagagacatttatgcattttctgaaggaatggtaaaaatcctaattctgggtaactttgttttactccaaactcttggtgctaagattctgttccgtagtttctcaccaaagcattctgtccccttcagatagtcaaacatatgacaaacaaaaatacccacaccctctttcctttcctacctggtgctaattggaaagggtacctggtcagcgcatttatttcactttcagtcatgggggagtctaattatgtttgatttaaccaaataatacaaaattcctcagttcttgcttatggatttggacttcaaagcatcttgcctttacctctcagaagctgttctcacttgttttttgttttgttttgttttgtttttgagatggagtcttgctctgtcgcccaggctggagtgcagttggtgtgatctcggctcactgcaacctccacctcctgggttgaagcaattctcttgcctcagcctcccaagtaactgggattacaggcatgcgccacacgccgagctaattttttgtatttctagtagagacagggtttcaccatgttggtcaggctggtcttgaactcctgacctcaagtgatccacccgcctcggcctcccaaagtgctggggttacgggcgtgagccaccgtgcttggccatctcacttgttttgaatcaggatgcctaggtcagtgagagcctgtgtgagccaaaaacagccacgttcatctttgaaaaaacttaggccgacaaatcaagtttttaattacaggaaataatcaccaactactggagatgcaattaaaggcatttttctctgagagtagcttgtttgtcttttatatttttccccaaagctcattataaaaaatactatgttctttcatacttacagtctcaactctatcacttcctgctgtgagtatggaaatgaattttgttgaaatcaaagaaattagttaataagattttttttagcctgttagtagaagtggcttaacgtttataaagaatatttgctttgctcataatttaactgaatgagacatctgacctctgctgtctatcaaattcattaccgctttctgggacccatgaactgccttacattgtactagttgagaactgatgaaataaaaccataactcgattcatcaaactgtttagaattcaaatgttgagacatatctcacttaataacatgagggtattttgtttttctttttaaattgttcactctggcctttagtagccaccagggagacatgtgagtttggaagggcatctcaggtcaatcctaaaagcctgcagaagaactgagctggcagaatataatcctgcaggttgaaacttagccagcctttgaaattattttcatcgggaaagtactacaggattttttaaaatgacatagtagacaccctactcagaagcctactccctaatttttttttctagttactcatttgccaagatgacttgtttatttgaaagttgttgtgatggaagttggattatgtatattatgattgcttttcttcctgtgtattattttcatttgaaaatgtcaaagtatctcaccattttcctattttatagactagtaaactgagttatatgattttggtgaatttaagcttccagggctagatctccatttagctttctcttctactatttagcgcagtccatacaaagctagctgcaccagagagcattttatctgaatcctattcttgttcaccatgccttcagcaagcacattttacagagcgtccacacgccggccaatagaactgcaggtgtgagcagttccattaacctgtcctcaagccttagtgggagagatggcacagaattgctatataggatgtgaatgctcactcaagggacagagcatacaaggagaccagagaaacagaccatgggaacactagagggaacaaaaggataagaggcagtttgggtcagggaaggctgaggcttgaagagtgagttggagtttgccagacacagaagagacccttggaagcaaagagatcatggtatgtcctgtgcagagtttaatgagcacagcgtgtgtaggggacatgcttggacatgagacagctggggctgaatcaatgaagtacctggttaagatgtttggacttaatcctgtaggcactgggaagcaactaaaaggtaaatagggaagtgacatatcaaatttgcactttaggcaagtccaatgagaagggtttgagttccatcttatgaaaagctgcttctagatgccctgcaatttatacagctgccatatattaatctcctactgtgtgcctgggcatgcccatacatgtttttctttactttttacgcttttttctctactggctcttaacctgcctcatcctatgccaagtttataaacatatttcaatttaatattataaataaaataataatacaaagccattaagatgaagagattgccattgctgttgcattcagcaactgggagtccctgcaaatttgggaagagctggttcagtggagggcacgggcactggggtggtgactgattgagaggtaaggaaggggaagtgggaatatagatgctccttctggaaggtggactgtgaaaggaaggagttaaccagtgaaggctataagatgtgtgggccctacagaggcctgagaggagagaccctgaaggcatggaaacagttggtgggtggatttgcttttaataggggaaagaggaggagaaggtggaggaggagggatggaaatattttttccactgccaatgatggaagatcgcagttggggctgaattgtcctcatggaggaggaggaggaggaggaagttgtagaaggtttactgcttgccatcgaattttccaacaaagatcttccactgaaaatgagagaagaggttgatgaggaaggagactggaagagaagggacaagcttgagagagtttccgtgtgggaaggagaggggaatgttgagaaggattgtcactagggccctggcaagggtagggacctctagtaggtagtctcagtaatgaccagcaacacagtgtgggaacaggaaaggatgctgggaccccctgggattgagattgggctgtgtgggggtggtaggagggaaggtaagtggtcagaggagctgaaggctttgagaaaagtatgggcaagtgctagatcatggcacccagtctttttaatagtaggctgaaagaagatacagatggtcaaagatttggggattgtgggagccaacaggttgttatcaaaagcgaagagaatagagttgaagatttcagatgtagagcaacagttccgagtgatactaagctccaaggtatggcagttcgtgtgcagaggctaggcaagagtcctaggagataaggaggccgaaaaacctggagaccaaagaaccaggaggtcaaagaatctggaggtgccaagccttgtcctaagggccctgaaaccctcagggtgatggcaaaaattggagggaagagagagtggaagtagaactcccaaatcttcaatgaacagtgggctcattatctgcataagagtgaggattcatgggaaatgtgctccccagaagaaagcttcttacttgcattaaaaatattaagagtaactctgaaaacatgattttaatcacaatttctctcagtggattttagggttttggaaaaggccacaagtgccctaaagtagaagtctattgagataatgaaagtttactgaaaattgtatctgcaaacattacctgtcattcatctctcaggtgaggttgtatgagtgtaaaaaaaaaaaagttctttcttttttgctaactttcaccttatcacaataatgcaacaggaagagagtttcaacaaagcataatataaacagatgtctctcttttttttttttttcagacggagtcttgctctgtcacccaggctggagtgtagtggtgtgatctcggctcactgcgacctccacccccagattcaagcgattctcctgcctcagcctcccaagtagctggggttacaggtgcccaccaccatgcctggctaatttttgtaattttagtgagacagggtttcaccatgttggctaggctggtctcaaactcctgacctcaggtgctccacctgcctcggcctcccaaagtgctgggattacaggcatgatccaccgtgcctggccatgaagtctctcttaagaccttttattgtgtggggcagggggttgtttaaaatacatccagtgggaatggcaaattgtgccctcttttcaaagtttgtttttcctccatcatctatatttgagttgttctgtgtgaataagttttggaatgcttcctccttcttgttgaccacagtggttgttgacatagacagaggttgttgggataggaagagatccctgaggttgtcttgtggacaacaaagacccacgataacttttcttcccatataagcatgggctatcctagagcccagtcccctgtgggatatgaccaacaattatcttagaaaatttcactcaatcggctgggcatggtggctcacgcctgtagtcccagcactttgagaggctgaggcgggcggatcacctgaggtcaggaattccagaccagcctggccaacatggtaaaaccctgtctccactaaaaatacaaaaaagtagccaggcatggtggcaggtgcctgaaatcccagctattagggtggctgaagcaagagaatcacttgaacctgggaggcggaggttctagtgagtcaagatcgcaccattgcactccagcttgggcaacaagagtgacactccatctcagaaaaagaaaacttcactcaatcatttcacttctacctctcccagtcctctttggagcgtgaggacacttgtaaggcagtctgtggggacagtaacttataggttgtgtcctgtccggtagtgggctttcatcagaagtatgcttttggtcacactacaccatttttttataccaccatagagttgacaaacagcattcacccatttcattttgctttactactccgatgtggagaaaaaaaaaatctaaggattacatttctcttgcagattttttagatcaatagctattatttaaatacagggaatcctgaaagtctaagactaaaaaatttgggttccttttgtatatgttaaattctcccatatacacatgggtctgtaaataaaaataaataggtggcccctacccttgcagttgcatagagaaactagaccctgaaataaaatggaacaacattggaggatttttgtttagtggattaaaaattcaataatacttgaaaactttgtccagctcttcaacagagatatttggatgagttttctggcttttctaatcaggaaaggcttgttggagaattaaaggagatatgattgaggaaataaaacacaatacaagatttttctggatttattatgaataaaaagggaccccagaggattaagtggatgtagtttgcagttgaggttaagtggtcatggcagtttaccgtggacattgtttaactgatggaaaactccaaaagactgaccaaggaattgaagtagaccaatttggaccaataacttggagctcagaattaaccactgtatttctctattccaaatacccattcctcttccctggaacctcaggctggccacacaaactttcttgaaaattcttggggttctgcctttacaggaaggccatttgcctcactcatcagaagtattagaggtttattctgcacaaccatgaagaggttaaagagaagggtagggaggccatgagggttcttacattccatcttgagtcaaccatctcctgttaccctctgaaaagtggcagaatttgtcccagacttttttttgttgcacttcatatctactatggaattacatttatagctaatgcattaactctaaaaatggagaaacccattgctctgctgttttcatggtaaggaaaaactgctgagtcatgattgacatgggctgtttcaagagtttccacggaatgaaggtaaacgcttaggatatcgcagcctgagtgagaggcactgcaaagtgtggccgctacttgaagttcttcatggtgagtggagagggaatcctgagcgcatcctggattagaaaaaaaaaagaagaaaggtggcctgaaatatgatctgagtatatctggaaatacgcagacatctagtacttcacttgcagcactctgtgaaccagaaggccaatttctacatgctacaagctgcacttcaagatgcacccaaaatgcatgctcgggaagttgttttttgtttttgttttgttttgtttctgagacagactctccctctgtcgcccagccaggagtacagtggcgtaatcttggctggctgcaacctctgcctcctgggttcaagcagttattttgcctcagcctcccgagtagctgggattataggcatgtgccaccatgcccggctaattttgttgttgttgttgtttgttttgtttgtttttgtttttagtagagacaggatttcaccacattggccagcctggtcttgaactcctgacctcaagtgatctgccagcgtcggcctcccaaagtgctgggattacaggcgtgagccaccgcgcctggctgggaagtcttttttaatggcaataaccaaatgaactctcttgaccttgctgcctctgcaggcactgccccgccccggcccttccactctagaggaaagcacctggcatttagcatctttacacacaggaaacaacagatatgctcagggacttttcctctagcttgtaaccagggatggctgttgggcttggcagccgtcaggctgagagtgactcagcttaaaaggtttcattgttgatatctgccctgagcattcccctttggacttggagttccaggatgtcttgtgtctgtgcttcagcatctgaagccccttgttgcctgttcttaaggtagactgcattatcaacggtgtcttaaattaatagcttctctctactgactattcacttgtcacagctgacatgaaggttctcagtcctgagtgcctattaatgaagctcacagatagagtgcagaaaccctttgcaagatctgttttgccagcttgctggtgtcctggcatgaaggtctccgaccgacgtctttgaaatagttcctggccgggtgcggtggctcacgcctggaatcccagcactttgggaggccaaggcgggcggatcacgaggtcaggagatggagaccatcctggctaagacggggaaacaccgtctctaataaaaatagaaaaaatagccgggcgtggtggcaggcgcctgtagtcccagctactggggaggctgaggcgaatggcatgaacctgggaggcggagcttgcagtgagccgagatagcgccactgcactccagcctgggtgacagagcgagactccgtctcaaaaaaaaaaaaaaaaaaaaaaaaaagaaatagttcctttccacgtggagtggactggccaccttggggctctacatttgcctgcttggttcaggcagttctgtcccatttcatgtacatttcactcttttcccctactagcttctcacagtttaaattatcgatgtgattgcctacccagacatctaattctttcaacaggtagtggtttacagactccagtttctttatgatcatcaagacagggattgaacaactggcaccttccctgtctgtccattgaggggcatgtgtttgatgtgtgtggatgctactttcattaggcaagttaatggcagttagctacgttcacactgaggaggaaatagaccaccgtgtatgcatttagtaaacaccagcgtagtcagtggatctgtttccttaacagaacatggttctgctccactgtacacttcaaccaactgcttcagagcaagctttttccttagaaaagttttcatttaattaggatttagaaaggaacgtggaaactttaagatctccatttagtcttctgcatacttcagagacttctgatgtctcctacagggacaggaaaggagtcaggggtctgaaactctaggacctgaaaggcaagtgcaattcggtcactgtccacattgccagggtgtcaaatcacacataccctgcctgaaagtctgggaattggagaatttaaaatgacaatattttctactgtggaataccttgcattctcccactctgtaaactactattctggaggcggcccctctcactatatttcaaaaccagatgcttttctctggaaatactagaaatgtctctcttctgggctgacctaaaaccaacatagtattgggcattgaagtaaggagaaatatggtcagtgaggctaagacctcctcttctgagaatgaaaaatgactgagtattttgtgttaggtgggacactatttgttaatagagaacttatatcttaagtctcttaaaataattatagcatctcttagttatttccagcataatccaggagtgagcattccaagaacatcatcttacaacttttaattaatatatctttctctaacccttaaagaaatgctggtaactgcttgtcagatgaggaaaagatggatcattattcaagtaagatccaatatgggaaactcagatataaatagttcagcattttcgtttcttatcaaagatttatgactgtgtctactttaggatttatttcttctggactatttcaggagccccttcactggtctttcagcctcaatttcctttcctccgcccctttgtttgtttctcccactgctctgaggacagttgtcataaagctcagttctagacttcttgatttgtgtcccgggtgcttccccagttgttctcaggccaatttctcaggcccctgtttcaccattttatccacacctccaacaggcattccctcctggtggaacttctccctcttcatctgagggtgaagggtctctttgttgacactggtccctctgccgggcatcctctcccttctatacctccctattgctaccaatccttccttcactaagaaatcaacctaaatgccaccttcttcatcccagacatgctaccactcctgagccaggagtaattaattctttgacctgttgtatcgctcttatggcacatggctcttctgtttgatttggaaaaacgtatatctccttatgcaaattgtaagttctttgaaggcagggtccatgtttaattattttattctttaatgtgccttagtacttaaaatgtcctctgctggccagcagtaagggtgtcacctgtgagcttgctcaaaaagcagactgtcagcccccatctcagatatgtgggatcagaattcacattttttttcttttttctttttggagacaggggcccactctgttgcccaggctggagtgcagtggcacaatcattgctcactgcagccttgacctcctgggctcaagcgatcttctcccctcagcctcctgaatagttggccttacaggtgcacatcatcaaacccagttaatttttaagtttttttgtagagaggtgtctccatgttgccaaggctggttggtctcaaactcctggcctctcaagcagtcctcccgcctaggctttccaaagtgctggaattacaggagtgaatcactatgcccggccaggatccacattttaacaaggggtctccaggtgattccaatgcagctgagttgggagttctggctttgtacattgcacagaaccttgtataaagcagagactccctggatagctattgaacaactaatgaataaatcacattaaaagctgagtttcttctcattgacttagagggaggttacctcataattactcaaacatagaaaacgtaacccaacatgtaccattttcctatgaccattttgagtcttaaaaacgtggaaacccttttcttcttttaaaatcttggatttgttatttcagatcacctttgatagtttttctttctttcattttttgtgtaccctcactgggtagtgtttggccttcgcgaagaaggatagagagaaagcttgctaattggggctaaatacagattatgtgcaaaaaaagaaattgctagcatctaaaaataagcactctacacgtgtatagttttataatcttatcagctgtgatcttcaggaccaagtacgtggcaactacaggaggatggtctctgtcgctgtcaaaagctgagtattccaactctcacttacttgataccaaccacagaaggacatgagactgtaatacactgggattttcaaaatgcaaaagaatttgatattaaaggcttgttagctgtctaggaataaaacaagaatggggagaaacatataaagtaaggaagattatctctctacagctaaaaccaggcaaaaggaccacccactatggcatattgtgaaaattttgggggctacttttgtttgtcacaataattggagcagttggttgaagggtacaatgcagcagggccatgttctgttaaggaaacagatccactgactacatttgtgtttaataattgcatgcttagtggtctgtttctcctcagtgtgacgtaagtaactaccatgagtttgcctaatggaagtagcatccacacacatccagcacatgccccttgatggacagacagggaaggtgccagttgctcagtccccatctcaatgatcataaagaaactggagtctttagactgggtgcagtgtctcatgcctgtaatcccagcactttgggaggccaaggcaggcggatcacctgaggtcaggtcaggagttcaagatcatactggccaagatggtaaaaccccatctctactaaaaatataaaaattagctgggtgtagtggcccatgcctgtaatccaagctactcaggaggctgaggcaggagaatcacttgaagctgggaggtggaggttgcagtgagctgagatcatgccactgcattccagcctgggcaacagaacaagactctgtctcaaaaaataaaaaatttaaaaatttaaagaaagaaactggagtctttaaatgactgcctgttaaaagaagcagatgtctgagtagacaatcacatcaaggattttaactgagagaagctagtaggggaacaaagtgaaaggtacatgaaataggacaaaggccagggatactagataccttgcaaggcataggatagtctcatactgtgaagaattgtcacttgaggccgtgactttagaacatctggcctgacattttggtggtgaaaaagtgtttttattaatagactctaaaaatatttttatataaacaaaaattaaatatatgctaaatttttcaggaatgcaattaccatttcaattgagaggatactgtcctttgttttgtttagaactttactatacagtaatgtctctgctcatatcagtctgcatgtgtaactattgaattcacactgattctacttagaggtagctcctgatgtcattgtacctgagcatttgtatattgaaatgttccttatttgtttagaaattttttttttctcatttatataataggatattgtattgatttttttaaatctatgtgactaagcaagttttaaaataagtatatctcaggatataaaaagaggccttgggtctgatgggtttgagaattactggcatggacagcctcattagttcctgtcttaagacagaggataataaaagttaaaggctcagacttaatcaaagggttagaaataggagtagcgagccgggcgcagtggctcacgtctatcattccagcactttgggaggccgaagtgggcggatcacctgaggtcaggagtttgagaccagcctggtcaacatggcaaaacctcttctctactaaatatacaaaaattagccgggcatggtagtacctgcttatagtctcagctactcaggaggctgaggcaggagaatcacttgaacttggaaggcggaggccatggtgagccaagatcgcaccactgcactccagcctgggcgacagaggaagactccatctcaaaaagaaaaaataaataaataaaataaaataaatagtaagagcatatcccacaggaaaagaagctgagagacaatcttggagggaattcatgtatggggcaacttgtcagaatgaacagagcttgggctcaggaattaatgcactgagtttggtgctcttctcttcaactttcagaattcaactatcctgaattctggcttctgggggtcccggcagggtcagaatgaatattagagataatgaccttaaaacacctagcacagagttgcaaaaaatgttacaaattgtaaatactgtatataataacgctaatgtcatctggctcttcaaaatggaaaatgatgaagctatcttactggcttttagagaagttgaccgagttttctacaattgctcatggctagattttggggccaggctctaaaatccaggttctttagattattttgagcctaacaaccaacttaggtttgacctgacttgaatcactctcttcctctaaaattccctgtactcttggctttgtccatacagaacctgtacatcaaattacaccaaatatcacaatcctgtagctttctcatggcaacgtaagtgcctttgatatgtgagttttttcctttttttctggaaacagggtcttgctctgttgcccaggctctgatcgtagctcactgcagccttgacctccctggctcaaacagtcctcccacctcagcctcccaagtagctgagaccataggtgtgcaccaccacgcctggctaattttttaatttttttgtagagacagaatctccctatgttgctcaggctggtttgaaactcctgagttaatgtgatcttctcaccttggcctcccaaagtactgggattacaggcatgagccactgactcaatctagttttttccttttcagtagtcacttttacgcttatgagtaaactacaattttatgaagcctgtggatgctggagtgatacttacagccctggtgtgtcctctgtgggttcagcctgccctgtgaactaatgaaatttaaccagtgtggtgcctccctcccatttagacttctctctctgaccaaactgcctctgttttccttccctttagacccccagaagctgtgcatgctccatgtccagcaataacttttctcctagattctttactgcttgttcgattccagatgcaagagatatagcttcacccgtgcttcctatcttcctgtgatttctctgctaccgcagagggtagtcaccaacctttagctcaaacactgatgccgaggctacgtacagagagatgctttaccagttactcaccttcctcactgggcatctgcagagactcctagagaaatgtttgtaagacaacatgagttataaattttgcattcaaaatcttttaaattggtaacaaaatgaatccctgtcccacagtgtgaagagatcactgcttagtcagtttccttttgggagaattatttccaatttttttaagttaaatgctagttattagaaaagtgaccacatggccacctgagtctgttcagatcttttggaccattttccttctcctcttctgcacacctcgatttgcttgtcacaggtgttccagagattccttctgttcttgtctttggcaggatcatcttgaattgagtagtataaatatatcctgcctctgtttctactatgaaagcccctctctctgcatttcctgcatggtttccttacgctgttctgtgcattttgggtggcgtctgcattcttttattatttttttgagatggagtctcattgtatcacccaagctggagtgcagtggcacgatctcgactcactacagcctccacctcctgggttcaagcaattctcctgcctcagcctcctgagtagctgggactagaggcatgcaccaccacacctggctaattttgtatttttagtagagatggggtttcaccatgttggccaggctggtctcaaacccctcacctgaagtgaattcgcctgtttgtttgtttattgagacaagagtctcactctgttgcccaggctggagtgcagtggtgttatcttggctcactgcaacctctgccttccgggttcaagcaattctcatgcctctgccttccgaatagctgggattacaggcaccagccaccacgcccggctgatttttgtatttttagtaggcacagggtttcaccatgttggccaagcctgtcttgaactcctgacctcaagtgatccacccgcctcagcctcccaaagtgctgggattacaggtgtgagcccccgcaactggccaggtctgcattcctaatgctacttttgagcccggcaatctcagacaataaaattcagtgcagctggggcagataagtgcccccctgctctcacatttctctttagtcttggcatcttcaagttagaaccaggtcattatttttgtatcaatgacatttcattatgccataaatactgaggtgttaaaaacaccaaaaaagccctaaaaatgcctagaaaattatccgaagcatttactattaaggctgataaactttttcttctcttttcaaatataaattgattataaagcatattgagtgacttcaagctgaaggttttcagtatctggaaaactgaaatttaattgcagccttcatgtcaccacagtgccaggtgcagcatagtgctcagggccccacgcaccttctaacttccattcccaaacaggtcttccctcctctccattccccaaaccccaaccatctccacctgctgacactgtagcttcatccccagatcacttcagctgaaagtggttttcctttttctggattccaagaaggactttgcttgcaaaaaatgtttatttacttatttttttttaaaggcaacagaagttccacaattaatcttttcttgtaagtagactttattttttagaacgggttggccaggcgcagtggctcatgcctaaaatcccagcactttgggaggctgaggcaggcagatcacctgaggtcaggagttcgagaccagcctggtcaatgtggtgaaaccctgtatctacgaaaaatacaaaaattagctgagcgtggtggcgcccgcctataatcccagctacttgggaggctgaggcaggagaatcacttgaaccggggaggcggaggctgcagtgagccgagatcacgccactgcacttcagcctgggcgacagattaagactccatctcaaagaaaagaaaagactgagagacagcaaacgagacatagggtttatcaggggaacttacttacagggatggtccagtggtggcaggttggacaggagaaccactaccatttgtaaaaagcatacagtttatatagcattttcacttagcaccctccacctagcaacctccatttaacccaaaacaaagggacttgatcccctgtatgacctgcatttcaagagacaggccaggggtttggatgtccatcatgggtaaggagtgaatccctgggttggccactcctggattccttagctcagaactctgaatgcacattcttcttgatcatagtgtcattctcagggcatgcctaggttaagttattgctgtcaggtgcatctctatacacttcctaatgtgttgctcttttatgagtgaattacctttaatttggccttatgttttctatgtctatgttgtgcttctcttttattcttatttattcagtgtatatttcttaagggcatattaggcactgctgtgtaggtctggaaaaacagggaacacacaaagtacctgccttattagtgccaggatttcagagaaaacaggcaggtgacagacaaaccaatagatggcatgcagtataagtgctatgaaaaaaaaataagacagtgtaagggaaatcgacacaggagaccttaaagagaaggccttctggatgaaaggacactttgagcagacaccagggagcagtgagggaggaggtggccatgtggatatctgtctagtggaagagcccagaaggcagaggaaacaacacaagttagacagttaagaccaaggccttaggtggggtggcaggatggctacatgggactgagggaccatatgggggtgggacatagtcaaggtcaaggtcatgtagggtcttaacaggctgtagtaaaggcttgaatttttactctgagtaagagggaaaatcattggctttttatttttctagaaatagggtcttgctctgtcacccaggctggagtgcagtggctcaatcatagttcactgcagccgcaaactcctgggctccagcgatcctcccatctcagccttcctagtagctgggactgcaggtgcacaccaccaagcccagttaatttttaaattttttttttagagacaggatcttgctgtgatgcccaggctggtttcaaactcctggcctcaagcgatcctcctgcctcgatctccctaagtgctaggattacaggcatgagccaccacacctggcctccattggagggttttaaagacttatatacttagttaaagcagtctgtagggggataaggcaagcctggaagcagggagacccgtgaggaggctcctggacaacgtagggacaacaggccatgactagggtggtggccatgagaggtgagaattaatcagatcccagttcacagagttgatgggatttactactggtctgactgggaaggactgtaaagaaaagcagggagtcaagaatgattagaaacaaggtttgtgccctcggcaactggaggaggattcctgatgtcatttacagagaatggggaggggatctgaggtgggattaagcttgaggaacaaactcaagttgggttttggacagactacattcgaagttcctgttggacgttgaaggctgttggctgtgagtctgccttccaaatccctgagtccttgaattcaaggtcgtgtgttggccgtctttgtattaggacatctaactcttgtgtttgacttaatgggattcaaatttgcacgtgtgtggttttctgaatgtggcctacagtttcacttggatcttcatattctttttcatcataatctgtaaaagcagaaaaaaagaccattggaaagaaatgctgtatgaaactttctgaaaatggatagaaccagaaatgatgctgacaggagttttagaaatgaaaaatagagagtattcagaccaaatataagtaaattagcataaatcagcattctctgatttccacgcctacttacccaagttggttgactcaacagctgctaagactacagctgtgtgaatcctccacatttttttttttttttgcatggaaaagtgtttcagtttgtcattgcttcatcatttcgaattccatattaggttacctttttttttttttttttgcctgaccatagtacttaagaaaaatcttgcaactgtccttcattctgttgaaccaactatatcttatgttttcacttgacattttgttttagatctacttggggctttatttaaatttttttaacatttaaaaaaatttttttacttaaataatgaggcagtgtctcattattatccaggctggactgcatggggcattcatagttcctgggctcaagcaatcttcctgtctcagcctccaaagtaactaggactaacagcatgtaccaccacatccaactagtttttttcatttttttatagggacggggtctcgttatgttgcccaggctggtcttgaactcctggcctcaagtgctcctcctacctttaagtgctgagattacaggcatgagccaccagacctgaccttggggttttattatttgccttcgagccccttcagacagttcttcttggaggtttggggaaggcttctgtaaagaaaacttccttacacctgtttgatgatggtaaaaggtccaggtggagaaagacttcctaggcagaaggaaaaggaagtgcaaagctatgtagcctctacaagagcacatgtgtagtttagggtggctgcataggacctgggaagagagctgggtgatgcagggcagatgactggcaggtaatgaaggtacttatgggctatgctaaggagtatggaaaatggggagtattcaaaatttagagcccagggtacagtgatgggattgcattttttgacaaagctactttgactgccatgtaaagaacaaatgggaggtgagggagcctgattagaaggtccttgatgatgcaggcaaaagatgatgaaggtctcaaagttctttgagccttgactggaacacatttagtgtgacgtgtgtttataacataaaattaaatacgaaagcagaaacattggtgatggagaggagagcacaaaattggggagatattgtagccaggttgaaagcttgtactgctcactgcacaacagccagtaagtcaagagacaaggagttagagtaaggaagatgactttatttggagagccagcaaaccaagaagatggtggactggtgtcctaaagaaccatcttaaaagacatgaatctcaagcttctttttatatttgggaaaggggaacaaggagagggttgaggtgacaggtgaccacagacatctgagcattagcaggcgtccgagggtgttacattgaatattgcattgttacttgtgtctatgccctttttatttcctcagtggttagttttgggaagggactattatcatccttgctttaaactgtaaactaaatcccccccatggttatcttggcttatgtgtgggaatgagcaaagatagtcagcttgagcggttagaagcaagatggagttagttagctacgttatgtttctgtaactgttacgtcttacttgtaggattacaacatctacttggatgaatggtgatgtcattctagcatgaggagcaggtgggattaggttgaggttgaatgggaccatagttctgtcaggacgtgtcatctttgtggagcccaggggtcatccattaagcagctgggaatacagttctggggctcagcagagacctcagcctggaagaacatgtttagaagtcatcaacatctcattaggaaagagaaagagatcgcccaggagaggaaatagagcaaggagagaaaatggtcaacaagggaaaccatgctgggattgagtctctgtggtaccaatggtcttactattgacgtcagagttaaaaaagaagagagttatattcaaattctggttgagttagtctcttattaacatttcctgactcaccaactggtaaatgtccaagaaaaatatatctttttgttttatcagaaaatatacatgctatttgatcactcttcaggcattaacaaatggtgtctatgagaacattttaacaaaatgtcctttctactgttaatacccacagcaaccaacttggaaatcagtcatcatagaagatgactgcaggttctggctttcccaaatcaccaataattcacacctttgtacatggttctgtgcatgatctgttcctaatattatgcaacacttgtgaaatctttaggactttaagtaattcatcgttttgccccaaacctagacactactataagaaacccaacaggctactcttaccagcaataggggttcctgaacaatatcacggaacaatgagaaatcctgcactcatgaattctctttacaaccccaggtgctcaagcatggtttttaagggtgactccctggccacctggtaagtctgagtgacttgcgggcagctgtctttctggagcgggagttattctctgaagccatagaaagtgtcagggaaggctggatacacatcacgtatgtgcatgagaagtaatactttcaacagcagcagcatcttccaagtgataaaaataactcagctttagtcagtagcccagaagccaagtgtcccctttcactgcttgttctctgttggtattcttcaaagggacatcgtgtctttcacagtttggaatgtgatgtttctgttctcactgacataactgtcttagtatctgctcctcctcttgtcatatatttggaaggtcttcacctcttgatcacttgcattttacattctacttgtctattgttcattcacacggcaagaaatgacggctacctgccgggcattagttagcaaagctgcttatactctgatttctattgttctcccagtttttagactgtagccgtttaattacaatgcagcagctttcacgtcagtatttctcctgaaggtcttagtttattttattcctccatcacagaaggttccttgaggtcctgtattctgaaaatagatgcatttcttccaaaatactggatagcttttagatttttcaaagttcttggcaagtctacttttggaaaccttgactgacttgcgaatatgatttctccttttttcttagctccgggttgagctccttctcaagagctcttatgttataaagcttgtgttcatgagcagagaaggactgatagtgggtgttattaatcattgaaagatgtggctgtgactgctattatttcctgtgttaagcttcccaccagcaaacctggccaagtgctttggcgctgtggaaacagccttcgtgtacacacttcttgacccttcactcccttcatgcccttcttcccatcaagacttaatgattggctgggcatggtagctcatgcttataatcccagcgctttgggaggtcaaagtggaaggatcacttgaatccaggagtttgagaccagcctggaccacataatgagaccccatctctccaaaaaaaaaaaaaaaaatattagccaggcatagtggcaacatgcctgtagtcccagctacatgagaggctgaggctggaggattgcttgagcgtaagaggtcggggctacattgagccgtgattgtgctactgcacttagccttggtgacagagtgagaccttgtctcaaaaaaaagaaaagaactggaaaagaaaaaagaatggtgttcatctccacccagcatgctagagcaggcatgccattcattgtggaggcaaaactcccgcatagctgccaaaataactgctgagtgctttgcgatggagagaaacaaaggaatgttgggtcactgcccgagtcatggggtctctgcctgagccatagaaagcttttgatttctggagccacattgaatgaactgattatgtttaaaattataaaagaaaaatatagcctaagataattgagtgcaataaaccaatttaacttatttgttcttacgtgtaacaattgttgagtaggtaccatggtacccactctattgctaagctgtggaaggagccttgctttggaattctctcagctcctctttcccatcatttccttagctgtgtcccttttcagcctcctgtgctaactgatagcacatgtgtttcagaatggaacctggaaaaggaatgtgtgcagccctcgtaaggatataccgttccacattccatatgctgttagataatatgctggctagaccgtcaacagttaccccaggaagggggaatttggattggaaagaaatcaaaggaattggaggtaacataatggactgcagttaaacagtaatagggtggtctggacaactggacgaaggccagtttctaaattgcaggcaatcccctctgcccttttagaacaaggcaaggtccactgaatggagaagaaggcaggccatcagccttcttagggtttaattcagacacgggctctgagctttgtcttttgttctctttaaaggaacaaagccattgaatccagccagaaaaacctgtgcgtatccatcataaacatccacaaactcttctttaatctcccttgttattctccctaagaagtaaggctccaacataagttcttggttgcatctgacaagtgtcagctgatgtccatgaccccttcgtttcctgtgtcccttctacttgatgcaatgactggcataacgtatttgttggaatgaatgaatgaatggcattggtggctgggcacagtggctcatgcctctaatcccagcactttgggagtccgaggtggctagatcagttgaggtgaggagtttgagaccagcctggccaacatggtgaaatgctgtctctactaaaatttcaaaaattagctaggcatggtggctaatgcctgtaatcccagctacttgggaggctgaggtcggaggatcacttgaacccaggaggcggaggttgcagtgagctgagatcacaccactgcactgcagcctgggtgacagagcaagactctgtcaaaaaaaaaaaaaaaaaaaggaaggaaggaagggagggagggagggagggaaggagggagagagagaggaagggtgagtgagtggaagaaaacaatgaaatccagttctgagggtaaggagcatgccatcaatatgatgggggatgtgatatggtatgaggatggggtctttcaaactgtattgtgtagaccagtagaccatgacaaataggcgcgcgcacgcgcgcgcgcacacacacacacacacacacacacacacgggcttccatgttcttacaaatgttgcacactatatctgactgtgggatcacagtgtacgtttgtataccaaagtctctgtaaagacctgcaatgaagtgaacccctttaacctttcttttactcagtgttcccctattgtatttgactgtggaaccctctgcgtcatacccttttacatcccagaacccaccgaacacagtttcttcaacattggcagaaatttacaaaatcatcgtagtcttgagtccagctgacctgagtgtgaatcaaggtttaccacatagtgtgtgatcctgagccaaattaagtaacctctggttccctccttcctcatctatatgatgaggataatgtgcatctcctaaaaggagagaatgaaggcagttaatgcaggtaatccatcttgcgtgcacccagcacagggtggctcttccctggttaatttccaccctgatgtgtagaatttccctgcaacactctgctaccacaaagaggggcttcttaggatataacctattgtccttaaactttatgagcagtgcaataattgttatttgcacctgtaaaatgtgaataactggtctttctttttaaaatactttcccaaaggaaaattatggcaaagagatcatgtcctaactagtttctcacgtgttggtgctatcacctcctgagttttggcaacgttatttctctgctttttttcttgactcccctctagttcttctaaattagatattaagcaggagaagtatttttaatatcctggaaatgtgttttattaatctaccaaacaaatggctgtccaacaactccatgaaacaggaagaacggccactagcattcattttgcttttaccaggcaccaggtagcgctgtaaactctttatgtgtgtaattcatttcatcttcacaacaactcgatgaggtaagtgctattatctgcagtttgcagagaaggaaaccgaagctggtggagtaacatgcctaaggccaccctgccaggataagatgaatgaccacgactctgagtgactaaagccttaggaacaaagatgagttgaaaatgggagagccacctggggtagaaccccagagtttttattttcttgcaaagttttagtaaaactttctcagttttcaggaaacaaaagttatatattttagagtttgaaatcacaaattacacaccactcccccatctctagcctctacatttttaagcaagatcaacagaacccagtggagttccatggagttcagggaccttgctccaggtgtgcctctaacactcagtcccttttccaaggcagggcacatataattgaatataggctgggtgtggtgtctcatgcctgtaatcccagcactttaggtggccgaggcacgtggatcacttgagcccaggagttggagaccagcctgggcaacttggtgaaaacccatctctacaaaaaatgcaacaattagccaagtgtggtggtgcacacctgtagtcctagctatttgagaggctgaggttggaggatcacgtgagcctgaagaggttgaggttgcagtgagccaagattgtaccactgcactccaacctgggcaagagagtgagaccctgtctcaaacaaaacaaaacaaagcaaaaaaatgaagattgccaaatatttaaatgtcagttactattaatttaaatgtccatcagggttctccttgaagtcaaaactgctgttttccccaatgccagaactcctaacagtggaccccaggccgtaggaggtgatctagaattgcccctgaattaaaggctttgtgttctgcacacgtgatgcaacctcaggatcggacatgtgttagttcccagcctgtgtcctgtgacaccttggagaacaatcgagactggttgatatttggagggttaagcaaaggacctttcttttgccagctactctgccgtggttgaagtgtcttgagggtggtgaacgggtcctcgctgggcttgtctctgagctgcacacattgacttgacacaggagtcaagtagtaagtattggttgaaggaatcagcgatgtttggctacccattgtgtgctctctaatatttgctagggatatggtgataagggaggaaaaagacccaaggagtaatgaccgagcagctatgtaagtgaatcaatgatgtgaccacattgctttttcttagccgatagttacagctctatgcaactttttctacttattgctggaggtaatcacattccaaccctgaggactgctcccatgctgggcggtactgcagtgacctctgcatttgagctggggtttcttgtatctcacgagggtcaggggcctgtgggaactttttgtcatctggggggacaaaggctttcttgggaaaaaaaagtctcctttttatcctctgcgggtgaaaaagaagtgccgttagaataggaaggggcttcttgtaggcttgaaaagagaaggacttggcaggtggcacctgggctttgttcagcagaactgagagggcaagagtatagctggcttttttgtaagactcatgaactctgtggcccattgatgagatgctctctgctctacaaagtggactttcctcgaggtggaattttattttcctccctgtgctggtgttagattctctggatacataaggtgacccgaggagaagcaggcaatgtcatcacagtttatttgtaggatctgggcttcctccttcagaggaggtgccactcacacccgagatgcctgctctctccctgagcctttcagcacaagggcaggacggagaggagcccagctaacgaggggccagctcaaagtcattcaggaaaaacagatatacacagacatggccggaagcctcaatgtgtttttctactgcaggaaggttaaagtggaacttcatgtcatagatttaaaaaaaaaaaaaaaaaaggctggggccaggcacagtggctcacgcctataatcccagcactttgggaggccaaggcggccgaatcacctgaggtcaggagttcgagatcagcctgggcaagatggtaaaacctcgtctctacgaaaagaaatacaaaaattagctgggcgtggtggcgcatgcctgtaatcccagctgctcgggaggctgaggcaggagaattccttgaacctgggaagcggaggttgcagtgagccaggattgtgccactgcactccagcctggtgacagaatgagactccatttcaaaaccaaacaaaaaaaaggtgggcatggcggctcatgtctgtaatcccaacattttgggaggatgagagggaggattgcttgagtccaggagttcgagaccagcctgggcaatatagtgggaccccatctctacaaaaaaataaaaattagctgggtgtgatggtgcagacctgtggtcccagctactcaggaggctgaggtgggaggatcacttgagactgaggaggtctgggctgcagggagccttgattgtgccactgcaatccagcctaggtgacagcgcacatccttgtctcaaacaaacaaaaccctacatatcttaagaggtattggaaggccttaatacatgccaagcacataggactcaatgagcaattctgtctcaaaaataaataaataatagatatttaagaatacactactattaagaacctcagatatggaagttcatgaaagatacttttatttaataagacatgaagggaaatttagcgtcactgatggtatccttctctctcctcaccgcgatctcttccagttaactgctgaatgcaaatcaacagtagagcgggacgtattttgcagttcagttattgatttttagggagcctgggtgggtacccttatctgtgtctctttgaggacaatgacaggagccctcattgccaacagagataacagtgagattgtatttttatttgttccacaaacactgacgtgacaaagtgctcttactggtaggcttgaggagagtagcctggcgattaaatgttcttatttcgagtgagcagccgggctgtgttcagaagagcccattagcagagcacgggacccatcaacagtccaattaagagcaaagggatgtgactgcggaaatattaatgggctgtgttggtaaagctgcccggggttagcgccagatggagtttttctgtatacagtttgtaggaaactcttgtgtattttcacgcgggatgtccttctgcagagggggatggttttagataatgactgttgtgctttttggggataccacctgcagagatgtgtttattttgagtgtttatagattgcagaaagctggtgaaaccaccttgagagaggtgatcctttgattgaatgtttttttcatccaacaccaaaaaattacaggccatgattggattttggagctgattcttgctttgtaagactgcatggttttggtgaacatccatctggttgttttttttttttttttttttgagtctcactctgtcacccaggctggagtgcagtggtgcaatctcggctcactgcaacttccacctcccgggctcaagtgattctcctgcctcagcctcccgagtagctgggattaccagtgcccaccaccgcgcccagctaatttttgtatttttagtagagatggggtttctctatgttggtcaggttggtcttgaactcctgactgaacatccttcttgaatgatgaagtcaaccttatttacccttgaaagatgacttaatccttaccaagagagcttcaaaaatacctgttattctgtaccttcgtttaaaaaataagtcctattgccttaactcctgtccaatgcctactgtagctctgtttacatattacaaaataaatagaaccaaccacatgtctttgaagtaccagccctgttagtccatggtaagatttctgcctaaaatttaagcatcttgacaacatgcgggagacttaggggcagagaaggaccatttctcagaagaataacccctcagctcagcacagttgtgtcatctgtccaaggtagcactttagcagtttcctaaatgagggagggtattcatgtgtgtatgcatgtatggtgtctgtgtgtgcacacgtgtacatgtgctcacgcatgttataactgtagaaaacaggcaggggagcctgtgatttgccttgtgtttctataaacccccctacagctttaactaatttccatggttgttgatggaggttcagatgtgaaatctaatggtatctgtgatctgcaaaatatacatattggccgggtgcagtggctcacgcctgtaatcccagcactttgggaggccgaggcaggaggatcatgattgtcaggagattgagaccatcctggctaacacagtgaaaccccatctctactaaaaatacaaaaaaaatcagccgggcgtggtggcaggcccctgtagtcccagctactcaggaggctgaggcaggagaatggcgtgaacccaggaggcagagcttgcagtgaactgagatagcgccgctgcactccagcctgggcgacagagcgagactgtctcgaaaaaaaaataataataataaaataataaaataaacccattgttcatctaagaacctacccatgtctttcgggaggctttccatcttatcttgtcttggttcagacagtcttccatgggacccactgataccctggagcatctctggaaggttgaagcggaggacagaggaggcatggaaaaggtgtgcagtaatacataggaagcttccaaagagaagtgggtgcaagacagcacagaaacatgttcagttgcctcagctgctgatgttcaaaatacctgcagaaaatcaacgctgctacacccaaaagaaaaggaagatggaactgggggcctagagtgaattttttcaaaggtaaaaaggagcccaaatttcacagaatgatctcccgcttcagaaagggaaaccctctaagtacactatacacttccctgcctgttttctggagagtgataccgagtgttggcactgtctgcaaggaaggaagtaggactttgactaattgcacaaacagcaattttgtgtttttgaagtgcgaggactcagtcctgtgtccacgaagcctccttcaggaggttacttcttgacatagcccatcaaccggacctcccgttgctaggttctgagccttagggtgctttcaaatgcaatatctaggccaggagtggtggcccacacctgtaatcccagcactttgggaggctgaggcaagaggatggcttgaggcaggaggatcgaagtcaaggctgccgcgagctgtgatcgtgccactgcatgctagcctaggcaacagagcaagaccttgtttcaaaacaaaacaagaaaaaaaaaatatgtgcagaatccactaatggaagtcatcataaatttgttgccagaatgggaatgtatcagtttatacttcctacattttgttttttgtgatgactttaactttggatcattttatcagtgactggatgaaagtttatctttattttatctaatggggggggggaatccaaggagctttttaaagacagccagtataattgattataaagggtagttccctgctaagctgaaaatgctgtcttcgaacactttaggcatctgtttctacctaagagatgcattgtggagcccagtctatagcacctgccactggtcttcaatgtgttcagtatgtatcctgataatatatgaaacatcagggtccgctcacctgcttcaggtgctgtgtgtactccaacaggtattctacaatccgagctgttcatcagttgttaaattactgtgatttgagtcccttcaaagtgagatccattggcagcaggaactgttatatagtattatgtgtgtgtttaagggcagagggatggtgttatctaactgtcctgtcccagtttgcaggcatggaaggagttcctaggatgtgtgactttcaattttaaaactgagaaaggcctggacaaaccaggatgagttgtcaacctgcatgggggcaatggatttggccatgaacttcatcatttcaaagtattaagttgttggcattctgaatgcccctgaacctattttgcatcgtagagtggacttgttccccagtgacccatgtccacccctagtggactcgatcaactcctgacacacccctactaggaacacgaaaatggttgtagaatgtgtttcattgtcctcatccacagatacagacactttggtgactctgtgttctatctgaatgggggctgagactacaggataccccatcccatttctgtcctctgtccttcatccaaggtgtcaccatttgtatctatcaggaaggaggctttgcagctaaaatttaaaataataagaagaatatatttccgagccagagattagatgcctacatatctcttttggcctcagcattctgtggtcttctatggagaaaggctaattttctgaaggctttgaatggaatgaaaactgcctgttcaaatggttctgaggatactgagagacgctcagtgtgtggtctttttatttttagtaatagtgttggaaaaaatcaggttatgtttacgctgagtgtgtggggggcgctggtgagattgtgtagtctagaaaaggctagaattataaattattataaacgttggccatgtggggaaattcttataccaaaaatactgcaatgtatgtcagcctatagattttcatgtagtttcttgtccaaaactgtatatgagagcagaaatgattgattatgttatgttcaatgtatacctaatatctagtgctgatacataaataaacccatcatttgtgacaagggtcttttgtccgcatttaattttattttgttactttttatttatttatttatttttcagccagggtcctgctatgtcgcccaggctggtctcaaatttccggactcaagcgattcccccacctcagcctcctgagtagctgggactggaggtgtgcaccaccacacccagcttaattttatttttatggccaaatatgacacaggtgaaagccattacccagaccttcaaaggagtgtcacgatggggttggcaatgaggacaaggggtgatgaggaaaatacattgctggaaatcaagttgataataggtttggtggaagatctaagaaatgtagtgtggaacctctgaggtagggaaactgggaattcttttctttagaatatacatgtatattggcatgtatgtagaatatgcatgtctggaactccagaatacaatctgggctgcagccatcagtgtacaggttaaaggttcttaggctttctctgttcacggcattcctgtagactaaaagaaacagctaacagctccgtttattaagtagtaaagcccaaacaacttagtaattatttatgacctaacaatttagtggccaattgaaaatacaatcacatcaattcaaaagaaaagatgtattttttcatttttaggtgatggctggttttatgcatcaacgtgcgtagggcatggggcctagatatttggtcaaacccctgactgggtattgctgtgaaggtttgttttttagatgagattaacatttaaataggtaagttttctgggtgcagtggctcatgcctgcaatcccagcactttgggaagcggaggcaggaagatcacttgaggctaggagtttgagaccaccctgggcaatatagcagaacctgtctctaaataattagatagataattagatagagatagattagattagagaggtaggtaggtaggtagatgatagatagatggatagatagatagatggatagatggatgtatagatagatgaataggtaggtagatagatagatagacagatagacagacagacagactgattgagtaaagcagattatcttctatactgtggaaggcctcattcaataagttgaaggccacaagagaaaacagactgaaacaggctgaggtttccttgaggaggagggaattctgcctctagactgtccttgaacttgagctgcagcatcaactctaccttaggtctccatcctgctgaccttcccagcagattgtggatttgccatcccccacaatcatgttagtcagttccttaaaatcatcactctctctctttctggttttctcttgaatacacacgtatacgcacacctccccctctcttatctggagaactccgccttctacaattaccagtgggatgtgtgcacctgttgggcaccgcacaactcccctgaccttggaatcagattggacaacatttcctattccgctttgatttttctgcagtactggcattttaatcccagcaacctctgaaaacctcatgttgcaaaaatgacatcaacaagaagaatgcttatgatctaatgttgaaactgtgaactacctgaagtgaatcattagcccagtgtgtaacaagtattgctgtgtttccctcaaaaagttaaaatatccctcagtgcctctgtgagttcgctgtggcatcccatccaggacacctgggtgcacggtttgggagctgcaggtagagtggcagcagtagtcatgggagtggatgagttcaggtggagggcacaggaggtggagacagcagagaagagcttcacagagaacatctaggagggacagctgaagaagcgctttggggccgggcgtggtggctcacgcctgtaatcccaacactttgggaggccgaggcgggcagatcacctgaggtcaggagttcgagaccagtgtggccaacatggcgaaacaccgtctctactaaaaatacaaaaattagctaggtgtggtggtgcatgtctaatcccagctactcaggaggctgaggcatgagaatcccttgaacccaggaggcagaggttgcagtgagctgaaatcatgccactacactccagcctgggtgacagagcgagacgttgtctcaaaaaaaaaaaaaaaaaaaaaaaaaaaaaaggcaggggatggctttggaaaggagattctaaagggagactagagacacagggaaaaattgatgtactgtctgtgaacagcaaggaaaatatgattacacctaagagatgaaattggcataggcgagaagtcagaaaaataatctatacagcttgcatggttggggagttaggagaggccaaggccacgtgcacgtagagcaagaggtagaagaggcccgggggctagagcgcaccctggtggatagtgtgagaatttcacactggctcaagccttgaagaccaccccaggggtgcgccttagcaacgcacttatgcaagaccccaacaactggcccttgaaaggagcttttcactggtggggtgtggccctgcttgtattcagaaccatagttttaacaagccagcattaaatccacaagtctttgccaaagcactttaagcctcttgacatttattggaattaatttacctgcaaggaagttcatatatctagctttgttaaccctacattcgggaaaatgtttccatgagataactaaaacccgcatgaatgatacaatactgtgacaaaacccaaaggtggcataattagcatataaaactcccaaattttttttgcaattaccatcgtctagtaactggttgtttcattaggtaaaagtggatggaatcagtggaattatatgtatgatatgaaatgctctttggcatctattaaatttttattttgaagaaaaaataaaggacaaggaaagcatcctattccaagactccaaggagattatatttttaattccacaccacagaaaatgcaaacaaatttctaattacacttcatgcatggagatctgtagaggaaaaataaattggtacccatccacccaaaagccacaaatcagacatagaatggctaatcacaaatataacttgtgtgcctgatgctgattactttctccgcagtctgttgtgaacaattaagaatttagatcttgggctgggagtgctgtttttaaagtgtgactcaaaagcataaagttcatttaaatttctcctaatcctggtttgcaatttctattcctttttggttagagtattatttatcttcaggaggcccctattatactataaatattgccttggggcagtgttcatagcaccacagcacctatctatccatttatcagaataatcagcacttcctgttggctgagaaaacactgtcatttttactgtttaaaaacagaacagctttcagtagcaattgccattaattgatttcatggcaggaagacggaaaattctccattttttcattctcataagtcacctaagaacatcttaaaagctacagagaggccgggctcagtggctcatacttgtaatcccagcactttgggaggctgaggcgggcggatcacgaggtcgggagatcgagaccatcctggctaacacagtgaaaccctgtctctactaaaaatacaaaaccaaaattagccgggtgtggtggcaggtgcctgtagtcccagctacttgggaagctgaggcaggagaatggcgtgaacccaggaggtggagcttgcagtgagctgagatcacaccactgcactccagcctgggcaacagagcgagactccatctcaaaaaaaaaacaaaaaaaatgctacagagaaaggggacagctgccatggaaaacagtggggcggttcctcagaaaaaaataaaaatagaattatcatataaccctgcaatttcacttctctgtacccaaaataattgaaagcaggaacttgagatatttgtacatccacgttcatagcagcattattcacaattgccaagggataggctcggcacagtggcttatgcctgtaatcccagcactatgagaggctaaggtgggcataatggatcacgtgaggtcaagagttcgagaccagcctgaccaacataccaaaaccccatctctactaaaaatacaaaacttaactgggcgtagtggtgcatgcctgtaatcccagctactcaggaggcgggagaattgcttgaacccaggaggcagaggttgcagtgagccaagatcgcgccactgcactccagcctgggtaacagagagcaaggcttcatctcaaaggaaaaaaaaggagccaaaggatggacacaacccaggaagaatggataaaatgtgaaggaaattctgacacatgctacaaaatggatgaaccttgaggacattatgctcagtgaactaagccagtcaccaaaaagacaaatagtataggattccacttgtatgaagtacttagggtagtcgaattcagagacagaaagtagaatggtgattgccaggggctgggagaggggagatggggatttactgttcaatgggtgtgcagtttcagttttgcaaggtgaaaagtgttctggagatgggtggtggtgatgatcacataacaacatgaaaatacttagtgccactgaaccggacgctcaaaaatggctaggttggtacattttgtggtgtattttactgacattttattttattttattttattttttgagacagggtctcgctctgtcacccaggctggagtgcggtggcccgatctcggctcactgcaatctccacctcccaggttcacgcgattctcccacctcagcctcctgagtagctgggatcacaggtgcatgctatcacacctgactaattattattattatcatttggcagagatggtgttttaccatgttggccaggctggtcttgaattcctgacctctagtgatccacccgcctcagcctcccaaagtgctgggattacaggtgtgagccaccatgtctggcctgaaatttatttttaaaaaagcaaatctacagaggagtgggctccaccatagaaattcagttccagttagtcagcagtagcggcctgggcagcagcaattctggtctaaggtgcggggtaatctctgaagtagttaaacacaagtggtgtaaccaatgtgtcaggatgggagaactgggcactgggaaagagaaagactagtgttgggaggagcagggaagcaccagcaaggaaaaagaccctgtacatgaacttggctaaggaattgtttcagtgatagaaataccagacactgtaaatggttgtgcacatgggccagagaggtctttaaattacatttgaaacatatacacctactgtgtacccataaaaattaaaaactattttaaaaaataaattccatttgagccactccttcaaaccacccagagtgggtagacgtctttcgtgcctctaagaagccccatctctattctgcgtctcaccttgcagggctgctcatctgaatcctgaagatggtggacacccatctgctaggactgaaatgaataggacagagggaggtgcagagtgaatggaccatactacctgtcatcttggcaacgtgtgattgaataaaacaacttctttagaagtttgatagagtgatttgataatgtaatttacaagtgatcatttctttttattttcattttcagttgttttttatagacaaagtctcactctactggctaccggctaggctagagtgcagtgccacactcgtagctcactacagcctcaagttcctgggctcagcaatcttcccacttcagcctcctgagtagctgggactataggcatgaaccaccatgcccagctaattaaaaaaaaaaaatgtttttgtagagatgagtcttgctatgttgcccagaatggtcttgaactcccgacctcaagtgattctgtcacctcaacctctcagtcttctttttatttgtgtacctggcttcagcccttttgtttcttcaagggcctggacttgttactcctggcccaggagtatgttgttaaacactggattaatggtgtgacctatgcatctatttaatttatacgtatgtacagagagatttttgcgtgccgtcagtggctaaccaaatcaggcaaaccacagttcatttgagtaagtcctcccatgccatgaggcatccctgaaagggatccattctccttttccagagaattttctaggatcagtagcaaggcctggtgtccctactcatgctctttattgaatacaattcattttgagtgacctttacttctcagtaatagttctttatttgtgaagcgcagtttgcaaacagcctaatcggcttctggcttctggttactagtattccacctgctttgtaatgccattgtaaaaaccagctgggtaggaaggaagaagatattgattgaatgtttttcactggaagaaaaatttgtgtagcaatgagactgccctagattcaaatggaatttgaagacaatgcccatgttttctcttcgtgtgtgtgtgtgtgtgtgtgtgtgtgtgtgtgtgtgtgtgtgtttgactaacttagggtggttttttttcgtatttcttcttagtacctgagagttaatgtatcctagttaattaatgatagtatgtttctaaaaatcaaaggaagaataataagtataataaaatgttataaagttaagcataagatcttaggctaaggaaccactgtaaatacacctgtaatcccagcaatttgggaggccaaggtgggaggattgcttgaggtcatgagtttgagaccagcctgggcagtatagcgagacctcatctctacaaaaaaaaatttaaattagctaaacatggtaacatgtgcctgtagtcccagctaccacggaggctgagacaggaggattgcttgagcccaggaggtaaaggctgcattaagccgtgatcacaccactgcactccagcctggacaacagagtgagaccctgtctcaaaaaacaacagcaacaggccgggcactgtggctcacgcctgtaatcccagcacttcgggaggccaaggtgggtggatcgcttgaggtcaggagtttaagaccagcctgtccaacatggtgaaaccctgactccactaaaaatacaaaaattagccaggcatggtggcatgctcctgtaatcctagctactgaggaggctaaggcaggagaattgcttgaacccaggaggcagaggttgcagtgagccaagatcctgtcactgcgctccatcctgggcaacagagcaagacttcatatcaaaacaaacaaacaaacaaacatacaaaacaaaacccacagcaacaaagaaactatggataaattgacccagggtgagagtattagtaaggactcttggatttttccccctagactatggctcattagttattttatagtcctgctttttcagggatctttgtattatatcttagaccctgttttgttttgtttaaaaatgtgatgttaatacttgtctgtgggctggtcttgtcaagtcttgcaaacttgtactgctgttgtgctgatttcttggataggagcccgaggttatcatgtttccctaacaatgctcaatcttgcccctattcagcgactgactgtttagaaaagcctggccttcttgggttgcccatgaacttgaccccttagatactggcagtgaagagcttgagttaaaaaaggagttgaaaaaaagtgtaagcaggtgactctcaaagtgccggtcagttgccaccttctctacttgaaataatcctagaaactctcacttctacttctcaaagaacaatccatagtcacccagaaacaagcactatatatacacaaaaactcgggtttctgacttgtcttcattccttcaacatgtccttgttacaaaagtgtgggacagtgatttgcaagttctttgacagtagtggttatactggggattttcttctatctttcaggtatggaactcagctctttgatttcaaggagggaaactcaagcaggctgcagcagttcaatgctctgcaggcgtcagttcctggcattatggagaaactcagaattattagggggaattatggaagcaggatgaaatgagaaagaagggtgtgtatggcccctgagcgggcacctaagagtaagagtgagaaggtcatcttggttccagcctgtcaacccacagatgaggtccagagagagtatagagctagcaagcaaggtctcagatagttaaggcagctctgccaccagcaccttttcaaatgccttttgcaccaccttctgaatagattgtcttaaacttctcagacatgactaattacaagtggccggttgatcctataataaccgatttgtctggtctggctataagattagagaaaattatgctcttaatgcagagtgtggaaaaacagaatggtatgtaatggggtggaagtttggctttgcatgtggatctgtctggacatgtatgaaatgtacatacatttcagaggggcaataaggggaagaaaataaagaaataatttgccattttctctcctaagttcaatttcagaattcagcaggaagctcctctctctaaatgaatacttcaatgactttgtaagaaaaattagataatttagagagttacattattttcatatttataatgctgtgagtaacactgaaatgagccccagcaaaggccttaagttttaggtataccagttaacaggacctgccccgctaaggcctggttggagtgatgtttccatcactccaggaccgtctaaaagaaagcaacactataaaggccttgcatatttgggaaagtaaaagaactttacttcatttccagtttttacttcgttgtgtttttcatcaagctcgttcattattactacggtatctctattgatactgttagataagttgtaaaagttcccataggctaccattttaatcattgtctctcctagaattgtttatttcatgcaagatgttgatattaacaccttatagaaaaaaaagacttaaatcataaaacttccatttgcttccttgtccccctcaccctggaagaatgaaaaaaaaacttgctattttttttaaagtcgatggcaaaatactttggtttagctcatgaaacataaatatttgtggtagcctagttggagaataaatgacaaaagcgcttttataaaatagctgttgtagttatataattcatttttttccagtatgctttaacatttcttgaatctaaaggtgtgaaaggcatggttatcaaaagcaaatagatgtgaatactgctgttattaaatgtcatgcttttcaatttgtcagtcatatattatctgaaaaataaaatggatttttctgttattatttttttcttttattttctcaactgggctgtccacaaaaggtttgtggcattcttgtttttccagtgaaaaatggaactttaattgcctttggatactttcataattatataaattaatactgacccccaaaacccttacatataggaaaggtacaactggaaataggatggcattttaatgataattagggaaacgaatgatatgaaattacttatgatttgtaaatgatgcttaataatttaagcagagagaggtggtaaattgttgtctacattgagagtgttttatgcataccttttggttatgcataacttttggttttccttttgtttaattattgcttcttagtgttttcaaaacacagcacaaaatatttgagtatgatttgttttctgaaagataagatgtaaagtgcaaactcattagatttatattagaatggatgcaagcttgctgcagtcttctaaattggtattgcttatcctttgttgagaactagtttgggtatggtcagtgttttggaaagccatttcatgagcactgccttcacaaggtaagatgccaaatacagacgtttcagaaatataagttcattgggttaccatcactatgatacccagcccaattatgttatctaagtgaaatgtttaagaatgtctcctaaaacatggctacctatttgactttaatgtgtttttgctgttttattaattgatgtaaagtcccctataagtataaatttaagggaatttctcattgagtgctatgtgcctgacatgtattaatgtctcttcaatactctttgacatatgtagttttttgtttgtttgtttttgagacagggtcttgttctgttgcccaggctagagtgcagtggaacaatcatagctcactgcagcctcaaactcctgggttgaagcgatcctcccacctcagcctcccaagtaggtgcacgccaccatgcctggctaatttttgtatttttgtagagatggagtctccctatgttgctccagctggtctcaaacttctggactcaagggatcctctcaccttggcctcccaaagtgctgggattagaggtgtgagccactagttttatttttatttccattttactgacaagaaaatggagacacagaggatttaagtagcctgactgtgatcacagctaacaaatggcagagccaagattcaaactctagttctagagagcattatcattaacccattttctccaggcccgggattctgggtctgatgttctgggtcacctcctatatgcagtcatgcttcaccctatcccagaggctaaatattcatgtcatctctgtgtctgaccttgtaactccctgattgggacccaggctgaactactcagcagtgaaactcttatgaaacaccaggggtttggtctaggtcctgctgcttacctaacaggaagccaatcactgagacaacaagtattgccggggaagaaagctttattcaggtgctgcagccaaggagatgggagatcagtctcaaattcatctccctgtctgactaaaattagggggttatgtagcagggaagaaatgtaactatgtgtgagaaaacaggaattagggagaggtaagggaggggagttggtcaacaggaagcagggggtcaatgaggcatcatcatgggtgaggggtctgacaatttattgtttagatgcagtgatctggtgagtgtcagcttcttgatgctaactgggaggcctgatggtttcctgagaaaagaactcagataagtcaaatgtaaccatctcaagttttaagactggggcgatcagtttttatgtttttttttttcaaaagaaaccataaacattggctctatggaacaagtgagtcagtttaaaaacaactttattaacagagttgatgatgtattttttatttactaggaataaatgatcaattgatatattgttttcaaattttcaggactgggttctttcctcctctcctttttataaccgcaaaatatcctcacaaacaatgtaattaatataaattttatctcatactttttgagatacatttacttttctgtttatagcttgtcttagtttgattctatgcactgagctgaacaccatacctactaccattctgctggaatcccagttttattaagtgaatttgcaacacatgatatggaatcactgtccttcagcatgtgtcttcccaattttcataactgatgacataactttatagggttcgccagtagcattgttatgatttataccatatcacatttgtagtatattgcatagtataaacatatgctgtttatatacatagtatataagtagcacatagcatatactatatacatagtatataaatagtataaatatatagtatataaatagtataaatatatactatgtaattagtatataattatactggagtgtatatatatactataaatatatacatagtttatatttatacatagtacataaatggtgtatatacatagtatataaatagtgtacctagtatataaatagtataaatatatgctatttatatacatagtatataaatagtacaaatataaataagtttataaatatattttttaaacagaagtataaatatgtatactatattatacatagtgtaaatatatacaatatacttgctgctcagtggaaaataagaattatttgcttatacttaattaatacaaaatcttttctagagtaaaatcattataaattcccctttcttcagagccaaaggagaaaaataaattgtcttcaaatataagtgcatcactcattgcatgatccaccctttacagacctaaaggggcaatgtacgctctcctggagtatgtcaatgggaagttgagcatgaatagccctgcatttagtaaatcagaagttatttaactactcggaacctagatgttcctatgtgttagataggaatgaaaatacccatctttccaggtttactcacatttaaatatgatcgtgtaatgtacttagtacagtgcctggctgccttctagtgtcggcactcaataaggagtagttatcattggttcttcgtagactgccattgggaacttgagcaggtttggagaagtggccattagcaaagaaatcataatggaaagaggctaggaatatacacaaagccagcactgtcttatggggttgcctaaaatataggaaattatggaaaatggaggcaagaaaatctctattcttgacttagaacttgcttaacttgtctaatgcataatttacctaaggattcaaaagtgtgggttgcttaagaataagcagaaacggctgggcgtggtggctcacacctgtaatcccagcactttgggaggccgaggcaggttgatcacctgaggtcaggagttggagaccagcctggccaacatggtgaaatcctgtttctactaaaaatacaaaaattagccaggcgtggtggcgtgcacctgtaatcccagctactcagaaggctgaggcaggagaatcacttgaacccaggaggcagaggttgcagtaagccaagcccacaccactgcactccagcctaggtaactagagtgaaactccatctcaaaaaaaaaaaaaaaaagaataggtagaaacttgaaaagcaaggctatgttaccctttggacattttttgtttgtttgtttgccatttaagaggacgtaaaaggagatcattagacagaaagtttgtaagttttggaagtaaaattttagagcaaaaggaacctttgcaagcacttttgatatagatctgtcattccagagaatccatacataggcttccagaacatctaactaagccatagaccttggaggtatcaggggtcttgctgccctcttctgccttatagaatcaaataaattcatagagaaacagtaggggcattttttatttttgagacagggtctagctctgtcacccaggctacagcacagtggtgtgatcatggctcactgtaacctcctcctaccaagctcaagcaatcctcccacctcagcccccaagtagctgggactacaggtgcatgccaccacaccaggctaattttttaattttttgtagagatgggtttttccatgttgctcaggctgttcttgaactcttgggctcaagcaatctgcccaccttggcctcctaaagtactgggattatatgtgtgagccactgtgcccagccaggacattttatttttatcttatatatatttttttatttttattttttgagacagggtctcactgtgttgcccaggctggagtgcattggcatgatcacagctcactgcagccttgaacttctgaacccaagtaatcctcccacctcggtctcccaggtagctgggaccacaggcaagcaccatcactcctggctaattttttattttttgtagagacagggtctccctgtgttgcctaggctggacttgaactcctggcctccagcagtgctcccacctcagcctccctaagtactaagattacaggcatgagccaccatgcccggccagtgaggacattttaaagaaggaagcagaagaatcaactagactgattgccctctccaaaattaaatattgcaaaggcaggagttggataagcatttggtcatgaaagatgttaggatgccttagaatcttcgaaggctaaaaagcagcagcattaatgaagttgaatgtatgaaagcagatttcaggtgttgaagaggaagcagctatcaatgcagagattaaatagacgaagtcacaagaatctagcagtagtaattatgacttaatgaaattccagttaacgaagcaatgaggtagagaaggtaggagaaaacccatcaggatgaacaaagcgtggcttgaatagctgggtggccaataagaatgctgcaatgaagcgaagagcatggcagagggccaaggaggagaaaggacaaacagcagcttcaagccaggaaagctcaggcaggaaatgagaagcaaatttcaaaacacctcaagggaaacattctttaaatacatctgaaagaacaggacagggaaatgtcgtttctattaggtagaggagggagttggttttatttatttatttggagagggagttttgctcttgttgcccaggctggagtgcaatggcgcgatctcagctcactgtaacctctgcctcccgggttcaagcaattctcctgcctcagcctcctgagtagctgggattacaggcgcgtgccaccatgcccagctgatgttttgcatttttagtagagacggggtttcaccatgttggccaggctggtcttgcactcctaacctcaggtgatccacattccttggcctcccaaagtgctaggattacaggtgtgagtcacggcacgtgatatcagtagtcaggttgtctgttttcttttccatgcaaagcaaaacttctttgtttcaagagtctggtaatatttactggaagttgggagagtaagagaaatgaggagaagagctgacaaaaggccgttatagcagactttggattaaaatctgtagacacccatgtcctgcctatcaggggtactgaaatatttctttagaatgattgcctcatggaacacccagcgtagagagaatatagaactagaaaaggtgcgagatgtcatttgtatgtaacaggaggtgaagaatggccttgaaatgacaaatctgaaggcttttatgacctggaagaaaatttgggatgggttggggtagcaggtgtcatcacaacatcaatttggaaatggcttgtaagctgtaaggtagcaggtattagcaatgtggttttaaaaagagcaactcctgtcagactaatgcatcctctctcggtgacagagtagatggaggaaaagtgaaagatgtaacctagattgattttaggagagttgctaatgcgtatccataagtcacacctgtgggaccagaaagaaatgattactttttgctgtacagctcttggaggggctgcctcattggagcacatgtaaagtgtgtttaattaggaattaaatggtcatagtggactgggtaaagagggtcatattaagaaatgttctaaagtgatcattaatagatccagtgctcattcaaaatgttccataacctgcaagatggcaggaaacacagaaaatggccaggtcggtggcaggggtaggagggaaggaggaatttaggatcagaggttaaaatgattatgattatttagaggcacagtcagaaataatgtagtagaaggtcacgtgaaaggtagaagggcagggcagagtatgtactgttttgtgtgtgtgtgttattttttgagactaagtcttgctctgtcacccaggctggagcggggtggtgtgatctcggctcactgcaacctctgcctcccaggttcaagcaattctcctgcctcagtctcctccctagtagctgggattacaaacgcccaccaccacagccagctaatttttgtatttttagtaaaaacggggtctcgccatattggacaggctggtcttgaactcctgacctcaagtgatctgcccacctcagcctcccaaagtgctgggattacaggcatgagccaccacagggtacttactgttttatgggtaaggattatgatgatgaatggttgcctagaaggcctacatgctgagtttatctgggagtgacatttattcctcaaagcgtatctttttcataatttcaatttttatttgggattcagggggtatgtgtgcaggtttgttgcctgggcatatttcatgatgccaagatttgggtatgagatcccatcactcaggtagtgagctaaaagcagtataaaatgggtttctttcttagccctgtaagttggttctttcttgaccaactaccctctaaggagagttaagagaagatcttgtaggtataaagctaaaaatcaataggctggcctacaaggtcaagtaacaaagcacgttgttttaagctcagggtcttaggcttagtggagcagggatctggtctgatccctacaagtaaaagaatgattagagacattgaaaaagccataaagatggttaaaaggttggggaaaataaggcttccaggccaaacaaaacttgaattcagtgtggaaaaatgttgagagataagttattaatgttaagtatgcaaagaactcctaaaagcacatggatgtcagctgttctatatttcttttgctgaccaactaagagggcaaattcttaactgaatgaagcatttgccctacatcaacttggaatagatttaaaagaagagagtatgactattactaaacatggagataagttagtgggggagggtatgtgtctccttctaagagatctttaaaattatgagcaattgtggctggaggatacatacatgttatacatttataaaatatttgagtttggactcaaagtagaaaatgaagatgagcccttttgtctctttcaactatgcatcaagattagtattagttttggatgacttagtctattgcaagaaagttttcactaggggttgggcatggcggagcatgcctatagttccagctacttgggaggccaaggcaggaggattgcttaagcccaggatttcagatctaacctgggcaatatagtgagaccctgtgtcttagaaaagaaaaaaagatgaaggaaggaaggaaagatggaggggtggaggagggagggaaggatggaaggaaggaaggaaggaaggaaggaaggaaggaaggaaggaaggaacttacttgaattggcattttccttttcctatcacaactatgccttcagctttcttctaattaccatctaagtccttataataaggacttataaatccttacatctaagtgccttacagtagtgtatataaattcttactgtatttgctcacctaacagtcttcttggtgcctctcagctctgtgaatgaaccatgtctaccctgctcactcaccattgtaactctacttccaacagtgtttggcacatagtcataatatctgcaaaatgaatgatggatgttggaagaagtacagcacagaaggttgcaggcttagaaggttgtcatttatagaatgatttgtggaggctggaatatcactaagaagtatttcccgatctttttcatattgttgaagttgtactcctggaaatatgtgtcatttgaattaaagaacttcctctgtaagcatcttctttttaaatgcaaatggaatccacacaaaaactcatacatgaatgtttacagcatcactattaatagttgccaaaaagtagaaacaacccaaatgtccatcaactgatgagctaatacacacaatgagatctatctaaacaatgatactaatacatgctacaacatggagtaatcctaaaaacattacgctatgggaaaaaagccagccagaggaccacctgttacatgattccatgtatatgaaatgtcccaaataggcaaacccataaagatagagaaactacactagtggtttcttagagctggggaggttaggaggagatggggaataactgctaatgggcaaggagggtttttttttttttttgagacggagtcttgctctgtcacccaggctgggagtgcagtggcacaatctcagctcactgcaacctccgtctccctggttcaagcagttctcctgccttagcctccctagtagccgagattacaggcaggtaccaccacacccggctaatgggtatggagttttattatgggatgaaaaagatgatctaaaattatctgccatgatggcacgagcctgtgaatatgctaaaaaccactagattgtgtactttattttatttaattttatcttattttatttatttatttatttatttatttatttatttatttattggagatggagtctcgttctgtcgcccaggctggagtgcagtggcaagatcatagctcactgcaacctctgactcctgggctcaagcaatcctcctgcttcagcctctcaggtacctgggactacaggcatgtgccaccacacccagccactgtaaaaaaattttgtagacataagaggtctcctaatgttgcccaggctagtctcaaactcctgggctcaagcagtcctcccacctggaacttccaaggtactgggattataggcgtcagccactgcactcagttgaattgtgcacttgaaatgggtacatttggctgagcgcagtggctcaggccaggcacagtggctcacgcctgtaatcccagcactttgggaggccaaggcaggcaaatcacctgaggtcaggtgttcgagaccagcctggccaacatggtgaaaccctgtctctactaaaaatacaaacaattagctgggtgtagtggcaggtgcctgtaatcccagctactcaggagggtgaggcaggagaatctcgtgaacatggggaggtggaagttgcatgacccgagaccgggccattgcactccagcctgggcaacaagagcaaaaccccatctctaattaattaattacttacctaattaatttatggggcacttggcatcaaggagatttctctagcaagaaaaagagcacaaagaacacgtatggtagacaacacaaaattcaaaatttttcctactttttagttttgccttttgctaagtgtgcttaacaattacacttgagaaataccttttctacaacataagcactgtagagtgttgctgttttcccttagaatgtgtgcaaactcctcatcttgcactcagtatgttaggtctgaagtgtggatgtctgtgtgtgtcctgcccttcacgatgtgaacctgagcactatgatgccattctgttcagcattgtgtctgtgtttattatcccagaacccatggtaggaggaccacagatatttgctgagctatctatactttgatataaaggatataaagacctggggagattttctttcaagaaagagggcagactctattatgagcttaacagagttgcctgcttagaatatggttttttaaaaagttaatactcaaattattttcaacaacagtgccaagatcattccattgggaaaggaaaatcttttcaacaattgctgttgggaaaaccagatatccacatgcaaaaaaataaatctgaacgcttaccttatgccgtatacaaaaattaattcaaaatggatcaaacatctaaatataagagctaaaactataaaatgcttggaagaaaatgcagggcaaaagtttcatgacattgaatttggcaatgattttatagatatgacaacaaaacacaggcgacaaaagaaaaaatagataaattggacctcatcaaaatttaaaacttttatgcgtcaaaggacactaacaacagtgtgaaaaggcaactcacactgtgagattaaatatttgcaaatcgtacacctgataagggatttacattcagaaggtatttttaaactcctttaattcaactgtaacaagtttttaaaacccaatttaaaaattaggtctaagacttgaatagatatttctccaaagatgtacaaatgtccattaagcacatgaaaagatggttaatatcactagccattagagaaatgcaaatgcaaactacagttagatacatatcacaccccatcctaatgagtatgaaggagtatctcattgtagccctgaaagggttctgggaagttgatgctgtgcccacattatgtcttctgtgagctatggcttatattgggttggtctgcccatgcgcatcacacttcatgagaatatgacagatcgcattttcttaatctgcagacttaaatgtttttttgtttgctttgtttttgttttgtgtggtttttttcttttcttttcttttcttttcttttcttttcttttcttttcttttcttttcttttcttttttttttttgagacgagtctcatactgtcgcccaggctggagtacagtggcgcaatctccactcactgcaaactctgcctcctgggttcaagtgattttcctgcctcagcctcctgagtagctgggattacaggtgcctgccaccatgcccggctaattttttgtatttttagtagagacaaggtttcactatgttggccaggcaggtcttgaactcctgactgcgtgatctacccgccttggcctcccaaaatgctgggattccaggcatgagccaccgcgcccggcccgtaaacatttttatgtttgcctttctcctagtcattttgccagtttcagcagtacatgggacattgtaatctctcaaagtgttttctaaatttaacttgaatctgtaatctagaaagcaaccaacaaatggccaatgcagcatgagtctcaatgtcccaccagcctcactcaattccccttgaatctttttgtcaccagaagttctgagtagtttatgtcccaatgtggatgattttctaggttctgccaatgcagaggattattctaggttatacaggttattctaaagaggcccgagacagctatccttttctgagtcctaaggttgaacccatacatatatctatgcaggtgcatcctctggtgtctgaagtgcagcttcttaacatcccattatgggggatcagaatcttaagcaatcttcttagccctagacccccagtcctgaaggttgatatgcaagtggcctgaaaaaaaatgacattggctgccccttgcttctgaaggacttacagatactctctaagtcctatagcatgtgcacaagtcagaaagcacctcatgaaattattcatgcattcaagctggactgaatttaatccttcaaagagagacagctgtcaacttcttaagaagctgagcatgttttacagttttgaccttgatactcaagaaatgtctgtgtctgacctaaaacttgtttgaaataggttttcttttcacataatgtaaacgtatttgctttttcctcattctagaagcaaaacatgttccttttcaaatattgtcaatttgaggcattttaagattatttcctttatttgttttttttgtgggctaggaaatctagacagaattgattattattatatggataacttttaagaaagaataatttcatcttaacagaatcatgttgaaactatcttatagaaggatatatagaaaaatataaaccaagattcatttcagaaataaattccatttacatggagaaggaaaatttcgagtcaaagtgacttacattgaaatcctggtttatgcatgaactagcaagtttttgaagcttgatttcctgatctgtaaaactgaagattccatatttttctcagtgttactatgtggattgaataaaatattacatgtgaaagaacctgataggtttctggtatacatagtagctcccccaaaaatgatctcccccgttctcacactattttccttatctctaattaacctcgttttgttttttaaatatccctttttggatgtctctttagtagcacagaaaatatgtttctattgggttgtaatcattacaattcagtcattgagtatatacatatatttcccttttgggcattgtcacccaatttttggctattcaaatagatcttcattaatagttcattagttattacttaatttcaatataaagaaaattatacttctgagtggaaggaaatcccatgtcacctcttgtaaagaatttactttcttagtatcaaagtaacatgtttgaagctcagaatcaatattacatggacctattgaattactaggttcagaagccagtaagttcaagggtgaggtgataatcaggaattttggtgtttgtcaaatatccactgtgagccaggaactagagcaggtgttgtacgtgtgtttccacacttaatttcacaactctctattaggtatcattatcactgttttacaagagaggaaataagggctgcagaggttggttaactcaatgaggatagcacattaagaaagttctgggccaatgttgcacccaggtctctctgagacttttattattatccaccatttaattgcatttagggaccatgattatgaggagacatcttttacaatgaagaactttagtgtccccccaaagccaatgttagtctgtctcccaaaacagattctccccttttctttgactctgtcttctctcctactcttccttgcttgtcagaataacaggttcattgttgagagtgggttagtaaatacagcgaattccaaggatttagagtgttgcgaagtcaggaaagaagacctgctgcaggctgtgtggttctgtggggaaggaaaaggatgtctaaccatccaactgggacctgatctcttggccatttgggactgggtaggagaatggctagactgacagccctgtgatttggcccttttcctttggaggggtgtgaatctgatgctgtaacaatttctgccttctgttggtggtatggcttggccgtgtccccacccaaatctcattttgaattgtagctcccacagttcccatgtgtcgtgggaagaacccggtgtgagataattgaatcatgggggcagcttctcccatacagttctcctagtagtgaataggtctcacgagatctgatggtctgataaagggttaaccctttcacttgcctctccttctctcttgcctgctgccacgtaagccatgcctttcaccttccaccatgattgtgaggcctccccaaccacttggaagtatgagtccattaaacctttttttctttagaaattacccagtcttggtatgtctttatcagcagcgtgaaaacaaactaatacagccggttaatatccctgcagttccctccacccgcatctcttccctccacccacatctcttccctccctcctctgtagcatccatcacaggactaaagccagacaaggctccgctggcacaagcagagcaattcattgtgaagtttactcctgagagttttcttctgctttaaactgccacagaaagaaccgtctagacagctacctcatgtaattgactgccccacgtttaatagaatgatcttttcttctgagatgtcaacctcataaggaatcataaagttcacttggaaattattttcaagtgagcagaaatgcctcagcatttgatccagttttctagtggatgggaatattctttgaatgtgtgtgagcacgtgcacgcttgtaaatgtgtctgacacatgttatgcgccgatagttctccgtcatgtaatcctgagaaatgcgaattttttctctctgattgctttgctttccttccctatagatactgtgttgtactcaataggctgccaagtccatatggattagatctgcttgttatccttttacttctcctgtcaaaataaccatcacagtgcaaaaggaaaaccaagaaatgcattctccccgggctgaagttggactcagtgcccagcttgcaaatgaactcttcttattttctttctttctagaggcattccacagtggtatatgataggattcccttttccatgtcttctatgtacaggcaaagtcgtgattaaatccttcattgggatggaaatcagtaggtcagttggaagattgtcaagccaagatgattctttctcttccggtcctaaaaaaaaaaagacctcatgaattgtttttatttaaattggatgttttgttaatctctatctggagttgaattctccttttgcctttcttttcattggagacttgatgttcatttcattatttctacttgtagatacgtatagtatctcctctatttgagcccaacattccttggaaaattttatgaagttgaatcagggaaacgaagtgtatttccttttatactctgcgtcatagccaaagactcctttaatacttactttaatgaactgaggttgtaatttagatttcttcagtgtagcttttagagcaaagagcatgaaactggttttcaggagatctagaatttcccactggctttccaactgctaactaatagccttagacaagccattgaacttttattagttccaatctcttaaatgtaggagttgaagtgggtggtttcaaagattcctttcagcttccaaattctggaactctggaaaaaaaaaaaagatagccacatagacttggaatatcgtcatgtgttcctaaagtatcatcttttataataattgatgttgtttgaaaagagtgttgatatacagatcttggacaaataattaaaatttaaggaagtctaccagactgtccttgctagcatgaaattatgcctgaaggcatagcactgtggcctttgcagccagagggcttgttttagaagtacagtacactgtacacgtcctagtcactggggagctctgtgtacaaatacacacaaggccatggtcacagagagcaacagtcacaaacataaattcagatgtgtgaacaagacaattgagaaacaaatcattgtcatttaagcttaaacttttaaatcagagagacctacctcacatacttgtccaatttagtagaagactgtgacaacagagaaaatggcagctgacagcagaaacaggactgatttttttaattaaaaatttcaaattaaatgtaatatatgtacatggaaaaacttcatacgttaagctgtgcacacaatcacaaagttaaaagcttctaccttcaattctcaatcctcctttctaaaattaaccattgttattcattttttgttagatcctttcctcaaatggcatatgcatatcccagtagatagatgcatggcttatgtgaacatttataaaaattataataatctacagttactctgtatgtcgcttctccacttagtgatgcatcttcaaggtacttcacattagctcatgcagatacaactcaattttttttttttttttttttttttgaaacagagtctcactctgtcgcccaggctggagtacagtggcgcaatctcggctcactgcaacctccgcctcccaggttcaagcgatcctcctgcctcagcttccagagtagctgggactacagatgcatgccaccacatccggctgattttttatttttagtagagacagggtttcaccatcttggccaggctggtctcgaactcctaacctcggggatccgccgacctctgcctccaaaagtgctgggattacaggcgtgagccactgcacccggccgactcagtttttaatgattacattgtttaccatcatatgaattatcatttactaaatcagttccctatgctaatttaaatgattatttttctagtttctgtctttctctaactgcaactcctgcatttccatctttatccaatttcttacgaaggcaaagctgcactggatggtctgttcatatatctgggtatttttttccacaggataactttctaaaggtagaattgattgttcaaaatgtttacaaatcttaccagaaatgttagacctatttggatatatataatattctgcaacatataagaatgctagttgatagttgctatcctgtatattaactttttaaaagttttgctaacccaatgagtaaaaaaagctcattgttttgatttacatttttataatcattgacgttagagtatattttcctatattagttagtcaattttgtgtttgtgcgaagctccagtttgtgtttttacccatttttaattggatgatgaggtttttggggggtatttttagaccacttcataaattaaggaattaactttcacactttatgcaaatatttctccagttgttaaagtttgcatgtatttttcccatagaaatttaaaattttcatgcaatcaacctcagaaatctttcctctcatatttctgcctctggaattgtatttttagaaagaacttccctgtcctaatattacatattaagcattgtttgtgttctatactagtgctcttagagtttagcttccttacgttgtaatatttgatccttctacagtttattttgaggcaaggagtttgatagagatctagctttctttcttttgccaagtggctagtcaacagtaccactaccacgaactgaataattaatcttttcccttgttgatttgaaatgccactttgtgagatccaaatttctgcctgtgtttgggtctgtttctgaactctatgtttcattccattgagctgtttttccgtctccaattctacgatgtttgagtgactatatttttagttatgggccatgcagggggaagatttgcaaaattggttgctcagttcactgttttgaaactgcttaatgaagaggcctctttgtttccattttctctattaacaccagaattagtgttcacgatgacattgtatcatccaaaaagaattaattttgcccttataataagcttaacaagattgaatataaacaaaattttaaataaataagataatgttaaaaatagcatctagaaggatatttttaaatgtcttatctggaaatctcacttctgggacagcgttcaataaatctactgtacctactcacacacacatttgtagacaatcagacagaaaactgttcgtatttcttgcgctttgtcttttagaatgtggcacatcgaatagagttaccagttgccctgatctgactgatttcgtataaatgtctttgctttggcaacagttgagacctattccttctctgaggtaaatcttcttgcagagcaggaagttgaggttttggggtagagtccaagagtcagttctgaccttattattggggaatgtggaaacctaaagccttccatgagttaataatgtgcacagtgaaggatttttttccctcctgaactgattgggtattttctaaaagaggatgagcttttaataacaggaatgtaacttttaattttaaacagatctgtgcttaaacatggtcagggaatagcccctgctcaaaaatctccttatttgtacatgttattgttcaagggagagaccttcctatttatatggcgagaaaataaatgagatttctttctatctgtcttccatatgtttaatggtaggaatgtgtcttggatcttgaattaaaacagactgtggattcagttagttgatacaattaagaactgttcttatctcagaatcaactctgcagactatctcagagaatccaatatcaaccatccaggtggctaatccatcatcaactgaatgggcaatttggttgcttctgttcaattgaacaaagaggcataggcactcgttagttccacaccccagtcagagaagcaacatgggtgtgtgacaaaaggggtatatagtctgttctttggcttcagatatgaaaaagcttttttcaatccaactaattcaagacaccaagcatagtgatttcttcactgacagttagcattgaaaatgaacttcattttcctcctaacacacacaaaaaagggggtggtagaagccacggcagatcatggcagatggcacttagggacagctgtagtgcttggcttgagttcccctccgcatggagcacagagctgcccacttcgtaggaatacggcaatatttatctacgcataggagtcattccaaataaaaagggtaacagaaagaaattgcagcctactgctgtgagcctatccaaagggtatccatacatagcccaacatttgaggtaagggcatggtttaagatctcaaggaatcaaaacattatggaaacactaacgggaccattagaataaatgaatgaacctaagatcttcagtccgacttgattgagtgcagatccagtcccctttggagagagttgttaagataagacttaactgtgactaaatatacaggcaaggaattgcctctgcaacacaaataagaagcttagaataatttgccatttgaactttccttatatagttagatactttgtagagaaacctaggctaggagttggtgattttttttgggtgggggggtcgcttttttccccctttctcattttattcatttgactatcggcaactttacgattttttaaattgtagtaaaatacacataacgtaaaattaccatcttaaccattttaaagcgtacagttccgtggtgttaagtatattcacattgttatgcaaccaatcttcagaactttttcatcttgtaaaactgaaactctatccattcaacaacagctctccatccccgccatcctcccagcccctggcaaccaccattctactttctgtctctgtgagcttgactattctagacaactcgtttaggtaaaatcataaacctactgaaagtgtttgggtttttctatgtgactggtttatttcacttagcacaatgtcctcaaggttcacgtatgtggcagcatgtgtcagaatttcctttttaaggcttaataatattctggccgggcaccgtggctcacacctgtaatcccagcactttgggaggccgaggtgtgggcggatcaccaggtccggagatcgagaccatcctggctaacacagtgaaacactgtctctactaaaaaacaaaatacaaaaatatttgctgggcatggtggcgggcacctgcagtcccagctacttgggaggctgaggcaggagaatggcatgaacccaggaggcggagcttgcagtgagccgagatcgtgccactgcactccagcctgggggacagagcgagactccgtctcaaaaaataataataataatatttctttgtatgtctatacattttgtttattcattcatctgtcaaaggacatttggtattttgggttttgttggcccttttttttttttttttttttggaggcagagtcttgctctgtcaccaggctgaagtgcagtggtgtgatctcagctcactgcaacctccgcctcctgcattcaagcgattcttgtgcctcagcctcccaagtagctgggaccaccaggtgtgcaccaccacacccggctaatttttgtattttagtggagttggggttttgccatgttggccaggctggtctcgaactcctgacctcaagtgatcctcccaccttggcctcccaaagtgctgggacaacaggcatgagccactgcaaccagccaggttttgttggcttttaatcaagataatatgcaaacactacttttgtccatctgatgatgtctcaacaaagccattttagaatctgaagatacttcctcattaaattgttactattgttaataaccgagtgttggcttagtgagtgttaaggtatataagagtagtccaaataaatggcatagaaataaatgacagtgattaatcactcactagtctgatacctcatagcttccttacttcaagtttaggcaggtgcaggagtcatgaaaaaaagccaaaagataaaggtcgcaaccacttggtgaggaatgtttgctttcttgaaatgatagccctctacccagcaccatgaaaagtgtgtttttcgtggtcattttcaggcctctaagcttgaggtgtgggtttatattctgaaggatgcagtgcgtgatctttctcaccaaactctctcaaatactgcactggataaacactcagaggactggaaagtgggactggaaggagccattgagattttttttacatcctcttgtcctggagtactttccttcctctacactttccttacatttctcagagaaaaaaagaaaaactttgtcatttttgtattacaaacgtgccagctttgactacccttgacactaggtaagtgggagattaattgttgggattatacccatggaaaaagccataaggcttacatcacaagttttattttttttaatattttgttttcatagctggggattactctattggcattcagggagagagaatgaaaaaatatactaggataaaaaagggagtactaattaaaactacaaaagcaatgcaaacatacattaaaagatacaacaaattccatgccagtttcgtgaagaaatgctttgaggtttttttccccccagctttattgagtataattgacaaataaaaaatgcatatatttaaggtgtatgacctgacaatttcatatacaaatacattgtgaaatggttaccacaatcaaattcatgaatatatccatcaccacacatggttaccatcctttgagttttaaggtgaattaatggaatgcgtgtcattcatatgcatattcatatgcatgtcatttgcataccattccttgactcaagaaagttgctatatgagtgaaagataattattgatcatatgaacttaagatacaattattctcatctggccaggtgcagtggctcacgcctgtaatcccagcactttgggaggcagaggcaggtagatcacttgaggtcagaagtttgagaccagcctggccaacttggtgaaaccccattactgaaaatacaaaattagctgggcatggtggcacatgcttacttgggaggctgaggcagaatcgcttgaacctgggaggcagaagttgcagtgagccaagatcacaccactgcactctagcctgggtgacagagtgagaccctgtcacaaaaataaaataaaatgaaataattatcctacaagaattaccagtaagtatacttctaaaatagatcttactctagttcattccaatactcacataatacaactatatattaaatggtgaaaatatcattgcagataaattctaaatgaaaataaatcctaatatgtaatccattaggaaataaaattctaaatttaattctacaaattactttgtgattttgataaaatttacctaaagatacagggaagattttaaatttgtttaaaaatgggaagttagtaaaatcttgaggataaagaagaaatgtatacatatcaggcaagcccaccactgcatgttccatagaatcttacagataatggatctcaagaataagcaggctaaattttcacacccatcccccaagtagctgaatcattggggattttcttttggagaaatttagggccctagcaaagagtagatagcgttctgagcaagttactactcccaagggttggcccaagcattcaaaaacagctgggggctgggcacagtggctcctgactataatcccagagttttgggaagccaaggtaggaagatcatttgagaccaggagttcaagattagcctgggcaatatagtgagaatcccatttttctacaaagaaatttaaaattttgcctatagtttcagctagttgggaggctgaagtgggatcacttgagcccaggaggtaaggctgcaatgagccatgatcatgtcatgcctctgcaccccagccagggcaacagaataagaccctgtctcaaaaaaaaaaaaaaaaaaaaagagagattgagatctgagatctcatatttttgtagcaggttacactgagtgttaatggatgcatgatgttaacttactgattttgtttgtgaagaacatataacctggttatttgaaagaaaaaaccatgactaccagaatgaaccaatgtgtaatatagaaacaatccctctggctttgatcccctaacatctgtgtgtcctctggcaagatttttgagtacaggttggagaatgagcaaagcaaaggtatttgttggacaccaactaggcatcagacactgaagttattttagttactcctgaccacaactctgcataagctacagggtggttttcccattttacagacaagaagactgagcctcaatcaggccattgtttggcagacagtacatctaggacagcctgtttccaagcctgtgccctttgcaaaacaccttcttttgcctggccagcttgatggaggctcttataacctgaggctatggtgtgctggtgggattgtaaacattagaaagtacatgccaagaaccgaaagccattaaggaaaatgagtcactttctggatgcattgaacatctttagattatgagagcttcgtgaagaaataaagtacagaaatgatttttcttcttaaaaagaaaggaatatctctctggagtagagattgttggcaagttcatgtataatcatggtcagcagaaaagaaatctaagcagtaatgaaaagcttgtgtactcagaatgcctttaacccagtgagctgaagagcaggcctttgggggaatgacgttggatggaggtggagttgggacaggaatagaatcctggtcctggagggaaagacaggtaaaagaaagtgagaccattaaaagcaggcatgatgcatggttactcttcatccctgggtaaggtggtataaattgcttttgttttgcccccgtcccccaaatcatttttttaaagaaagagaagaaaatatttttgagggaactcattaccttttggcttgaggcatagaagcctcagaagctgaaagcaatgttatatttttatatgctgcagatgcttcctggttttaaaacagtgacctggctccccaacaattacagcatcaacattgagggagaacattcttgtgtatcgtgtaattccaggagcagatgtggggtagcctttacgaaattaggaggaggggaggcagtctggtttagatcgtgaactacccaaaggaaagttacttggcatgacttcgattgtgtgttaagataatttttattgtgttctagttctcagacaatatcatagataacctcttttgcctgggtgcattttgaaaggtctttgtgttgattatctgcttttgatgtgttttcatgatccgttcagactacccaagccataaaacatcagtaattaagaaaaactctccctgtggagaagaatcaagaagattctacttcttttatttaatttttaacatatctaaaggaatgcagtaaactctttttacccattagtaattgactttgaaacaggatatgcctttcctctggagtctacaagtaagtctcgagagaaacttcataaaacagattgatcctaaacttccctcctgcattcatgggagttagctgacaggaaatacacagtgcgaggaagtggtgagtgagagaaaaaaaaaaaacagctaactgataagatcttaattgcaagggtcgttttcatggtggatcatacctaataggtcatgtatttcaacagtttttttggaaaagtgattatgcatcttttttttttattattttctgaggcagagtctcattccgtcaccaaggttggagtgcaagtagtgtgatctcggcttactgcaacctccgcctcctgggttcaagcaattctcatgcctcagcctcccaagtagctggaattacaggcatgcgaccatacgcagagctaatttttgtatttttagtagagttggggtttccccatgttggacaggctggtctaaaactcctgacctcaagtgatccgcccacctcggcctcccaaagtgctgggattacaggtgcaagccaccatgcctggccagtgattatgcgtcttgtaaacgaatttttggggtctaacttttccaaaatttctatctggttttctttcttcccttctaagagtctgtatcttcttccctgccctgggctttattcttttctagagatcctggcagtcattatgaccatgccctttatggcacatccaaggtcagtgttcatgcgtgtcctccctcgttcattccctagtatgggtggatatagctgtgttacatgctgaatcctgctacccactgtgcaatggaggggtcagagtcttgtggaaggagagctggagagccagggagaatacaggacttttcttcaccttgggttgaggcagaactcatgaaaaacaatgaagcaaggaataatttcgttttgcacccgtttttttcgtttatggaccccatttcctgcatcttagcaaaatctctcctcaaaaaaatgttctagattagtagtagtaaattgatctatctgatggggctgctgttggatctctccgagccatgtttgaacttttaataatgaagtccacagtccctgcatagcttaccaagcaactgtggatttgcagggtgcggccagcaggttgctggagcgagatgggctcccagttcccctaacatcactctccaccctccacagtctatccacaagccaccaccctgctgctcacaggtctgaccctcccctgtggttgatgggcaggacaggactctacatatgccggtgtctgttaacacaatggggaacccaccagagatccctcacacaggatcacttttctggctgggctgtttttcctcatctttcatcagtgagtgttggccgtcagcgtggcactcttcacacccaagtgaagcctgcctttcccctctgccacattgcagtctctgctggggtggaaaagaggtcagcaaatgaactcacaatagtgctaagcattggattaagctttcaccattagtcttttcagctgacccaagaattgcattgtgaatggggaggtggggtgactcactgagtaatcctttaaagagtccattggaagccagtcttctttcaaatgtttcacatggaataatcgtgaatatttttgcatggatgtgcaattaattgcaaagtatgtatgtatactttaggtggaaacttaaaaaccttcctttgccattctcataaatgggcttgctgatctgcctattatagattatggtggccaaagcaccacccttctattaaaaagtataatctttttttttgttgttgttaaccaatcaaatgttccatctgtttagactccgctgtctgctctggattttagaacaatgcagtcaaggttattcttgctcagtaatcttgccttgaaaaagtgagttactgttcccagaggcaaaggcactgcttcttgatgacaggcaagtgggatttattagctttgtgaaggaggtgggagggcatcgtgatacttggtaaattatgagaggggctggggagaccatgtcaaaaagaaagggattccttgccagatgttcctaagagttgaattaccatggagaaaataatctgaaaatatgagtgacctcgactttgtcctaaacccccatggcttaaagtgcaagcgaaaggagggaatgtggctttataggggcttgcaggtagatggagggtgggtgggggtggtgtcaggtcagttccttatgggcttccctaagtcagtgctggagagcaaaaagagtgttgaggcctcccgagaacgctagaatgaccccacatccctctacatcagctttagacccacagcagcctcctaggtcttctaggtggaggctgagatagagatgttctatcctgaatatgttcagacaagccaggggcactcatataggtggtgcggtttcctgttttgcaaaggacaggagatagagccacccaagcagatgtcccagatgaaaatggctgtgaaacgacagtgtcaccttaatatccatttggacctcatttatgggaaaagccacctttcccacaccactatattttgtttgttacaatctctgtttgtccttctctttcaaacatatttctcattagatttattccatcgcatattttcagcttgtttctgtgaagttccgacaggaggggtgttccaggaagctccgcggtaccttttattttattttactttatttttgcccttctcctggaagagcacttggtaatcttcttaaatgctttttgaaagccttttaatgacatcactcagtgccccgctgatcactcatgaactgcagttgtacaccagctccaaaagttccatatttatgatgataaacaagagctgtaagatttctaattttgctgaggggctattttccctctctctcttgatgtgactcagtttttcagtgtagggccagaggctgtttgtgtactcagagacgatgttttcaactttttgctcttgatttttccaggcaattagcaaagtctttttagagtggaattgttatgagcatacattctattttaattcattgtaattagagggatgagcattacacttcttcaagaactcctagaagtcaatgttctgatttccaaagatcaaaatcttattttatgagcaaaaaatgtgactagatatgaaaaatgacaatcagtaatattcctccagctggcagagtgtatgaactccacttgtgatttcaaaatcatgctgcagagctgtagctgggttttctgatggtttctccacggattatcttcctcaaatacaatgttaaaaataataacttgtcactgtggccctcagtttggttgtgtttattataaagaagattgaacatatgaactgccaattgatgatggcccatgttcctggtctgtttaagtaacatcaagtcatctttgaatttaagaaatggtagcattctcttatttgattgctattagccctgaaatggaactgtccagaatagtatttgtgaaatggcagagttcccggacccccctcacaggacgtgagacaggggtgtggctagtctatctggccacctagtgagcactcaaaccccttacaggagggggagcatgcagatgggcaggtgcaggagccggggcaagtgcttttggactctggccccacagtagcatctaggggtgggtgcctgcaactctcaaagctgcagtgggcatgttaccatgctcttttagctctgccatctgcacacagcttaagtgttaaccagctcagtgccctcttggtatccaagtccttgtcctgcatccaggaagaatcaggtcacacagacaaactgaaggatggtaaatgcgggggattttattgcctcatcaaggtggctctcagcaggatggagtgggaagatgatcttcccctggagttcagccatcctgaagccaatctcctctctcaccattcctagccaaactcctctcagcattcagatgttccttctcttctctcctctgctcctctgctcttctgctcctctgctcttctgctcatggagcctggggcttggggtttatatgggtacaggatagggaggcatggcagaccaaaaggcaacatttgggcacaaaaacaggaatgcccgttcccatttagggccatgggtttccagacttgagggtggggcttttgccaaggaaccaccctcttctacccagtatttccctgcctcctgtccatgtcatttgtacaagaaaacatttttctcccagtaaagcttatcagttttcacagaataattgtcagcccctaaagtatttttggctgtctccagaggttagtaggtaagaagcttgaagatgaggccagagttcagcattgagctgtcccaggtgacacagactggtgagggcaggcaggttggctgaactcagtccctggagcttggggccagaggaggttgcagctgtgtaagcaggtgggcttcagcccctcaggatagcaagtctcacagccagggatgcagatgctaacatctgtcacattgtcttcagtggtttattatcttagtttcagctgctgcaaccaataccatcgacttgggggcttaaatgacagggatttatttctcatagttctggaggctagaagtccaagagcagggtgccagcatggtcaggttctggtgacaaccctctttctagttggtagacctctgtcttcttgctgtgtcctcatatggcagaaagaaagcatctgtctcatgtctctttttagaaggacactaatcccatcacaagggctctactcttgtgaccaaatcacaccccaaaggcctcacttccaaatactatcacattggagattagggcttcaacatgtaaatttggggttggggggcactcacattcagttcatggcacttgtgaactgaagccaagtgttgtaggtcttctgtcgccacagctgagcaggctgagatgagcatagcaagtcctcactcttttttttttttttttttttttttttttttttttttttgagacagagtctcactctgtctcccaggctggagtacagtggcccgatctcggctcactgcaacctccacctcccgggttcaagccattctcctgcttcagcctccccactagctgggactacaggtgtctgccaccacgcccggctaatttttgtatttttagtagagacgggatttcactatattggtcaggctggtctcaaactcctgactttgtgatccacccgcctcggcctcccaaagtgctgggattacaggcttaagccaccacacctggacagcaagtcctcattctttagcagcagaacattttagggtctcttctctttcttttgtgcataacttaagtttcttctccttaatgataacatcattgctttattatttttagagctttatagttaacagtgctttcaaccagtttgcttcatttgtgcttcctggagaccactgtgaagtaggtgggatgattattgccattctgcagatgcagaaattgagggtcatggtttagttgccccagtacaaagcctgatgctgggttaagtaatttattcaaagtaaaacagcatcgaatgctgaatctacatcttgaacccaggtccttctgaccgcaggtccttcccatgggtatttagagatttgcaaaaagcacttagagctcctgcccattagtctaggccttccttgataataaccttgtgggggagacctctagtgtggccaaggatgttaggaggttgccgtggtttcagtgtgtcccccaaagttcatgtgttagaaacttaatcccgaatgcaacagtgttgagagttgggacctataagaggtgactaggtcatgaggcacaacccacaggaatgaattaattctgttatcttggaagcacgttcctaagaaaagaataagtttgggccccctcctctgtcactcacacacatgctcccttgcccttccacaattccaccatgggatgacacagcaagaaggccctcgccagatgctggcatcttgatattggacttccagcatccagaaccatgaggaatgaatttattttctttataaattacccagactgtggtattctgttatagcaacatgatacggactaaaacagaggccatctgtgtctaaagcaacttaaagctaaaatttgccaaaaaggtttaatccaagtcttcattttaatgcataaggaaattaagggccagataaatgcctaagttacaatgagtttgaggcagggcctgggctaagaattggtctcagactctcagcccagtgctctccagatcattgagccttacctctccctcatagagtggcaagataagatgccccactcgtaccacggccagccattatggaaactttcagggtagaccttgtatgaaggccagcccctgcccactgtaggtagaggaagacaagacactcagaagcatccctcagctggctgcctgggcctggagtagtacgaatcaccttgctttggatgcaagctggtcagaatctgtgagtttctacactctgggcctgtttcctatggaagaaaagggagaatcagaagtgcattctggactagcttcaataaatcatcttatgtcttatcccacctcttttccctattaaaattcttacctttggccgggcccaagcttgagaaggccactcctaaagcaaggcccctttggactagggcctgggcaagagttaactggcacctgctatgccagcacaaagcttaattcccctgcagcagcacacccgcaggcagctattgaagcaaggatggaatgtcttacaatacaaagcctttgtaataatgagagggaaatagaaaccagaggtttgcaagctctttttttcttggggggttctgagtatttttgtttaacttaagtttcgtgttccaaggaaggggcgttttagtgaaaattgtgaagggaaaccctgccaaacagaaattccttataggatgagtattttcctcctttcaaggtgtgagagcgaccaagaagcaataacgcataggggagtcggggtgatagattggaatgctcttggctggagtgtgattggtgtctggaagtgagtcccagcaggttggctggtgaggccatgtgagcattgggcctgttccagggctgtgaagtgtgcaggcttgcttgaggctgtaggcaccactgcctgagccatgcacgtaaactccccagaccctaagagtagtttactgtcagggggtaagcccccaaatcaagcaagctgcacagagccaagactcccaagaaccaatgccttcttccagcctttcattcattcattctgtaagtgaaaactcagcgtggatgtggatgaagatattcatgcctttgtgatcattacatttcagtgtgtgggtgcaaggggaaggagacagataagaagtgagcaaataagtaaagtatctagtgtgtctaggggttttaaatgttatggaggcaaaaataagcagagttctcaaggaactggtcatcccgatgtccatgggctgcacttggttggggcagttctaagagtatctgtcacacttgcagagacgacctgggtcaactcttcccaggcactttgtagaacaccgggcagggatacttcaatttcactctttgttaactgggaatgtggaggcttaggaaagaactctgagatttgtgaatgtgataccagtcctcctatagttaaccaatgtgtttgttcattctcatacactcttgcatttgtatgagaatattaactatttcaaagctctcataaatctattgcatcattttagtcttatatcaaagtaggaagggtggatattgagacacaaaattgaagatcaatgactgtgctgtggcatgggttgtccagtcaggacagtggccatacacagtggttggccatagtgaaaactggctgaatagtcaccctgtatatgacaggtttgctttgcaatttgttttttgtttgtttattttttgcattgcaatggcaaggtcatagaaataatcttgtcacccttcaaactcactactttgaaagccagcactccattgtatgcatatatatacacatacacacacaaagtgtacttgttttgtttttttaaaaatcagtctccttactttgacccatgagaacaggagcacacaggagttcagacatatccattggccacatagtacctgagatctgtgaatgagatcacagtcgtcctatagttagccaatgtgtttgttcattctaatactttctttctttcttttttcttttcttttctttctttctttctttttttttttttttttgtttttttgagatagagtctcactctgtcacccaggctggagtgcagtggtgctatcttggctcactgcaacctccacctcctaagctcaagtgattctcgtgcctcagcctcccaagtagctgggactacaggcgtgtgccacaaaacccaattaattttttgtgtgttttttgtaaatacggagtctcagcatgttggccaggctggtctccaactcctggcctcaagtgatctgcccgcctcggcctcccaaagtgtcgggattacaggcatgagccaccatgcctgacttagctttcatttgatgagaatattaattatttcaaattgctcataaatctgcattactgtatgtcagatattggctttagcatttttctcaagttatttcatacaacaaagtataatataaacatcattattactatgtcatgaatgaagaaagtgtacatgaaacatgcctaaggtaatatgcccaaagtctcacagatagtaagtgttgaaaatgaagcttacgcccagttctttctctttccagaaattatactttcaaccactatcctatattcactataggattactttagattctaagattccttaggaaattagaaattcttagaattagaagctgttgggatatcaccctgaactcttttttgttaaatgttgctgctttttagtttatttacccttgaaggtctttgaggctttatattttattattgttatatcaactataattcttagtgtgacttataaagtctcacaaggctacgtaattttattccatctttaagtattttaaacagttagaaaaggaattatattacaattagatttctcaatttagtagctctttttttttaacccaaataatcagaaattactttgctcccccagttactgacagactgtgtatctttaggatataattacttttttttttttttttttttttttgagacagactcttactctgtcgcccaggccggagtacagtggcacaatctgggatcactgcaacctctacctcccgggttcaagcgattcttgtgcctcagcttcccgagtagctgggattacaggcacacgccaccatacccggctaattctttgtacttttagtagagatggggtttcaccatgttggccaggctggtcttgaactcctgacctcaagtgatccacccacctttgcctcccaaagtgctgggatcctgtcacgcccggccaagatagaattactttcaagactatttcccaacgtttggtcttgttatattctttagttttgtgtcatgaggctactaattttttattcctcagtggtaactttatgaaatctcttagacttgcagcaatcaagcctctcccttctatcgtgggctttaactatgcaagcagtcagcccattacagttttttcacagactggttacattcagcccgagtttgaaccagggccatttgggggcatttggagaggatgaagatggaccaaaagcaatcagttgacctgtgtcttgtttcctcttgaatttgggatttcagctgcctcctttgattatgctggagactgtatcatactcgctaggttcagggcacccccttgtggtgcaactcgaaacgtaatcaacgtgaggaaacagaatgatggccaaatgacgaggaatgaagaggccacgcatgtagatatgattttattgttcttcccatttttaaaactctcaaatcaaatctcctgtttttctcctgttgtttcaaatttatcagtagttatttcaatgctaagtggttttttttttttggaggtagaaacaaatcagaaaagcaagcacaaataatttaatgctacatctcgggagtttttaaaaaaattttattacaaaagtaaccatggatattctaggaatgttagaaataatagactaagagtaggagaattatttacaatcccatgacccacatagaatacttgtgttaatattttggtgtatatccttctcctatttttttctaggcacatagactcaaaggaaagaaaccacatgccacaagcacatgccatttttttttcttatttatgttattttattttttgagacagggtctaacactgtcaccccgggctggagtgtagtggcgcaatcacaggtcactgaagcctcaacctactcaggctcaggtaatcctcccacctcagcctcccaagtagttggtactgcaggcagacgccaccatgcctggcgaatttttgtattatttgtagagatgaggttgcaacatgttgcgcaggctggccttgagctcctaggctcaagcgatcttcccaccttggcctcccaaagtgctgaatttacaggtgtgagccacagtgcccagcccattgttttctaatatgattttatccacttaattatatgtgtgaacttctttccctcctgttacatgatagctacttcatcattgcatgtggttgcctggttttgttggttccactgtgtgtgggcaaataccatatcatgcagggcctccttgtagataactgtagattattttcttgggttctttattagaaatagaatggctgggccaggggcgatggctcacgcctgtaatcccagccctttgggaggccgaggcgggaagatcacgaggtcaggagatcgagaccatccgggctaacatggtgaaaccccgtctctactaaaaatacaaaaaattagccaggcgtggtggcgggcgcctgtagtcccagctactcggaaggctgaggcaggagaatggcgtgaaccagggaggcggagcttgcaggttcgggccactgcaagatcgggccactgcactccagcctgggcgacacagcgagactctgtctcaaaaaaaaaaaaaaaaaaaaaagaaagaaagaaaaagaaatagaatggctgtatcaaaaagatatgcaaaattgtcttcttgttcatttgttaaaatagagcatctttttgagaatgcaattttttttaaatctgcaagttcctaacatttgcatccttagtctgtgttaggaattgtgtacagtgtttcacatgcctggatctcacttcatcctcccagcaacctattatgatccattgccacaccaacttgctgatgaggaaagtggggcttaaggaaattaaagagctgttgtgggacttccaaagcagaagacagtaggctttcagaaatttgataaaaatagcactttgcatttcttgaatcttgagctaaatggaaattaatactaaacattctccactggtaaaatagagaataaggatattaacagtaaaagaaaagaagaagaaaaggaaatgtgcttccacagatttagaaacataagtaacaatctaagttaaggctttggcgattagatcttcatgttggaagatatgctggatggctcagtgatttgctgtgcaattacaaacccgagacaatttgtaatacaaagagcttttcatgagatcttacatttttttatgaatatattttcgtttaccatggttagtctcctaactggttaaattgcttccagagagtcaaaatttgactctatgtaaagtgacatcagaaagtctctaatttctgggccgggcgcggtggctcacgcctataatcccagcactttgagaggccagggtaggcagatcacttgaggcccggagttcgataccagcctggccagcatggcaaaaccctatctctactaaaaatacaaaaattagccaggcagaggttacagtgagctgagatcatgccactgcactccagcctgggtgacagagtgaaactgtctcaaatttaattaaaaaaaaagaagaagaagaaaagaaaatctttaatttgtgaacaaaagtggaactttgggtgagtgcttaaattttagcagcctccagagtttcctgatgttactccctagagatcaacaattcactttttccctcctttactgatacttttctttgtgccttgttatagaattatatttattatagaaaaccctgaaatagacatagcaaaagaaataaaataaatatcgcttgtcattcagaccgtttgaagtactgtacgtgtgtcattcatttctggttctctccactacatttgctcattgtgtggttacccaatatttattattcttgagcaattcttctcagactcatcagcattaggaaagaaactctgaacccctttcccttcctgccacatttagcctttcaaagagatctcaagtgccatttagtacaacaacaatgtctgaagtttctttttgccattttcttatgatagctgatgaatttattaggagtctctgaaataataaatgctcttctgtttaatttttacagtattattatttttgccattccttgaggtagttgagtcttcctgttttctcagtaacattcctttagttttttgtgggttttgtttttgtttttttttttttttgaaacagggtcttactctgttgaccgagctggagtgcagcgtgcagtggcacaatctcagttcactgcaccctccacctcctgggctcaagcagtcctcccaccttagcctcccaagtagctgagacttcaggcgtgtgccactatgcccagctaatttttgtattttttgtagagatggagtctcattgtgttgcccaagctggttttgcacacctgacctcaagcactcagcccaccttagcctcccaaaatgctaggattacaggcatgggccaccgcaccaggcccattcttttaatcttgatctaacctctttatatgtgataaactactgattatcattagcatagataatccagaagttcactgaaaacactcaactctggtctcatccactttttttttttttttgagacagtgttttgctcttgtcgcccaggctagggtgcaatggcgcagtcttggctcgccgcaacctccgcctcccaggttcaagtcattcttctgcctcagcctcctgagtagctgagattacaggcgcccaccaccacgcccagctaatttttgtatttttagtaaagatggggttttgccatgttggccaggctggtctcgaactcctgagctcaggtgatccacccgcctcagcctcccaaagtgctgggattacaggcgtgagccaccgcacccagccacccgctcttattttttaagaacaattttctatcgtatagtcaaagccgtaaatcaagcttgtaaatgctccacgttgatttagcaggtatatgtgagaggcctaataaaatccagttttcttttttattgctcttattgttgggctcaaaactttccacacagatggaacctactgagaagcgaaaaaaggttctcagtgaggttcattttgtaatcctgagaaaacttatgtgtgattataggatcctgaggcctaaagttcgtgagcttattccattgcatcttctgagaagggcttcctacgtctccagcatcccggggccttccctgctctgatggtgggagattcttccagcttctaggtttccgtgaccttagttagcaaaggcaggaaaagatgtaacaggtagactaggggtttgctccacagttcggaggctttgagcaattgtgtgtttctcttgcctgcctgccttccttcctttctttctttcttttttcttcctttcttttttttttgttttgttttgacagtgtttctctctgttgcccaagctggagtacgttggtgtgatcatagctcactgtactcactgcaccctcgacctcctgaggtcaagcagtcctcccccctcagccccctcggtagctaggactacaggcacttgtcaccacaccaagctaaattttttctttcatcttttgtggtaatgggagtctccctatgttggccaggctggtcttgaactcctggcctcaagcgatcctcctgtctcagcctcccaaagtgctggggttacaggagtgagccacctcacccatcctcccctactttcttgactttcagatgatatttgtctaaagcaatggctgtagcgactttccttgcccccgtttctccatatttcattttctttgttgtaagttcctctgatgagggtcacctagcagagagtggttgaggtctctttgtccctcctggcagactcactgggactccggtctcttccattaccactttccattcctggtcctctctgaagggctgtggttgtcctggttctcctcccgcagccggtgttacttatcatcgctctgtgattttctgtgctttttttttgtcccccttttccctgtccatagcagctcttcaaatctatcatcctgtttttatcttacacttttatttaccatgcatctgcagggctttattatttgtggtctacttcagggtatttctttcacagttgatgaagcctgtaaacttcagagcagagaatcagagggccctaagcaaccctcacctttctggtgagaatatattcacctagaaaagggcttttatgaggtcactttagctaattgtttttctaatagtgtcactccctttttctcttcaaggtctcttcaagttcttttatttatttatttatttttttaacccctatgtgcatcttgggtagaatattttagtacagtttttgtctggagacctgttgtttggctttttggctttcgagtgtagccatctgtgttcaagtgttctttttcttctagtggaaatttgtgtctgatgtgtgggactaagttctaagtaatatacacacatatatataatctatacacaatggtgatatggatcatggatattgtataattcaatcatgacggtacttagaggctcctatatgttactagtccttatggatatgtgtatatgcgtgtgcagtaagatatgcagctatggcaccccactggcagatattgggcacaagaggaagtcactcttcttgcatgaggattatagaaattttcattttttaagtcacaaaaaaatatttcactgccatgtttttttaaaaagttaagttgctcaaaaatgagtcggatgcagtggctcacaaatgtaattccagcactttgggaggccgaagcaggcagatcacttgaggttaggagtttgagaccagcctggccaacatggttaaaccccatctctactaaatatacaaaaattagccagctttggtggtgggcgcctgtaatcccagctactccggaggctgaggcaggagaatcgctttaactcgggaagcagagggtgcggtgagctgagatcacgccactgcactccagcctgggcgacaaagtgagattctgtgtcaaaaactaaaaataaaaataaaaataaagtcagtggcatcaatgagaattaaaatatttaaatgcttgcacagtaagcattgtaaaccaaaggcacactccagggtccaccaggttcaaatattagaatttgtgccctgaattacagtgtggatcttctgttcctgcatgtattcaccttgggtgtgccctcctgcatggcaaagcatgggcagagagcactgcactcacaggcctgctttcgtggagcaatctagtggccagtgagcccggggccagtgacaatcaagatggcagcctcagactgcattctggctaagaaagctatttcatttgggttgggcaggctctagtaagttccctgcagctctgggacaacctcagggatggtggattaatatgacacattctccaatgatacaaggtgaattcagaagcgcctatggcagggtattttggggcaaacccattgctagttaaggcttcaacatgtctttctaaaatataaggatggaactgtcatcatttttctttcttttcggggaagaggagttaaccgtgctacattttcatcatgaataaataggtggtccatttggtcaacctattctttttctcttcatgttttcaccccttttctttcctatttttttcttgttttctcctggtccacaggctttgaagggcatgctgatctctcttcaggcagaacttgacattcaaaggtacttgatgaaaattgaatcgtctcagcgagttagtactctacctgttctttttctgcatcgagttgcaccctcatcctgcacctttccctcacctgcaagtgccattctaatcagtgtcagccactaacgcctgcacttttcgctgtttaccccaatccctgattcaaaactatcagagccaagtgcttgtagcattctgaaatatgtgcatttctaaaaattatgagagtcagtattaaaatgaacactaattgcatgcttgcttcgaaatatttaatttgctttccacagattggattgtggaatcagcagtaatgcaaccacaagctggagatctttgaataattgtttgaaaagtgggcatctctaagcagagatcctatccttgccagcttgctccagcagaatactcatggcagtaaaacagaagcctgaatcattctgacaatcccaaagctatgtcattctgctttgctcagttccaatgtgtccaatgttgggtccagatcattttacttatatacattttaataatgatcataatggaaataaacacatttctttagaacttatatacaccaggcactgttctaagtgccttacaagtattaacttctcacagcaaccctgtgggggaggtatactatgatccccattttacaaatgaggtgattgaggcacagagaagttaagtaacttgcccaaggtcacacagctaggtaatggttgtgcttaggaaatgttcggccatctggctttgtacaaaagtgacctccttcccattggtcagtcttcagtgaccatgcttatctctttaccttccccttcttaataatcagtctcattgatctctttttagggtaacaagctcaatttagaaagttcctgcccagacaaataaacattaaagttcaagtttagacactaaagagaattttcatgtcacacatcatcccaattctgatgagtgtttatccttaattttattcttaatcattttcacattcctaaaattcatgcaaaatagaggcatctttattatttccgtgcgcatgtattgtgcactaagttaaaatgcagaaagggaaaagaagggcatagtgagctcttccctacaacttcacaccctgccattaacctttattcctactttcagaatagagatttgacattgcccagtgggattttcccatcataagtagtactgagtttgggattccctcccgctattctttttttcttctgcttgaaacaaataaatcttcagtactgactttccttttctttctttttttttccatatcagcaaataattggatatctgaaatttttcttgaagtgcttttttggcatttacaagcattttaaattataatgctgtttttcagagatggaataggatgaaggttaaggttggaaatcgaaggtgatcttccccctttagtgaatgagtaactctcagatcctctccagatgtcaaattctgttttgaaattggatgtaactatttacctatctcacaagaccaagatgaaggcatggtggatccattaaaggtttgtttgtacccttctcctctcacataggatcccagaagctacgggacttcccaagaacagtaggaagctgagccatctagaatcaccctactgagagtaacaccagcttactacctaaggaaagctaaatggttggcatcttttataatttaccaattgctgtcccatgcaacatttttccaattacttctcactttatcaagtagatattctgattattttataaaagtgagaaccgaggttcagaaaggtttcatatggagttgcaccgtgagttcatggcaggattggagtctgcttttcataaaataacctgataaaaacagtaagttctctcattataaattttgtcttctgtccatctcttcaaacactggtatactttcctagagcaggactagaggaaaatcagaatctttggtgcagaaagctagttagaactttcactatgtgtgtgtgtgtgtgtgtgtgtgtgtgtgtgtgtgtgttttcatttgaaaatcattccagtgaaattgggcaggtggtagtggtggttgttttggactggcgggagggggaatgtgtttgaaattaacagtgaacgctattcccaggatgtatggggagggtctggccataagctctgagccttggtgaccccaggaacccacaagagtccctcttgcccagttccctgtggccttctccactgtggggtgatgaggacatcataagctctcccatggcacagcccataccctcactgagggtgagggcctttgctagcaaggaaagcctctttggtttggcaacaatgcaattaagttttaggggtacgattccgtggcttgggatcccacatcctctccataaagcactgaagcctaggttgcagagatgagcttaaaaatggcttttgttaagaaggccttctaagatgtgtacttagcaccatgttttgctggttgtattttacttgagacttcaaaggctacaagcaggtttctttccttttatcagtataataacagcaatcctcacacagacaccttttatcctatagccttttaaagtgcattcctgactttctgaattacaaaagcatctgcagtcttgctcagacctcaaccaatgaggattttggcagccaaagcctgttcaacattttacttgttgataaggcattacttttcttgtttcagaaagaaaggagagaaagaataaattaattgttgtattcaaggcaacttgcaataaaaagacatctacctggccgggcgcggcggctcacgcctgtaatcccagcactttgggaggccgaggcaggtagatcacgaggtcaggagatcgagaccatcctggctaacacggtgaaaccccatctctactacaaatataaaaacttagccaggcgtgatggcgggcgcctgtagtcccagctactcgggaggctgaggcaggagaatggtgtgaacccgggaggcggagcctgcagtgagccaagatcacgccactgcactccagcctgggcaacagagcgagactctgtctcaaaaaaaaaaaaaaaaaaaaagacatctaccctaaggtagatacactgaaaatcaaaaagcaaaatctcgtaagaagaggaagcaaattttaaaatataggtactatgattagcttggacattaaatttactttcaagcttcctgacatacatgatattttacatatgacaaggtaatacttattaatccttcaggaagcaaaatcatattctttgtttcaaattgtgaaagaaacattgttcgtgcctttataaaaggtacactgatcagcatagtaggcaggaccaacaagtaaacagcagtattcttcatgtggcttttgtttttttagagacaggatcttgctgtgtgacccaggctggagtacagtggcatgatcactgcatagctcactgcagccttgaactgccaggttcaagggatcctcccacctcagcctcacgagtagctgggactacaggtgtgcaccacgactcctggctaattttcatgttggttttttgtagagatgggacgttgccgaggttggtctcaaactcctggcttcatttatcctcctgcctcagcctctcaaagtgctgcaattataggtgtaagccaccacacctagtccaggcttttaattttgtatcggcaaaacgaaaagaagaaaacacatcactgaataaaaattgcatgaacgtatttctgaaaggggtgaaagtctgagttaatgagatccagacttggaacttaccgatgatctaattttctaacttggtagaaggatgctaaatggagatcatagttgagctaggctttattttctttaaatagcttttgtctcattctggctttggggaggagtcagagagcagtcaatctgaggtggtatttcagtagagtttatgtcatgttacaggtaggccacaaggcagacaggtggcaggttgatgtctaatcctggagttgaaaaggccaccctgccttctgatctgataagaacccctgtctcctctgcaaggcaacagatttagcagctcctctaggtggaaccaaacctcttcaagggaaaaaaaagaatactgtatcatctacaaactatgaagggttgaaaggtggaaaatatctctgggatcatagaaaattgctaaaattccaaatttacctagaatcaaattttaagagcctttaaattaaattactataatggtatcagaactacagatgtggaagtctgtctctttaaaaggtggaatgcaatctgcatgtctgaaattgatttgatggccttggcgcttttcttaactgtatcgttttgtagaattggaagttttgtaagaactggattcttgccaaatattgcatggcatgaaaatgaaaacgtgtttcccttcccatgttttccccatgcatttgtgttgtcatttcaggggccatctctaatgacaagttcttaaacctagaatccaatcatacagaatacacaagagaagacaggaattgggcatgaatacattcaggtcaccatagacaggaatccttctggattctaaatgttttatgggaaagttcccttcctctgatctattctttaaaaatatcatgcctatttagtaattctctgatttgtaaaaacaacatattcttattttggagaaataaagaaagtgtgtcactcttatcctaagcaatctaatgcagaacagaaaacccaatgcagcatgttcttacttaataagtgagagctaaacattgggtacacatgggtataaagatggcaataatagacactggggactcctggagtggggaggcaggaggagagcaagggttgaaaacccattgaatactacgcttgttacaaaaacaccgggggtttggtcgaggttctgctgctcaccaaacagaaaaccaatcactgagacaagtattgccaaggaagaaggctttgatcgggtgctgcagccaaggagacagaagctcagtctcaactccatctccttgactgactagaactaggggtttatatagcaggaaagaaacgttaagaacacataagaaaacaacaactgagaaggcgcaaggaaacaatcatgatgaatgaggggtgtggcatctggtgtggtgatctggtgcgtttcagttctttgatacttttttgagagtcctaaaggtgtttcctgaggaaggaactcagataaaacaaatactggtttccagctttgagaccagaacaatttcttgttcagtttatcaaaaaaaataatctatgggactgttgggtcagtttcatgctcactgcctgggtgacgggatcaattgtaccccagacctcagcattttgcaatatacccatgtaacaaacctgcacgccaaaataaatctaaatctaaaataaaaggtgaaattatttaaaaagaatgttacccgtaatcccaccatcaaaagaaaactaatgctcgcatttggctctattgtgtccaattactaaattataccccaaaattccattaaaacacctttattatgattgtgtagtactctagagtacacagacattgtaatttgttaaccagccctccaaattgtttcaagatttacttattctattaaagatgtaatatgtacagatttgcttcctgacactccagtacaagaactaccacttttcttaattttcccaaatcaaaccaatctatcctggcttcagcaattattgagaaattcatcctcatcatattaaggggaagcattttcccctcacttggagtcataaggaaatcttgaggagcttgtccaatccaataaaaccaggccagggcctctgagtctcctgggacttatagtgaattgctttctgtgcagcctgtttgcatccaggtttatggggacctttgccaagtatcctaagtgtgagcacctggttccacccactctaagcatgtcacacatccatcttcccagttgtgggtcacttcttgcaaatggaatacaggtcttcccaatttgaagagcaccatcgccaccactgacaccaaaactgccaccctcttcttggctctgggaagtcatccactcccctcttcctgcgcaattaggaacttcctcctttccccttctggaggtaagtccagacgtcttttccagatacctttaccttctaaccccaatttagggagagagtcttcagagtggcctctgtagcatggggataccattaacaacccttccctgtgggaagaccttggaacttaaaggcttggaagtttcccaggaggtgatggctagcaatagaagttccataaattttttgttgtttctgacaaccacaaggacaaggtaaattaacaatacctcagaagatgaatctgacacacagataatactctatggagagtatttgcatagtgtggtgcttctttaaacaatgaggaagagcccttttctgcacagaggtgtccttgtcatttgtttgtttgcagctgtaggaaggcagggggctttgcatggtgacaatgggttggcagaggggtcctgcctggctcacttcgctccacacagaggatgcctcagtgcagggatgactgtggctggctccatatgagctgcccgtgggcagcgggtaatgggtatcactgccctttcatctttccaatctgataatgaaataatacacacagagaaggaaaatgtggaaacaaaagatgcagttgtactttgcccaactgctgaatcgtctgatttccatccagaacaaatgccattctgttttcacaggtgaaaatcatgaataacgtctgggtactctttggatggaaaagggagaaaagtgttgaaatattagcgttgaagaaacaggatataaactgagtgtatcaaggatatttcatcaaaataaatcctagagaaaatgcttcccctttatctaagtcagggaagagaaatactaattatcagacctcaacttaagctaggagaaacgtgagaatctcagatatgcaccgttggaagttggcattaaaatgtggttagtgaatatagatctatcttattgtaaggcccagaagttcctggttactagtcatcctggcaagtatccacaaactgctcacatccagcatccagatgtccactaaacactcgattttgtgtgtgtgtatattgtactgtagattaacagcaggaccctctagcgcctgcacccaaggtttctattaaaaacaaaagctgctgatttattctcctctaccaccatttctctgagtctttaatgccagacccaccccaaaattgcaagatcataataaaactaactacagttctcttctccatttgtgttgcagttctcacatccacccgttgtattttagaatcatgggtgtctcagtctattacccagagtgatcatagttgcaagaatggcactggggagatatcattcagattttgcttttctgtccataagccacagaagccgtgggaagttgccaagaagacatgcatagctaagccttgctgttctttttttaaattttgtattcttctgttattttttagagatgggagtcttgttctttctcccaggctgatgtgcagtggtgtcaccctagctcactgcagcttcaacctcgggctcaagccatcctcctgcctcagcctccccagtggctggaactacacgtgtgcagcaccacacctggctaattttttaattttttgtagagacagagtctcaactaggttgcccatgctggtcttgaactcctgggctcaagcaatccacctgcctaggcctcccaaagttctgggattacaggtgtgagccactgtacctgaccccagggctcgctgttcgaaatatacacctggctgttggtcacaggactcaccagagaatggcaggtggtggccaactggaggaagaaggcctcagctgatgctgtcaccagggatgggtttatgtaaggatgggagataagatagaagccaggtgtgcccgatggagctccctgtcttccttcccacccttagtcctcaacccagcatggacattaaagacaggaaactagaaggagagcagaaaatgggaaaaaggcaactgcactgtggcttgtaaaaaggactctgtaagcaaatttagaagcgtagagcttccaaagtgagagtttattaattttcctttggagtaccgtgaagcaggaatggtagagaaaacctaaattctgtggatgatttatttgttaatttaatattttgttcctggaatttttaataaaagtacctagcaactagaatgttctcttcaactgaaatcagaattttgactgggtttgagttgaaagtttcacaagtgaaagaaatggggctaaagtgtctgaatgtcatgattaaattaaccatgtcctttaatgagtgctaggaatgagtcattccaaatacatttgcatgtggaaaacttcattgtattttcaaatgccctgtggcaaattgggcattaattaggatgaagtaaaacttcatcacggcaatgttgatttttcttttcacaatagaacgtaatctgaagcaaagtgaataccttggctagccagacaccccactgttcctggcaattaacatattacgtaaagctacatttgcaggttcattttctggacctcggcatttcaatttagggtttaagggtctgaaaacgggaatgaaaaatacatcatcaatacctctagctctaactttcttttatctttgttgttatctccaaatccaatagcattgcaaagaatatgaataaatctgatctccctcgcagaacagtgcacttggtgaacatttcagcaaatatttgttcatgatgttaaaatgaaatcatgaccgtcttttaaaaattaatgctgttcaactatgttgcatacacttgaggacataaatgcggaaagccagatcttagcactacctagctacatatatctatggagcaggtgctataggataaataattcgaaggaaatctcagtaaactgtttttctggatgacatgatcttttcttcttatatgatgtgtacttagagttagaaagttttggtcctgcaagggatctgagacaccaactagctcaacctctggccttacagatgagatacctgtgactcaacgaggttatatgtggaccagtttttggcagaagctgaactagaactagcattcccagactcctggttaaataaaaattttaggcagggtgcagtggctcacacctgtaatcctagcactttgggagactgagatgaaaggatcgcttaagcttaggagtttgagaccagcctgggcaacaaagtgagacctcgtctactacaaattaaaacaattagctgggcatgatggtacacacctgtagtcccagctactcaggaggctgaggtgggaggatcgcttgagcctgggagatcgaggctgcagtgagccataatcttaccactgcactccagcctgggcaatagagaccctgtctgactgaatgaatgaatgaatgaatgaccaaccaaccaatcttaccactggtgtcaactctggagtgcgccacacgtgatctttgctcctttcatttggtagagtttcagggcaagctgctttttctattttctcagtggtaatcagtagtgtgaggttacagggaaggttaaattaggttaccacatgacagttacttgatacagagcagcaggcacctgttatgttgggtcctttatttcttccctcatcctttcattaggaagagaatatttctatagggtcaatcacagatgcagaagaggagagagctgcattgagccaatgacaccagaatgtcttcgtgacagagagaccccttcgaagaagagaagaatagaaaggacaagtggggttcaggtggcctgattatacagaccacccccttcatgcatgaccccaaagggcttaccatttgggtttgcgggtttggggttgcctaatgatttggggaagtctttacaaggttgtgatggaaacagagggagattggtgtcatggatctccatggagcaaggaggaaaatccagtcttacagacccttgagtcctgctcacgtggctcagagaatattcccaccatcccctgcttcctcctcagttaggcatagctctccactcagcagcttagggtagcagcttcaaacaccaagctgtaggccatgcatgactgagaaaagttttcaccggaggcaaaatgagaacactaactccaacataaagaatttttcactagatcaaacctgaaattgtgtttgcttcccccttttttggtattaaagtatctttcctttcttatggtaaaaaaatgataccacagagagtaagatttctttaatgcctcttactttgcaaaataaaatcaacatccttgtattgtaacccctcataaatttgggggaaatatttctttagaaattttcatctatgaaatataaaataatgggaactatgattatggaaataagctccagagagtttagctttctccatggttcttactaatatgaatatgtgagcatcctagcagcttagccaggaggaaccattagaattggtgttggtcagcggtggtttgcttgtaaggcaccgttatcccaaactagtgcaagaacaaaaactgaattaattgaaggaattcattggaaggaccccacagtgtactggaaacagaaagtgggaagcccaggagaccccagatggctgctgtcttatcttttgtgctctctgaagatcgtgggggtctcacatctctgttttttaatacagattcgctttattttttttctctgcacttttttctgtttcacttttcctgcccacgttaaccacagcttcaagttgaaaactaagttgtttcaagttctctgtagacattgactaatagatcctctgtcccagatctaaatttacaattgagagtttaattggaccagctaagttcaggtaactacttcttgacccaatcaggaaagacatttccaggggcgagaatttgattgatccagctaagatcaggtgactactgttcagtccaatcaggaaagaccaggctgggagtgggtagccctgtactttattgcccagttcagagcaaccctcgcacctccctcacctacactcttcctcctcccctgatgcccctttaaactcagcagttactgccccagactccttctgcacccagggtgatgtgcctcttcattcttcctgtccatctattgcatatatattatcttttgcccccatatagaccttacatgcttgacgagctcaagaacttttatctctggtccacttttacccatggtgcctagcactgttccaaaatgctattttgactttttttttttccagcatatcagatcacagggtatctggcacaagtgtcagcaatttccattgtcttttctctgaactaaatgatgtctcagcagcaagctggcatcagaggggagggtactgcgtgtgaggagactgctaatatgtagtgatcgttttcagtgagaacgtgaataacaacaaaaagaggagtttacatttggagctaaatagctatgtttaggaagtgaggggagaaaaaatatatagccctgcatctctgatttttctacttacctaccactacgatgaccctgaacaagaaacagagatttgattttgattttcttcaaggattattaccttctgcaatggaaaatgacaactcatcaaatgtatggtttctgccgtgagctataaagatgaccaaaaggcagaggttataaatgtagccatgttgcttaaagtaatattatttcttggctatcttgctaaactgaatctaccttctttaaaaaaaaatgtcaggaatgaggacatcataccttgatattctgctgagcacagtaaggaggaagctacttcactgaggaccacgtgaatttgtctaaatcttggtgaactgggcagtgatttagggataattttcctggtcaaatacttgtaatgtgtgtcaaagccagatccccataacagaagcagactttgtaaaaaataaatctaggaatgcaccactttggggacttgtacagaaaaattaaccaaaggagacaatttcactgttaatgcatgtcctttctggtcatgatattggcatatctttgctgagtttcctgtagaacacccagtcatctccttgaagccacatcccttaagaaacacagggcggaaggtactgaccttatccctgctttcctctatgggaaggtcctgagaggcatgtaggaaggtgtgattgtctggataatgcaattggttctgttgagaggggtcgtcttgtacttttagcaagaagctgctcatcccattctcaaagggtactgctagagtatcaggcacaccttgggcatccctgaaacaaatctgtagcccaaaactcaaggcaggactggctaaagaattgtcagggtaccttgttcaaaaatcattaataaggccgggcatggtagctcgcaccttggaatcccagcactttgggaggctgaggcaggtgcatcacctgaagtcaggagtttgagaccaccctagccaacgtggcaaaaccccatctctactaaaaatacaaaaattagctgggcatgatggtacatgcctgtaatcccagctacttgggaggttgaggcaggagaattgcttgaacccaggaggcagaggttgaagtgagccaagatggcaccactgcactccagtctgagcaacaagaatgaaacgccatctcagaaaaaataaaataaaataaaaatctcccttgcaatgtgagtttactgattgtggaaacagtcttggtatgagactctgaaggaccagttgtgttcaatttactctggtattagtagctcatccatctagggtgcgtagaagagtatacagtcccatctgttgtgaaagcactgttagaatttgtcgggcaaaaggaattgttttgctgtcactttcttataatgtggcttgtcctcaactccctgttcaaaatgcaccacataagtcaaacaataaaaatcttaatggagaccaggtgcagcgggtcacgcctataatcctagcactttgggaggccgaggcaggcggatcacctgaggtcaggagttcaagagtactcaaagtactcaaagcctggccatcatggtgaaaccccatctctgctaaaaaacacaaaaactagccaggcatgttggggcacacctgtagtcccagttattcaggaggctgaggcacaagaattgcttgaaaaccggaggtggaggttgtagtgagccgatctcacaccactgcactctggcaataaataaataaataaataaataaataaataaataaatacaatggaacacttaagggcaatgttattttccggtaattttcacaactgatactttgacccactgggtctttagttttccctatctaacccttgtgatggactgttaccccttgccatattatttttccagattaatagaaatggcattggacatattttccacacgattaataatagtctattttcccactttctttaaaatgccttttgcagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggtaagctttagaaggcagtttctgatgcccctttcttactgaatgcgtttgttgttatactactgaacctatactctttcattcaacattaatttgatcttgatttgcaaatactctagtactgggaaacttcattggtttaatatcaagcattgaggatttgcctgctgggtaatcaggtcaagtgcaagctgattttgaggctgggcactttcagaagtggttgggattagcaattcaagccaagaggctagtagtattttacctatgttcctgctactatacagcaggagtccccagtccccaggccatggaccagtaccagtctgtggcctgttaggaaacagaccacacagcaagaggtgagcagaggatgagcaagcattaccgcctgagctccgcctcctgtcagatcagctgtggcatccgcttctcataggagctgaaccctattatgaactgcatgagtgagggatctaggttgcatgctccttatgagaatctaactaatgcctgatgatccgagatggagcagtttcattccgaaaccatctgccatccatggaaaaactgtctttcatgaaaccagtccctggtgccaaaaaaaattagggaccagtgctctataggaaattgtgaggaactgaccgtagaatgatcctcttctcaccttgcaaccctcctctccagtcccagaggccaggacagttggcatttgtacccagtggtgtgggtttccaccagccctgctgcacctgtctggtagtccagtggaggagatgacaaaaagggacaatgtggctaacatctgcatgactgttcataagaaccataaacacgaggctgttcccactaccacgtgaaaggatagaggggcttggtgtgtgtagggcacagcttttctgaaaggcagaaggattctttttatgattttaccacgtatcatttccttttttttttttttgtattggaagtttactttctatcttgctttgcttttttaattgctttttttggcgctttaacaaaatggacaagtcgtgaggatttagacctctctgtcaagggggcagatgtttcttatgcttcattgccatgttaaggttctgatttgggtacttgtgtttgcaaacagatgggcttggggataagaggggacaggaaaagagtcaacatgcaaaagccttcagagtctagcacgtgcaaaagacagctgaactctgccatgtaaaactgagcaaatgccttgctgggagaagaaagaaaaagattgatgtgagagaaggtaccctgattttagttcctttgctgcagataatgacccaagcagactgaattcagacattgtcctagctgtcctaaaaaaaaaccctacaactttgttattatttgtattatcaatattaatatttaacattaaattttgtgtcaaattaaattttgatcaaattaagatcaaattaaaatttgatcttaggttagtaatctaggatcctcattgtataaatgagagaagaccacagaaaatgtgctttttgtttatgtgtgtgtttgcttgtttgagctcacacacttaattaagtggcagcagtgggaagtccagggctccagttcccattaacatgatcttacaaatgaagggacaaggacacacaggggagggacacacccaaggagcatcatgggccaagacagtgtcaagatgacacaggcttccacaccgtcaccaggctggggctttctgtgtggattcaagaaatttgtggtttttcttttcttttttttttttttttttcttgagacagagttttgctctgtcacccaggctggagtgcaatggcatgatcatgattcactacagcctcgacttcccacgttcaagggatcctcccatctcagccttcagagtagatgggactacaggcacgcacccaggcgcctggctaattttttattttttgtagagatggggtctcactatgttgcccaggctggtctggaattcctggactcaagtaatcctcccaccttaacctcacaaaatgctgggattataggcatgagccagcatgtctggcctgaaacttgtgctttcttaactccactcacacttaggagccaggcaaggaatgggatttctcctttgtgcttggaggaaatgagctcaggtctctgtaaagataacctcagctctgcaaaccaaaacgaagataagaataaatgcctgtccgccttcccccatacctgggggaactttgactctgtcggataatggatcttttgtcttaaaggaaggaatttcctctgcagccaagaacggttggcagtgcaggttgagacttgctgggttcaggaaccaagccttggggcagagaggctgcaggagctggggccggcttgcccaaggaatggctgagggtggcgggtgttttcgcacggggtggccacgcttctgcaaattgctccattttactcagcatcctttgctgtagagtgccggtgtgctgtcacagcaggctgaaaaatgcatctgacctgtttattctgccctccctgtgaggggctttttggcctgccatttttcactactcctggatagaaacaaaggaacacagtaagaggagaggagagaaatgagaagtttcttgccaaagccaagggaagctctggttccagaaaatgaggctggcactgggccagctgggttgatgttgcccttgaccgcctctttgtggccgattggggaatgtccccccagccgcacctggcccttatggcgtaatccagttgagcctggacgggaaataaaaaggaaaatgtgactcacagcaagtgcaaatgcagtctccctcccaggggccttgctcagcttagtctttgggaaactccccgcctgcctggccttatttaacacacagacgcacgggttcctgggataaacagtgctccccagagagccccggccatgagcagggtgtctaccagcacctgggtggcccagaagcacagctgcaactccatggggcctcagatatgccgactggatactttgagctgtaacccccctggaaacccgctgttgatgccatctggaagccctgggtgtcttttggcatctgtatgttgtcactttatctcaatccatagagttttaagttctctcatgaagccctgttgatcttgcctttatttaaaattttgatggtttatcatgaattttttttatcattttattttttaggagcaattttttaggtttgtaacaagatcgagcagaaagtacagacagttcccatacacccttggcctccacgcatgaacagcctcccccatgatcagcataccctactagagtggtacgtttgttacgatcaatgaaatgagaccgacacattgatatcacccagagtccatagtttacactggggttcactcttgctgttgtacattccatggatttggacaaagaggctgtcaagggcaacatcaacccagctggctcagtgtcgcccaggctggagtgcagtggaacgatctcggctcaccgcaatctctgtctcccgggttcacgccattctcctgcctcagcctcctgagtagctgggacgcaggtgcctgccaccatgcctggctaattttttagtatttttagtagagaccaggtttcaccatgttagccaggatggtctcgatctcctgacctcgtgatccgcctgccttggcctcctaaagtgctgggattactggcgtgagccaccacacccacctgctttttaaaagtattgcacaaagacattatttatcatgatcactgagcttttgggagacccttaaattttgcactggaggtatgcgtcttgttgacctcaccccagtgctggcccctcatgtaaccccaggagcatcagacactgttactgccagcccccagccacggggcctggagtaaggagagtgaggaaagcccagttcccggcctgtacactggcacgtggtgccacagtttgtcactggagtccttccccagctcaggcagcacagaaaggggagggctaggcaacttgagggtggagccaggacaagatggaatcctcacaccactccggctcctgagaggagaggaagccttccctcacttcagtctgcctgtgcctggagataaacctgcctgcctcttagtttctccacttgaataagtcctcatttctattgcttcagtgtatttgggggctgggagaaatgcaggaaggctgagcatggtgcatttcgcaaatggtgttaaaagacatgcaagagaaagtgtggggaacagtagctgtgttttggacccgtcttagacatcactggtgtctgtgtaatggtctccctcgggtgctgtcctgggatgcaaggtgtctacttctcatttgggagaagcattttgacattcagacagagccaagtgacagcaacacacaagtcctttctgaggcttagagcctagaaatttacaaagaagaaaggtaaagaaagaaattgatgggttcagcagcactgacttatcccaacgccaggttccaacaacctatcgtgtctaaatctgtacttccacagagtgatgggttccctgccctttcctctcatccagagcccagctgaaattcttttcagtggaatttatgccacttctcctttactctctcttcagtgaaaatagagaagaccaggagaaaggaagactaaaaagtaaagtgaaaaccgccttccaatagaatttggttgcagaaataatttccatgaaaaatggtcgggctgatattaggtctggagtcttaatgatggagtagtttccttttaatcatggtgctgtcttagaaatgcctgtctggaatgtgaccatgggcgggggttggtgtctggccactgcgtagtcggccttcggggaaagggtagccacaagatgttcccactcttctgtgagccctcaggaatttgaaaataagactcatgtgaaaacaggaacaacagcagcaacttcttgatgcagacagattcctttgttgaccatattctgaatgcatagctttagaaaagagacctcactgaccagcccggcagccagaggagttcccatttctgcaacaaactgcctctgaaacactcagactgaaaaagcaaaaatgatcttaagtggcataggaggattttagactggttagagggagaagttcctcagggggacgaattattgaatatctgtgtggctgttcttttattccaacatgattaactttgatgcttatcattccctatgggaatttaaggaaaagaaggctcataattgccagaatcttccatcctgtgtacatgcaaggctgagtaggaaatcagggcaaaggaattgatgaattgtctgtctctaaagatgaaaacaaagagggggcaacaactgtaagactaatgtgagactgtctgaatgtgaacagttatttcttgaatattcaaaaataaatctattttatttatttatttatttatttatttagagacagggtctttctctgttgcccaggctggagtacagtggcacaaacatagctcactgcagccttgaagtccctgactcaagcaatcctcccacctcatcctcctgagtagctgggactacaagtgcacaccaccatgcccagctaatttttctgtttttatttttttttagaaatggggtcttgctgtgttttctgctggtctcaaacacctggcctcaagtgatcctcccacattggcctcttaaaatgctgggattacaggcatgggccactgcacctggcccaaaagataaaagaattttaaacaaatgaaaagaagtattgctctgtagagtaagtgaaacatttatgaaatttgttttttctaagaccttgtagttattgaaaagtaatactgtaaaaacaaaaattcgcagaagggagtttcatagcaggtcaataagttcatggtcaggctcttaggctgctagcatagaaaatgtcagagcaggcagacacacaacaaaaaaagagaattttagaccaatatccctgatgaacattgatgcaaaaattctcagtaaaattctggcaaactgaatccagcagcacatcaaaaggcttatccaccaaaatcaagttggcttcatccctgggatgcaaggctggttcaacttacgcaaatcaataaacataatccatcatataaacagaaccaaagacaaaaaccacatgattatctcaatagatgcagaaaaggccttcgacaagattaaacagccttcatgctaaaaactttcaataaactaggtattgatgggacatatctcaaaataataagagctacttatgacaaacccacagccaatatcatactgaatgggcaaaaactggaagcattccctttgaaaactggtagaagacagggatgccctttctcactactcctattcaacatagtgttggaagttctggccagggcaatcaggcaagagaaagaaataaagggtattcaattaggaaaagaggaagtcaaattctccctgtttgcaggtgacatgactgtatatttaaaaacccccgttgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccacttctcaacgaaataaaagaggacacaaacaaatggaagaacattccatgctcatggataggaagagtcaatattgtgaaaatggccatactgcccaaggtaatttatagattcaatgccatccccatcaagctaccaatgactttcttcacagaattggaaaagactactttaaagttcatatggaaccaaaaaagaggctgtatagccaagacaatcctaagccaaaagaacaaagctggaggcatcacactacctgacttcaaactatactacaaggctacagtaaccaaaacagcatggtactggtaccaaaacagagatacagaccaatggaacagaacagagccctcagaaataataccacacatctacaactgtctgatctttgacaaacctgacaaaaacaagcaatggggaaaggattccctatttatttaataaatggtgccgggaaaactggctagccatatgtggaaagctgaaactggatcccttccttacagcttatacaaaaattaattcaagatgaattaaaggcttaaatgttagacctaaaaccgcaaaaaccctagaagaaaacctaggcaataccattcaggacagaggcatgggcaaagacttcatgactaaaacaccaaaagcaatggcaacaaaagccaaaattgacaaatgggatctaattaaactaaagagcttctgtacagcaaaagaaactaccatcagagtgaacaggcaacctacagaatgggagaaaatttttacaatctacccacctgacaaagggctaatatccagaatctacaaagaacttaaacaaatttacaagaaaaaatcaaactcttcaacaagcgggcgaaggatatgaacagacacttctcaaaagaagacatttatgcatccaacagacacatgaaaaaatgctcatcatcactggtcatcagagaaatgcaaatcaatccacaatgagataccatctcacaccagttagaatggcgatcattaaaaagtcaggaaacgacatgtgctggagaggatgtggagaaataggaacacttttacactgttggtgggactgtaaactagttcaaccattgtggaagacagtgtggtgattcctcaaggatctagaactagaaatagcatttgacccaaccatcccattactgggcatatatccaaaggattataaatcatgctgctataaacacacacacgtacgtttattgcagcactattcacaatagcaaagacttggaaccagcccaaacgtccatcaatgatagactggattaagaaaatgtggcacatatacaccatgtaatactatgtagccataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaatatcacacactggggcctgtggtggggtgggggaatgggggagggatagcattaggagatatacctaatgtaaatgatgagttaatgggtgtagcacaccaacatggcacatgtatacatatgtaacaaacctgcacgttgtgtacatgtaccctagaacttaaagtataataaaaaaaaaaaagaaagaaagaaaatacaacaacaaccacaacaacaaaatgtcagagcattctctctagcatcagaaccagcgccctggcctaagtagctgggagtgggtggttagggtgtctggctggaatcacccataccagtctcttcctagtgcacctgctgctaccactgaggctggaaagcagattctttctggaatatccaatgtgctgggttctggaaggtgagaagcaaggcagttgtggagacttgggttttttgttttgttttgttttgttttttttcagcattatttgccaagctcccagggcacggccaccagcttgatcgggttgagactgctggggcaggcatccatctctagtactgaagtgaaggtgaggcccaactctgcatctgtgctggcagcttccaatcaaggcagcatggctttggaatcacacctgaccagagtttaaggaagcttcctctttaccaaaccaggtctatagtcacccagttttactgtgaagattcagcccagtgattctgcaagccatttaataaatccattttttttaactggctgaaccagttcagttctctacaactgatctctgactgcacaggggcctaacttattatatttgtagatattgtagtgctgcctgttctgtgtgtttcaggaaataggacaagtgctggagggtataggttgatgacttctggaggcttggcagggagctgtaagtgtggttttcaaactatgttctagagaacatggaagttctatattataaatactgcaatttcatgtaagatctcatttgaaaaatgagctgatgctaaactggtaaaaaatacaataaaataaaaccgatacacacaataaaaattaaataggccagtagtatgggggaaaaaaggagggagggagggagggaaggaaggaaggaaggaaggaaggaaggaaggaaggaaggaaggaaggaaggaaaattatgaggaaatttcaaaagaaagggagaaagagagagggagggagggaaggaaggaaatgaataaatgtcctttatactcagcaggagtctttaaatactttaatttgccaaaacattctcttagttttctcgcacttgatgtaatgaatgtcctgagaggtagttttttaaaaaccgagtcaatctttaagtaaaacatttcaggctaagaattaaccattgtaaggaatatgtcaaaaatttcttcagtatagtgaagcatgttttgtgatacaagcatccccccagtttgtcctttatcaactaggattttcatatatgaggcttgctgaaaaaaggcagcgttgtccaggtttcctcacttggctcccaattcacccataagaaagaatgttcttgtaaaagatcatgtggattcatgatgcatttgtgcttactttaaaaaacaaagttggtcagatatccttaggaatctcttgtgattaaaattcctgggttgaaactctagaagagatttctcaaactttgaagcaattgtttagttaatatggacctgagagattctatgccttttaccaaaaaaaatatatcttctaggattactttgcagatgggacataggtaaaaaagcatggcctgaagtgaggagaagatgtgatgaatgacaaaggtgtcaaccctcaggcaccattattttagagggactttcagtgatcagggactatgaggaggaaacagtcttagcagtgagagaggtcttagagaagatttaggttctcctgtttctttctttctttctttttttttttttttttttttttttttgtgagacggagttttgctcttgtcacccaggctggagtgcagtggtgtgatctcaactcactgcaacctccacctctggggttcagcaattcttgtgcttcagcctcctaagtagctgggattacaggcaacggccaacacacctggttaatttttgtatttttaataaagacaaggtttcactatgttggccaagctggtctcgaactcctgacctcaggtgatccacccacctcagcctcccaaagtgatgggattacaggtgtgagccaccacacttggcctaggttctcctgtttctctttcttcctttgcagccaggctgttgttaaacctggagtataagtcacctttttataaagttaacctaagacttttcagtgctgaagatggagctatagggttaagtaactggaaaggtaacatatttccaaagccatttcagaaaatcagtcttggcgttaagttagagtgaactattccattctctctctgctatacccattgataccccatcctaacccagacacctagctgattttgttttcctgatgcgaaaaatactctaattcaaaaatgaaccctccatcaagtttcaaagacaacacagaagaaagtaggcaagttttatctatgatttatacctttctaaatccaaattagatttgatctggcttcatcaaaaccaataaaaatatcaaagaaccattaaaataagaattaatacaagtagctgttgggtaaaatatgtgttccagaaaaattaagataaagatgatggctgtaattgcagttaatattagaatataagacaaaagaagaaatgtaaggcattattacatggattgcattgtttaagatgaggtttataccagctcattagaaaaaaaaaaagttttaaggcattatcttccaacaactcttatatcttaatgtttttgacatctgattatctactaagcagttatatatcacagttgttttatgaaatgttttccatgtggctatatctttaccataaaacttcaaaatccaacaacacagtattaagtcatgcagtgagaaggccataacttagaatctatagatttccagggatctaatttaatacatggaaaaagttgatgtagtcttgataattgctttagccctcagatggttggtccttggctattagttgtcttagcaggttgggtaacttcagctgaagaggaatatttgagaggcagatcattgttgaagacttgaatggcaaaagagagttagaaaagtcatttctcccacagtgacaaaattccaaaatttttaatatgttccaataataccagctactactctacactttccccgggaatgacattggaaatttatggattcagatgctgtacttttagatgttctgcaatggtttggttggaacaagagatgagacattaggaaatgttacctgaactgtgtatgaggaaaaagattttgtttatcagcctcttttgtttccctttgccatgaaaactctatctaaaatctgttcaccatgccttactgttttcataaatgcaaaatatattacacacattatttttttttaattaaaagtttctggctgagtcaattttttttgaaagctaattttcagatatgatcctttaggtttatttaactcgatacaagttccccacatttttagcaccggcttttaaagaacagtctaaaaaatgttagaaataaaattaagacgcaagccagttttatggcatacacccaagtagaacttcatccttggtgttctcatcctagcagtggcctccagaaggctgcccgctgatgtccagaaactgagatttagggcagtttctcatatttctggctcagtcgaggaacatgggaaggtacacgttctgcattgctggagggtagattatgtcttcttaggcagaggagttagtgaaaggtcctggtctactggcatccagatttcacaagttagctctgtggtatggatttgaaactaagcaggcccctgtctggagatgaggttctgtctggagcagggaggagccagactttccatccaggaaagctgctttcatgcaggacagcaggcgagagcccccaggcaccaccatgacgctcttcggtttcttgtgattctgagtcactctcttgggggctgttaagggaggaattgtgcctaccctctcccaaattcatatgttgaagtcctaactcctaatacttcagcatgtggctgtatttggaggtaggaacttcggagaggtgattatgttaaaatgaggtcataagtgtaggtcttaatccgatatgactggtgtccttacaagaagaacagatttggatatagacgtgtacagagagaagaccatgtgaagacataagaaaaagacagctatctacaagccagggagagaggcttcagaaggaacccacacagctgacaccttgatcaaaataactctgttgtttaagccccttagcacagccccacgtacttaattgtggcagcctgaacaaatgagtacggggactcctgtcttcttctttcgtcctgtctcctttgaggggaatgtcaggcttatgacagttgtcacaaacatattgtgtgtctttcttcaagacattaaaattgtgtttgtcaagctttccattcactttaatttgttttcatttcagcacatcagcttggtttcttagcattccaaggggaaagtttaaaacctttttgcatatagactccatttgcacggctacttttcttttcggcgattctcaagccccatcctcaaattcagcccgtggaagttgtttgacatctaactgagttaactgcatcctatcaagcgaagctcctattttcagcctgctgagtttggctactcaaaagttggttaatgtcattaaaaatgatattcccaccaacttttcatttgcagaatttgctaaggtgttaattggctttcagacatccctggctaaacatctccctataatataaagctaaacatgataaaaataaattacttgttttcccctctctttctgccccaagttttgcccactctcgggttttgttttgtttttttttaatctccattcatgtgtttattaagaatcgatttggtttctggcactgctaaaggtgccatgatgagttattttaaaaacatatacaatctggttcttgtatttaaggaattttcagtataactaaagacacatggtaactatgtaaggactgactttaaaatatccataaatcaaagacttcccggatgaagctctgattacacccagccaccccggactcctggctgttccagcagtctcgcccagcacctacatccctgccgctctctgctttgattcaccccacaaacgccagtttcccatacccacatctagacctctgcccatcagagagccctccactgggtaaaatattaatagcacccctgctgccggtctctgtctccttacctgctgcattctagtttcatgatgcttctttaacagaacagtgattctcagactttagcaggagacgtgttaaagcgcaggtttctagccctacctcctgagtttctgattcagtaggtctagggtgggacctcataatttgcatttctcacaatttcccaggtgacatggatgctgcaggtcaggggaccactgattgagggtgagacatgccctcagaaagaatgaaatggttatttcagtgaccaccatcaccacataagggcatgtgaatcagtccccagtggagaatagaaagttgtcattttacattggcaggaaaacatagaggcccttgcagggaggacctctcccccattctttgctgttcttatttttgatccctacttgatctctgaatcacctcatctgccacctctttcccctgctggacacccttagactcaacatctgacctccgccctgttgctccggtcttggagggtaatcttttcttatgcctttgtgccactctgcacatacatcccaagttacttcattcaaggatttcccacaccagtgtcctgcccttctcctgccccagggacactctggctccaaccatggtcagtttagcaaccagatgttgatatcattcatggtgtggacgaggcaaaggaccagtgcttaaggccagtgcacctgagaatgtccctggaaaagaaagttcccttggaacaagatgctctatgctttgattcagtaattggcctttcttgattctagggctaggcacgttcttgtgcttccatttggttcataaaaggaaccacataatgtaggagcctttttttaagagacagagtcctgctctgtcacccaggctggagttcggtggtgcagtcatagttctacagcctcaatctcctgggctcaagcaagcctcccacctcagcctctcaagtagctgggactataggtgtgtactatcaattacacttggctattttgttgttgttgttaattttgtagggacgggggtctcacgattagcccaggctggtctcaagcttcaggtggtcatctacctcagcctccaaaactgctggaattacaggcatgaaccaccaagcccagcctataggagccttcttaagagtaaaaactcaattaaaactacataccaatgccagcaatgattcttttaagaaatgcttaccggccaggcgtggtggctcacccctgtaatcacagcactttgggagactgaggtgggtggatcacctgaggtcaggagttcgagaccagcctggccaacatggtgaaaccctctctctactaaaaatacaaaaattagacaggtgtggtggcaggcacctgtaatcccaactagtcgggaggctgtggcaggagaatcacttgagcccgggaagcggaggttgcagagagcagagattgcgccattgcactccagcctgggcgacagagtgagactctgtctcaaaaaaaagagaaaaaagaaaaaaaatgctcaccaagtatctaccaggcaatcttaataaaacagccacaaacctctggcttctggagcttctgttctgttggaggaggcagctgataaagaaataaaatatataatagatggtataagtgctatggagaaaaataaagcaggagaagggatacagagagcgctgaagacatgaagatgggagagttgtaattttatgaaagatggacagggggagcctcactgagaaggcagccttcgagccatgacctggagcatgtgaagatgtaagccatgcagatatctgggggaagagagttccaggcagaggaacagtcaatgcaaaagcccgagaaagagcatgcctggagcattcaaggaacagcaaaaaggccactatgatcggaatgatgtcagaaaggtaacaggccaaatattggatggcttttgcaaaacaaacactctggctccactggcaacattggaaagagaatgtctgcttcattgcagaggtaggatcagtggcgccacttcagatttaaagactattctggctactgggtttggaacagactaaaggcagtgtggacaggagctgggagaccagttaggagtcttgcaataatccaggaagatgggagtgttagcagagtgagcagggaaaagaatctgggttctgtagatgctttgaaatgagattaaggttggtttctgccatccaggagtttgtgttctgatggagaaggcatagatgtaagaaactctttttttttttttttttttttgagacggagtctcactctgtcacccaggctggagtgcaatggtgccatcttggctcactgcaacctcatacctcctgggttcaagcaattctcctgtctacaggcatgcagcaccacacccggctaatttttgtatttttaatagagacaggatttcactatgttggccaggctggtctcgaactcctgacctcgcgatccacccggcttggcctcccaaagtgctgggattacaggcgtgaaccactgtgcctggctgatgtaagaaactcttaaccgaggatatgatgcaaacatcaccatagtagctaacatttgctaagcactcattctatgctaggcggtatctaacacaccaaccagcaaagccaagattggaacccaagcagccttgtctgtagaacctacatacttaaccactacaatgtacgaaaaagtaaaaacgacaaagatcttatctggataactgggagagtttttaatgaaaagtagcatttgatttgggttttgaaggatgactagaaattgacagtttgaaaagggggaaggtctcttatgagagcagtgactataataataagattccactaataaccatgtagtgatcacttgaacattccagcaatgaagctggagccacagaggtgtatttctctctacagcagttattccatcctatccagtgccattcacacctgtagctacagctgttcccacaaccccacccccaataaagagggcactgagtgtacccggaagcagccagtagagtaatcaggatcatctcatctgggttcctttacttaccttgtctgtgacattgggcaagttaatcaatctctgagccatttctgtaaatacctacctcacagagtacagttgacccttgaacaacacagggattaggggcgctgactccccatgcagttggaaattcacatatagcttttgactcccccaaaacttaactactaatagcctaccattgagcagaaggcttgccaataacataagtagtcaattaacacatattcgtatgttctatgtattctatactgtatttttaccataaagtaagctatagaaaagaaaatcttattaagataatcattaagagaaactactatttatttagtggaagtgggtcatcattaagctcttcatccccatcatcttcacattgaataaagctgaagaagaggaggaggggttggtcttgctgtctgaggggtagcagaagcaaaaggaaatccacatactgttaagaatggcaaatatccgacttattggtggcaaatatgtacaggtctgcagcaatctcaattcttgcctcctcagaagaaacaatttgactgaggggcctaaggcagaaaaagaaaccaaggcaagtttcagggcaggagtggaagtttgttagaaagctttagaacaggaaagaaaggaaagtacacttggaagagacccaagcaggcaccttggagctcaagtgtggcatttttatatatcgacatatttcaggggtcttgtgtcctttttcccatgattctttcctctggatgggccgcccgcatgcacagtgacctgctaacacttaagagttgagcgtgcacagtgtgtttactgcagttgtacacatgcccacctgaggcattcttcccttttccagtggcatgcccccagaagatcatgctttgccattttgtctctaaatgtgcaaaccaaagtctagtggcccaatttctgagctgccagttaccaatttcaagtgtttttatttatagggaaactgcctttccctggtactggctgcgaccaattattattttagagagaccattaacaactacctgaccatcacctgatggttgcctgactttcctggtagggttggagggagccctctcctgccccgctcatgcctgactagctgcctaccataataatagaagtggacccacacagctcaaactgtattgttcacaggtcaactgtagttgtacatagccagtgagatcatataggtcatgttcttaatacactgcctgatatatagtaagtactctgtaaattagctgatggtcatagcgatgaactgaggtttttttcttaatgtctattgcattctaaggtaggacattacaaatttcatttagaaatatttacatcataatggttaaaattaagacatttctcatttgtgacgtactcacttttaacttattctttttaccgatgatgttaactcaaacctcatctctttcccaattcaaaaaaatgctctatcattgtcctttcacatcgtgtttcatttgctaagttcatgagttattttataataattaacattttagattggtcagctgaattctgatagtctttattctcattggtaacatgtcactgagttatattttaggttatcttagatcccatctctaaattctaatggccactctgtgttgcactgttcttttcaattctgtctttcagttcctgggtccatcagatctaagaatgtgactgaggtattccagcatggagagagttaatgtgaggttgaatgtggataatgcttcagaaagagtccaaaaaatacagaaattatgctaataggaaagaatgagtatcagaagatttctagcaatatagcagcatgagggatcttagatgctaactgtaccccttgtcaccacaaacacgtagcgacccaggatgaaatataataataacaaaaaaataataataatacatggcaagtttgaaagcgatgaaaggaaatctccagattccaaaagtgaagaagaatatcaaagtggaaatcaccatggacatggatatttcagagatgggtaccatgtctttgaactaggactttgctacttaacatagcaacaggaaaatgaacagatagatggactaatcgcccctgcgtaaatagcctagaggttcaaataactgatcatttattttttaaaaatgggtagatagaactctaatcacatcccaggaaagcagcaaagaggtttgcctctgacctgagaattggggcagaaaaaaaaattatctgggagaaacaaaagccctagacaggaaccgtgcacagggatgaagcctggacttatactacctgacctgcattttggggacttcccacagtatatcagtcaggataggctagttaatgctgcagtaacaattcccaaatctcaacagcacttatcacaaccactgtttatttcttgcttaagttgcttgcccagtgcagcttggcaagaggtcctgcctgtcatagccacccagggtccccatgctgatggaagccccatctcaacatgtcacagaagcaggataaagggagcataacaaatcttggctcttaaagcttctgcaagaagtgatgctttggttaaaagaagccacagatccatgcttacctccaaaggggacaaggaagtgcaatccaacaatggacctggaatatttgtgaacaatactagagacaatcacaccaagcctatacattaacctaaaagtaatcaggatcattgaaatccctagtccagagtattcagctgaagagagaaatagtcaaccagaatataaatatgaggaaatctcacaatctgaggagagaaaacatgaaagaccaacttagagacaggatcaagcaaccagggccacctatgtctgagaggaattctggaagataaggctagaaaaaaattggggaaagacaatagtggatgagagaatagatgagaatttttctagaattgaagacaaacctgagacttaagattgaaaaataacacaaaattccaagcaagaaacatacacacacacacacacacacacacacacacacacacaggcccactttggagaaactgcaaaacatcaaagatcaaaagaaaattttaaaagcagctggagagaaatgacaggttacttacaaagaaaagaaaacttaataccagcatgcttttataagccaagaagtcagaaagcaagagtaatagcttcaaaatccaagggaaagaagttaccatcaaccaatatatatatatatatatatttttatccagcaaaattctttatttgagagtgagggcaaaaagagcctactttaagataaacaagattaggagtatttaccattcacagactcactgaaagtactattaccatatgtatttcacacaaaaatccttaatacattataagcaaatcagattcatcaaggtgtaaaagcaataatacatcacaaccaagcgaggtttattccaggtatgcacggctggttcaatatttgaaaatttataaagtaatccaccatatgaacaggctgaagaaggagaatcatatgatcatgttaattgacagttaaaaatatttgataaaatctaacaacaattcatgattaaaaaaacacaaaactcccagcaaactaggaatagaggtgaactttctcacttcataaagagcatctaccagaaacctacagccaacatcatactttccctctaagatagggaacagccaggagtgtctgatcttaccactcttaacataattctggacatggtagccactgcaataggcaggaaaaagaaataaaaggcatgtagtttgggaagtaagaaataaaactgtctctgtttgcagatgacattatctacataggaaatccaatgaatgcaccaaaacaactctcctagaagtaatgagtgagttcaagatcaacatacaaaatctattgcatttctatatactaagaatgagcaaatggaagccaaaataaaaaacacagtaccatttacagttgctccagagaacatgaaatacttaggtatacataaaacaaaacatgtatatgatctgtatgttgaaaattacaatatgctgttgaaagaagtcaaagacctaataactgaagagactattttcatagataggaagattcagccaaatgaagatgtcactgctctcccaaaagatctataggtttaaaaatattcctataaaaaccacagcaagttttttttgtaaacataaacaagcttgttctaaaatttatataaaaaggcaaacgagtggtcaggcgcagtgactcacgcctgtaatcccagcactttgggaggccaaggcgggcggatcacgaggtcaggaggtcgagaccatcctggctaacacggtgaaaccctgtctctactaaaaaatacacaaaaaattagccgggcgtattggtgggcgcctgtagtcccaactactcaggaggctgaggcagtagaatggcgtgaacccgggaggcggagcttgcagtgagccgagatcgcgccactgcactccagcctgggtgacaaggcaagactccctctcaaaaaaacaaaaaacaaaacaaaaaaaaaaaaaaggcaaaggagtttgaatagctaaaactattttgacaaagaaaaatgaagtgggaggaattattccaccagatttttaggctgcttatagagctacaacaatcaggactttgtagtattggcagacacataggtcaatgaaacagaataaagaacccaaaatagaaccacccaaatacgcccacttggtcttttacaaaatttaagagttctttatatattctagatactggtccttcatcaaatgtggtttacaaatatttcctttcagtctgtagcttgtcttttcatcctctgaaggagatccagtctgggcacgatggctcatgcctgtaatcccagcactttgggaggctgatgtgggaggatcacttgaggtcaggagttggagaccagcctggccaagtgaaaaagcaattcaatggaggaacaatagcttttttagcatatggtactgaagaaatgggatctcccctcaaaaacttcaacctgagtctcacacttaatacaaaaaaaactcaaaatagatcataaacttgaatgtaaaatggaaaaccatacaacttttagataaaaagcagaaggtattattcaggaactgtagcattgtgaagatttcttagacgtgacagcagaaacatgttccataaaaggaaaagttgataattggatcttattttattctatttatttattattattattattttgttttgacacaaagttttgctcttgttgcccaggctggagtgcaatggtgcaatctcagctcactgcaacctctgccacccgggttcgagcaattcttctgcctcagcctcctgaatagctgggattacagacatgtgccaccacaccttgctaatttttgtatttttagtagagacggggtttcaccatcttggccaggctgttctcgaactcctgacctcaagtgatcctcccgcctcagcctcccaaagtgctgggattacaggcatgagccatcttgcccagcctggatctccttaacaggatggaaagacaagctacagactgagaggaaatatttgtaaaccacatctgatgaaggaccagtatctagaatatataaagaactcttaaaactcaatagtgaaaaatcaagcaatccaattagaaattggatgaactacagaaagagacatttcactaaagaggaggtacagatggtaaataagcacatgaaaagatgttcaacatcattagcctttagaaaaatgcaaattaaaaccacagtgaggtagcactacccatgcatcagtatagttcaaataaaaaaaatagagataacacccaatgcgggcagagattcagagaaactggatcacttatacattgctggtggaaatgtaaaatggaatagccacgctagaaagtagttttgcagttccttttattcattttttattttttgagacagggtctccctctgttgcccaggttggagtacagcggcgtaatcacagttccaccatagcccccatctcccaggctcaggtgatcctcccacctcaacttcctgactagctgggactaaaggagcacgccaccatgcccagctaattttttgtatttattttagacacagggtttcaccatgctacgcaggctggtctcgaactctggggtcaagcgaggagcctcccgctttggcctcccaaagtgctgagattaaggcatgagccactgagcccacccctacagttccttttaaaactaaaagtgggccgggtgcggtggcttatgcctgtaatctcagcactctgggaggccaaggtgggcacatcacaaggtcgggagatggagaccctcctggccaacatggtgaaaccctgtctctactaaaaatacaaaaatcagccaggcatggtggtgtgtgcctataatcccagctactcgggaggctgagacaggagaatctcttgaacccgggaggcagaggttgcagtgagctgagatcacaccactgcactccagggtgggcaacagaatgagactctgtctcaaaaaaaaaaaaaaaaaaaaaaaaaaactgaaaatggacttgccatgggacccagcaactgcagtcttttgcatttatctcagacaaatgaaaactgttttcacccagaaacttgtacatgaatattactagcagctttgtttgtaagagccaaaagctagaaactacccacatgtctgtccttcagtgggtgaatagttcaactacgatacatgcataccatggaatactactctgcaacaagggacaaactgtcgatacacaatgacttggatttatgctcagtgaggaaaaaagaaaaaagccagtctctaaagtttacatactgtaccattccactgatacaaaacattgttgagataaaattatagagatgcagaacggattagtagatgccagggactggggatgtaggtgggagagaggagtttgaatacagaggggtagcacttgggggcctagttatgatggtacaattatcttaattgtgttagtagttacacacagctatacatgtgataaaatcgtatagagcaacataaaattaataacaaatacatacacacatacaaatacatgtgtatgtgtatcaacctgaataagctctgtgggttgcagcaatgccagtgacccagttttgttattgccctatagttatataattgggggagggagggcaaagagtgcctgcgacctccctgtacatttctttgcaactttcttattataatttttttcaaaataaaaatacatatacttctctaagaaggataataaacctagaaggaaaaactgaaatgtgagaagtaatggtgagaaaataaattagtaaacatgtttttggaaaacctaaatgagcataaatcctaataaatcatgtaagggggttaaaagtaaggcaaaataaaaatacctggcagaaacaataaaagaccagagagagtgatcagaatgaaagcatcctaaaagtcctcctattttctagaaggagactgatagccatatacttgaaatatttttatgattaaaaggcagaatggtatctaaacctacgatgctattttgatatgaggtgtcatttactgagcatctgccctgtgtctggaaacctgctaacatcacagtctctattataattctgaaaggaagtagctttttcctctttttattgaagagaaacaaatgccaaacagggggtgaataaagtacaagttagagcggtaagtggtaaagtcaatatttgaacccagggctctctatctcctaagcatatgtgcttttaacctccctgtcccctcttgagcataatgaatatggaaataatgcattttctaaaaggaatgctgcagtgttttgaaggtgaagtagtcttacattttatagaatgaaatatgaaatcatctccaaactatgggcacaacagaaagctttcctatcttccctttttatttgatttcattgaccaaagtgtggacaaaactgattacaaaatagaaggctttcacatcttccctttcctttcatatcagctccaaacagtcattgtgaagccatgtgtcccaggaacccatcattcaatgagttgtgctacttggaagaatgacgagcaacaattcacattcagatttggtgttttcttcatcaagctataagcatagaaatgaaatttttgacattgtcccatatggatgagaaaagaaaaagtggtattttgaagatcaaagaaaaccacaaatctatggatgtcctatatgtaaatcttgtttctgtttctcctgatgctaaaatgttgaattctaaatatgcaaaggtacattcacacacaaacacacacacacacacacacacacacaccatacaggatgaacacacacattgctaatgggtcctagaaaaaggtgctagggcttagttgcacatgtttgttgacaggttaaaataaaagaaacctgaacacgcccctctgggtctatcagtctttttctccttttagctaaagctctccagtttatacaattgaaaagagggagtacttttatcttacctgaaacattatgcagccaaagcttctatttactgactcataaaggattttatgcctcatctgttgtacttaagatgactatagagaatataccagaaaaaagatttgaaatgtgttgccttctgaagttagaattataatcaggtgtattattgaacaatcctactttccttaatgtgtacagatttcagcattggcaggaagtattgaagtaaacccaaacacagcattaagcaaaatgtagcctcaaactctaaaaacatgtacaattgccactcctctgtgtgaagacttcagaatgattttgcccaactctttcataatagtttcatctgatgaaacaacaaaagcacctgtcactgggtgagcgcagagccttctataaaaacatcaggaacattctgatcccagaactaccatcgcagctctgtcatggaataagccagagagaccctgggcagatctcttctcctttctagaccttaattttctccatctataaaatcctgacacatttcccaagaagtctgagaggaagattggctttatagaaatggttctgaacagcaggatgtctcgtagcaatgtttaatcgttggtgatgataacatgggagactatttactttgtgtccttgatgaagatacgtgtgtgtgtgtgtgtgtgtgtgtgtgtgcgtgcgtgtgcgtgcgcgtgcgcatgtgatgaagtctcactctgttgccccggctggagtataatagtaccatcatagctcactgaagcttcaaaatcctgggttcaagcaatcctcctgcctcagcctcccaagtagctgggaccagagattcacaccatcaagctcaactgattttttcatttctatttttattttttgtagagatgggttctgattttgttgcccaggctggtttcaaactcctggcctcaagtgatccccccacctcagcctcctaaaatcttagaatgatagggtgtgagcccccacgcccagccaatagctattctttcaccaagataaaaccaaaggcaaagtatcagaaagaagaaactcatcaaaacgaaggcagacatggccataatattctaaaatgttcatgtcccattccattttagagttagtgttttcgaaagcgtgaccttgatggcagtccttaactgccattcctatggccatggtcatgaagagtggcctggtagccccaccttatccaggcggacccgtgaaaagcgtccacttgtatattggtttgtcgtgttcttaacaaaaaaataaagaggtttctgaattttttggtttaagaccctaagttttacatgaatggccaatataacatatttctcaattttgttattggtctaggttcatcttgagcaaaatattatttatatattaattttgagaggtcatatagcatgtggttaacagcatagactctaaagccagacagcctgggatcatgtcccagctccatcatctgccattgtgtgatgctggtcaaatcatccaactactctttgctccagtttcctcatcagtaaatggatataaaaataggacctacttcatagtattgctgtgaggattacattagttaattgtgcagtatagtgcctgaaccataacaaacacttcataagttgggggtatttttgtttttaagcatttcataaaaccaatgtgggaaaataaatcatgagctatcaacccaccctccgaatgtatatagatcctgaccacttcttacatcccctactcctaatccaccaccacctcttgctgggacttgtgcagtagccacctaactggttcccctcttatcacgagcagtctccacagggcaacccaagtagttgttccaactcctgagtcacatcacacctttcctctattcaatatactgcgtggcccatcatttcattcagaataaaagagtacaagccttggctcatcccctgccaccctcctctcacctctctgctccaattcctggcatcttggcagcttctttaataacctagtttattggcaacaacctcaaggcctttgtactttctgttcttttttgcctgatatgttcttctcctagatgtctgtgggagagtggcttctccctcatcaatctttattcaaacaccatcttatctgaagaagggctctctggccacaatctctgaaatatcctttccttccctgttaaatttatctctaacctgccttatttccctatagaggactaatagccacctgatatagtatacgctcattcttaaactgacatatgacctgtctcttgctaaccagcatcggtggtccatgacagcaactatcttgttttgttcactgctgttttacaagctcctagtatggtgcctgcacatagtagatgctcaataaatatgtgttgcattagttaatgaactggcgtggatgatacagtagtttatattggactttcgaagcacttttacatacacagtcttatttgatccttggaaataagaatcacagggggacagattttttttcttgcccctacacctacaaagattggctcagatcccaaaggggcttccattttttccaaaaccaagtaccctgacaccactttacttttgtacttatgtcaaatattactattttatttgactgagtttaagttgcatcatttaatgtactcttgagataagcaacagcatggatgtatctcaagataatgatgcagaatgaaagaagccagaccaaaagagtatatactgtctgatttcatttcttcaaaattctagggaatgcaaattaatttatagtgacagaaagcagatcagtaattgctcaggggctggaggaagggattacaaatggcccaaaggaacattttagggtgatgcagatagtcattatcttcattttggtgatcgtttcataagtatatccatatatcaaaacttaccaaattgtacactttagatgtgtgcagttttttaaaattttttatttccataggtttctggggaacaggtagtatttggttacatgagtaagttctttaatggtgacttgtgagattttcgtgcacccatcacctgagccatttcactgaacccaatttgcagtcttttattccctcacccctctcccaccctttcccctgagtccccagagtccactctatcattcttatgcctttaagtcctcatagctcagctcccatttatgagtgagagcatacgatgtttggttttccattcctgagttacttcacttagaataatagtatccagtgccatccaggttgctgcaaatgccattaatttcttcctttttatgtgatattccatcatatatatatcacaatttcttttcttttcttttctttttcttttttctttttttttttttttttgagacagggtctcattctgtcgcccaggctgaagtacagtggtgtgatcttgactcactgtaacctccgcctcccgggttcaagcgattctcctgcctcagcctcctgagtagctgcaattacaggcacccgccaccacgcccagctaattttgtatttttagtagagacagggtttcaccatgttggccaggctggtctcgaactcccaacctcaggcaatccgcccgccttggcctcccaaagtgctgggattacaggtgtgagtcaccatgcctggcctataccacagtttctttatccattcattgattgatgggcatttatgtaatttattgtacattattttgcctaataaaactgttttgaaaacagagagataccttgcccaaggtcacacacatttttctgcaaatcttgactgcagtccatgtctgtggattcctggtatgtccttctgcttcctgtgttgcttaccaggtgggtaatgaggctcagggttttaacagtaatgatacccatttacaataacatttatttatgtattgctctgtgctgaaaggagaactttgattttacactttgaaggtgttctctatcacttttctaaggctctatctcttaaatttagtgaaaatcaagtagccaacattgattggatagtatttgaggaactgcaggttaatagcacttttatatgaacaaattgagagaatttaaatgatttgaccgaggtcatcaagaacagcagctttggcacaggaattagaaactggattgcccttgcattttgtttttcagcataaaagctacatttctgttctctccattctttatgggcaaattgtaactctttttccccccaaagtacctaaaataatctgtttctcacagtccttcgtgcgtgtcttctttttctcgcttgtgaataaggtgtactaaatgcctcccagcacacacaggactcagtgttatgttctttttttcctctcaattcaccgtgtaagagaggcaccacctattaaaaacaatatccacagacctgaagtcagcaaagatatcagaatgtactgtgcatgtcagattagggctgaaattccaactatagtgtttaaatggggactcattttaattaataaatttggtcctgacatgcaattgctcttcacttgatcaatattttgctattcagttggacaggtttttttttaatttactgctgtgtgtgactgagttcctacttaatattcattgacacaaaaggattcaaagagaagtcagcctaactctcaagtaaacagaatagaacagatatacatgtgttttgcaattgcaaggaaggtatactaattttgagatacttgagatttggggctttaaaaataattaatggatctttatagttcagctttacatttattggtttatcccttttattgtacttacattcccaagacccttggttgattattttacaattgtgattttaaatgcattttgatactaactgctacttacaggatatacttggtgaattctttcacatattaacattactctctggtttatctattatgagaaagtgtgtgtttgtgtatgcatgtgtgtgtgtacatatacacacagatatataaattttcttaaattgagacatccttttctattatatttgcaagtatcactaaagaatctgagtcacacctattctggcagagagaaagaaaacaacggaaaattaaagctccaacatgacttttttttttcattcgtgtcatggctctcatctaattgaacactagtatgtttccttgggtcttgctgtaaacattgaaaacttttagttttctttggattttggagactagatacgatcagtaggaaatcgctaatgggaattgatgcttttgattccagccaagcataccaccgaggtcacagaggtaacatccaactcgtacacaaaacatgccttataaaactagagcatcgccgagggtgggttagtaacatctgcagaggaacagccctacctgtgctgccagaatcatcagtgtaaccaaaagttgttgtgtttgcagaattctaaaagaaagatcccgtgtgatttttatgtttgttataattttccattaagattgtgagaatatcacaaaaatgtttggtccaaaaaaaaaaaagagaagaaatctgaatcttctaaaaatatttctattattactggtggcattcgagccatgtctcatctgacttgcttgtcagtcttcagcaatcatttgggactatttcgagattggatgacctcatgtttcagctttaatgccacattccccctcaagctactggcctatgttgacaaaatgactagatgactagaaagggattatctaaaagcactgtttccagttcttctcctgtcatttctcttggacccatccattgatgccttcaatccctccactccacagaactcgggtccaggtcacagatgattccatgggttaaccagtgcttgcttctcttgactgccaacacatcacatggtagaccatgtcccatccttaagacacacccgtctcttggcttcctggacatctcttccatctcacaagcttccttatgacctcactggctggtcctcctgggtctcctttgttggttgcatctcattttctcatccatagacactggcttctgccctagacctcattgcttctctatattcatgccatcggtgtgaatggatcctgccgcatggtgccaaatatcagctataggatgatgaccgctgtagcctggatgtgtcctctgaaatacagattaatagttcagatcatctacttgacatctcaacctcaacaagtccaaaaaatgaacttcttatttcctccaataaaactatctcctcccacagttttccccatctcaataaattgtaaccctgttatgctagttgctctcaacaaaaccctttgcatctttactcatctttcgatctcatttcatatctaatctgatgagaaatctcattcactcttcttccaaaatatatgcacaaatccagccacttctcaccatctctatctaaccctgcactcaggtccaacccaccataatcactttcctggattattgccttaactcctggtggtctcttgagtttagtccttgtcccttgtagttaattctttttgagatggactctcgctctgtcacccaggctggagtgcagtggcatgatctcagctcactgcaacctccacctcctgggtttaagtgattctcctgtctcagcctcccgagtagctgggactacaggcccagctaatttttgtatttttagtagagacagggtttcaccatattggtcaggctggtctcctactcctgacctcaggtgatccacctgccttggcttcccaaagtgctaggattacaggcatgagccaccacgcccagccccgtagttaatttttaacagagcagccctagccattgacctcatcttgtcacacctctgctcataatcctctgttgccttgcagctcaatcaagagcacaagggcctccaccatgtgatcacctaccacctttctaacctcttctcattccatttctcatctcactcatttccctccaaacacagtagctctctgctgtttctggagcacatccagcatacttttgtctcaagaaaacttgcttttccctttgcctccttcccccagatatctacaagtctcgcttccacacttcttccaaatatcttcacatcagcaggatgtgcaactactatgaataaaatagcaatccgcccacttccaccccactgctctctagtccccacaccctgttttgtctttttccctgtgtcttggcacactctacacttacttgtttatgagtttagtgtctatctacatcaatagaagctatgatctctgagcttaccatcgtatcccctccttttagaagactgaggtacatggtggtattcaaaaaatatttctagagtaaatgaaatccatcttttaccatacccattttgtttaagtgtgaagtttaatgcaatactgtttctctgtaaatctaaaacagtcctaagtttcatcaacagttctctattcctaaagaatttatttaaggatcaagataatagtccagtctgctttgctttagttgttcctccttgcataagtatgccacataggttgaattatcttgtcctgtggaaaggggacacagactattatcctcccttttgttatgcttgttatataagcataatgtttacatatgagctgaattgctactatagaaggtaaagctgacagaatgcacagatgctggtaagggaagcagattccttccacctggggtaggtgctcaacttgtttaatgcatgttatgattggggtagctcagtatgatgactttgcttgataagttcctcaggtaacaaagcagatgggagggggtacttatagggttgattgcttttttcccagtgccttgagttggaaagccaacaattgtcgttttgatcatgaggcatttagggggacttctacctctgtatgtaatggggagagaaaggtgatttatggtgaatctggaagcaggagttgtattttacaggtggtgatgggaagatctggggacatggacccatcggaggatgggcaccttgtccttgcggactcgccccacccaccactctcagagctgttcaaatggggccctgcatggtttcgccaccctcagacatttgttctttattgtgtgatcttgtggttgagaacagaagtgactcttaaaaggcagcgccagaacttcaaaaggaaatgtctaggaggaagtagccatgtgtgatgcctcttaaatgcctctttagaaggtatcagaggagaacaaaagataaaggtacaaccaaaaagtcttctggagttttttaagggcggattggaaagctaggtttgtgaagcccagccttggagatttaagtcatgggaatgactgtccccaagatggctgctcttaaagtccctgcatggttggaggcccggcagtctggagcagcatggtagcctgatctctctctttttttttttttttttttttgagatagagtctttctgttgtcacccaggttggagcacagtggagtgatctcggctcactacaacctccacctcccaggttcaagcgattctcctgcctcagcctcctgaatagctgggattataggcacctgccaccatgcccggttaatttttgtagttttagtagagacaggatttcaccttgttggccaggctggtctcgaactcctgacctcaggtaatccacccaccttggtctcccaaagtgctgggattacagtcatgagccaccacacccagccacttgatatcttgttaccctccttgcacctgtacttccactagcagtgactcttctttcccacttgctcttggggaaaaaaaaaagcatataaagatacactttacagactttacaaacattagataagccttacaaacacattgtaaaaacccccttccctaccagaacacaagccaccaaatgacctagatctgaacatgaggccaacagatcggtctcaacccccttccgcctttgcttgagactcacacactcttgcacactcacacacaagactgtgatctgagcactcatccccagccttagagaattgggcccttttcagtgccatctctctggaccctcaaaagcagtagctccctcaggaacccctttattgctctggccagggctgagagaaggacattccagttctcccacaggggcagggtgtgtaaaggcagaagacacagacaaggctgccagcagatccacaccctgtggcgtgggcctgaggacgtgggaggagctgtgctgggaacagcagggagacccagggaggggagtgggcagagagccagggactagcctaggaagggatgatccggctggctgctggcttcaggctgcagtcaggctggatttgcctgagagtgtccccagggcagctgtaccctgttacaagggaggaaacttttctaacagccctaggaaagcctattgaaagctttcagtagtgaaccagagactgaacaaataacgacgtaattattacataacagtaacaggaaaactttagagcgtaaatggtaacaaaagttgttccccaatatataaactttggataccctaaaagcagctcagcgtgactcagtttttgctactagcataaaaccaaaaataatcagatccctgcagaagtagagggtactcaggtatccacctccatagcactacttaagaaataaaaataaaataacctgttcatagagtggacagcacaacttgaatgccaaaaggcagagaaggttctgttcctggctttgatgctgacgcttgggaaacaccccttgtctttctgcatcacacacaagcctgcctggggcaagaatccagaggcttgtatatgcccatgtctaaatatttttaaaggtataaatcaagctaacaaactattagataaaatgtgttctatcctcatactttgacaaatttaccttcacgatgaccgaggatgccagatttgattttagacttctctgagccctcacagttgtgggctggatcatgtgatcaggaagggtcccccccacatcccagcctgcagcaagccatcttccctcctcttcatcctccctccagctcccttccgctttgcaaggaggctcaggcacacgtgagtgattttcctcaactacacgggcaggttccctccatgtgccctgcaaacagcattctttggtcacccctcagtgtgaggggtgcatacaccaatgtcaggcaaggattacgggacaaggactcccttcccagactcctcctccattccacagtttgacccttattccttcaggacttatacccctaatccctgtacttccatcaagtcagtcacaaggatttagggaagctgatcatttctatgagagctggcaatggatggattaggttcctttatgttttcaggtcacgtaagagatacagcgagtcttttgttttttttaagagctccaagatgaaggccagcgtgatatgaatttcctcaaactgcccacacagtctttctccccaccctctggggaaaaaaatctgagcctccccctcagatacctaagaagaagctgagaaaaatctgcccagaagaggaacagctgctgagagcctgcctcaccctccctggctggccgtatttccaactttgttgccttcttcagtagatctggggaacaaaaaagcaaggcgtgaaatttgagtgttcccaagtctctctccatagctgcccgtgagcagtgttaccttttgattgaggcactcacgcttgagggccacatgaataaatgcacgcctaagtgtgagggtggcaaagaccaatcattcacagactgatgggaattgtttccctaaaatattcccctgagctgctagaaagggggtgatttccacgagagcatagactgatgcggactagaattgctaggacagggaacccccgtggacggctggccattgagacacagtggagaggaaggagaccatggtgtgaagtctacgaatgagagtgaggaaaaggaagaggtgggaagaagtggtacccaaggataaggctttatggaatctaagcatcccacatttactgtttttaaaaatgagcttgaaaaattagggtgtccgtcctgtgaaatggaatcccacagccacagatctgctaacatttgtttatatttgttgtcaaagaatagcttgatttttttttttttggttattaacataacttaagtggaataaaagtataaaggagcaagcaccatggttttctgtcatctcctctcctcttttcttttttcttttctgagacagagtgttgctctgtcacccaggctggagtgcagtggtacaatcatagctcactgcagccttgatctcctgggctcccgggtcctcctgcctcagcctccgtagtagctgggactacaggcatctgccaccaccaataaaaaaaaaatgctgctttttttttattttttgtagagatcatctcatcatattattcaggccggtcttaaactcctagcttcaaacgatcctcctcccttcttgtcctcccaaagtgctgggaatactggtgtgagccattgcgcccagccaacactgtttcctttccacttggaaagtagtttatcctggaaattcctgggatcccgacttttgtttaccagagtggaaaagctaatcaagttgatacttccccagtatctttctcccccaacttgaggaccaaacaggttgtgccttttcaaaaagaataattttttcccaatagtagaaaataaatcttgaacaataaaatttatacacttcacattgatgctttttaaatctacacgcaaattacataaaaaatagcacttcatgctgaaaactttctaaagatatattcactcctctgtaataactactggttatcactacgtaaaataccaatactttagcacacaagaaaaattttagattaactcaggcagtttctcactaaagtccataatctctgcgcctaaatctgctaatcactgtaattgaagaaaatgcaggaagtataaatctcctagggggcagtgtttgtaaccctttttaaaaagaaattacacccagagtctttttgatagtttgaaaacatgcactggaaactgttgcatatccctaaaaggccaacttttttttttttcctggggccatgattatttaacttttacatttttgttcttatctttaagaaaatctctgctgggtgcggtggctcacgcctgtaatcccagcaatttgggaggccgaggcaggcggattacctaaggtcaggagtttgagaccatcctggccaacatggtgaaaccctgtctctactaaaaatacaaaaattagctgagtgtggtggcaagtgcctgtaatcccagttactcgggtagctgaggtaagagaatcgcttgaacccaggaggcagaggttgcagtgatcacaccactgctctccaggctgggtggcaacagagcaagactcgtctccaaaaaaaaaaaaaaaaaagaaagaaaatctcattctttctgacctttgctctttgctttctataaccactcatcagaagctaagggccataactacatccagatttggcctcctgagtcagatctgagtgctctgtgggaggggaactattaagacagctctcttttgtcacttttaaaatgatttttctttaattttttgaatggaaaaaatacagaaaacataatatagtaataccataaacagatgttagtgtctgtttaatgtctgagaggcagaatggtacagtggtgaagacaattagctaggtaagtcacacaacttacttctctctgcctcagtggtcctcatctgtgagatggggataatagtagtgacctcatacagaagattaaatgaattaatatgtggaagagtttggatcagtgcctggcacatagcaaatgctatataggtttttgtcagattttaaagagaaaaacatgtttccataattgcttgagccctcttacacttttaaagtaaaatattgtaaaacccctgcactttctttccccatcctttgccagagctaaccacatgctggagttggagagtgtaactaccatgcacattttgggcttccactatgctcacaatgtatattattgttttgtgtgttataaagctttacttaaataggatcatactgcacgtatccttttataagtttcggtgttcactcagcattatgtttttgagattcatccatattgacagagatggttctagttcataatttgttaccgctgttaactgttccaatgtatcaataacccactgagaacaagcagatgacaaacggtgctacaatgagctccatggaacaagtgtccacatgtgagattttctctgcgatggtcagcttaaaagacgtagctaggtatgggaggcacctcttcaacttcatggatagggttcaatagtgattatgcaaatttacactctcaccagcagtaaataacaggctgtattttcccacatcctcaccagtacttgaggctgttatattttctgacttttctctatgtgacgagaataaaataggatgtgacatttttcatttttatgtccataattactaatttattggccactggagtttccctctcattgaattgcctatttatatccatttttggatatccattattgtctattttcttattgctttataaatgttctttaattattctgaatgcaaatccttggtagagcatgtgagttgtaaatatcttctctctgtggtttgtcttcattactttgtttgtaatgtcttttgtagttcaaaatcctcatttcaatgcagtttaattaggtaatattttccagcatagtttatgatctttgtttctttttaaagtccttccctgtaccaatacactgggagacaacaccatgtggtgtttttagttttttgtttatgcgaagttttagagttgagcttctcacatgtatgtctttggtccatcaggaattgcttttacttatggtgtaagaaagggatgtattttttactttttccatatggaaaaccaattttcccgacactatttattgaatagtcatttctctatgggtttgtatgacctcttctgtcatatatcaagctctcacaaagtctgtgtctttgtctaggctctctgtttcattgcgtagtcttgtttgtcctatccgtgtgccaagccacactggcttaatagtgctgatacctggtggagcaagtaccccctcttattattattcctcaaaattgccagattgatgttataagtggttttgtttgtttgtttgtttgtttgttttgttttgaggtggagtcttgctctgtcacccaggctggagtgcaatggtgtgatcttggctcgttgccacctcatgcctcctgggtttaagcaattctcctgcctcagcctcccaaggagctgagactacaggcctatgccaccacacccagctaatttttgtgttttcagtagagacagggttttaccatgttggtcaggctggtctcaagctacggacctcaggtgatccacccacctcagccttccagagtgctgggattacagacgtgaaccatcatgcctggctgtaagtggtatatttttattaaactgtattctctattttttctagtatttcaggttgctgtcaatcctatatattgatcctgtatcattcagttatattgaatagttataatagtgtatctgcagatttccttacattattatattgtctatgaacaagtaccattttggctatctctttttaatccatattgcctttatttctttttcttatattcaccatgctagtgagttcttaggatgcagtgacagcaaaaattccaaattttaaaacaatccttctaacatttcatcactgagcctgatacttgtttgaggtttttgctaaacataagaacattctttttaatttttaaattactggtttttaaaaaagttatgaatgtgtgttggatttttcttaacatttagctgactctgttaagataagtgtatagtttttttatttatattgcagaaaattttagggctggactgtctaatgtgaaaccagccttacattcctgagataaattattttggatcatgatgtgtttgttcatatattgctgtatttgctttactaatattttatttagggctttggatttgaatgtaaaatcccttcttattctatgtcttcgtctgttctcatgctgctaataaagacatacctgagactgggtaattgatcaagaaaagaagtttaatggactcacagttccacatggctggggaggcctcataatcatggcagaaggcaaatgaggagtaaagtcacatcttacatggtggcaggcaaagagagagcttgtgtaggggaactcccttttataaaaccatcacctcatgagacttattcactatcacaagaacagcatgggaaagacccacccccatgattcagttacctcccaccaggtccctcctatgatatgtgggaattatgggagctacaattcaagataagatttggctggggacatagccaaaccatatcattctctctttctaatatcaaggtttatactagccttataacattaattgatattataatatttgatttaaaccacagctcatcttaagtgttagaattcagatacagttatagcatattcgtaattagaatagtgttcctcacagcattttcttataatattttctcccttaattgttgagtaacctttgagatgaaaatgaggactcaactgatgttgctacaagttctgttgtgactttacattatagcttcttcatggacaagtttctaaatatccatgcaaagggacaagaagacctatttggaaggaccaggaggatcacagcactggaaatcagcatctttcactcagtctgaattccagaaatcatcaattgattctttcagccattgtttagagaaatgccttgggatgctcatttcaatgatattaacattttacttgaatcccaattgcaccaatttgtctgaaacaaaacaaagttaaaggggtaagccccagggctttctgtggagaatgagtgcctccaagcagaactctgcccagtgactgccctctgtcaggtggttatggggggcaagacactctctcatattacttcctatagatttaactttttttttttttttttttttgagacagagtctcgctctattgcccaggctggagtgcagtggcaccatcttggctcactgcaagttctgcctcctgggctcacaccattctcccacctaagcctccagagtagttgggactacaggcacccaccaccacacccagctaattttgtttttgtatttttagtagagatgggagagatggggtttcactgtgttagtcaggatggtctcgatctcctgacctcgtgatccacctgccgtggcctcccaaggtgctgggattacaggtgtgagccactgcccctggcctagatttaacttttaacatgttctttcagggtgctaacataggtttcctcacacttatgagtctttaaagcactttttttttttttgagtcagagactcagtttgtcgcccaggctggagtgcagtggcacaatctcggctcattgcagccactgccttctgagttcaagtgattctcctgcctcaaattcccaggtagctggaattacaggcgcacaccaccacgcccagataatttttgtttttttgttttgtttttttgagagggagtcttgctctgtcgcccaggctgaagtgcagtggcaccatctcggctcactgcaacctctgcctcccaggttcacgtgattctcctgccttagcctcccaagtagctgggactacaggcatgcaccaccacacccagctaatttttgtatttttagtagagtcgaggtttcaccatgttggccaggatggtctcaatctcttgacctagtgatctgcccacctcagttttagtagaaatagggtttcaccgtgttgcccaggttggtctcaaattcctaacctcaagtgatccacccaccttggcctccgaaagttctgggattacaggcatgagccacagcacccggccaagggcacattcaaaattggaatttagcttaaaattattattgcctggaatttctcagtccttcataaagattcgtctagagactctcaaagtcttacattgtcctcaagtatcaggtcactaagtgaaataaaaaaataattgacagatagatccttcttgaatacagcaaaaatttggtatttacccaattcaagataaaaacagtgaaatccaagagtaaagttattccaaattttttttttttttaaatccagactttctgcggagaatgaattttctattatctttttcttctttgcaaggcaattgtcatcattctgctttgtcacctactttaaaagctatcctataggaagggacttaacagcgggagagttctctctgggatttgagaagttactgacatcagaaggtatcctagagccatttgaggaacacacacacccttgttcaaatcgctgctgtgtttgaaacaaaatgtcagctggtgttaggtaagaattgctaacttctaaagaatagtgtcatttatagaaccactgcaggggttagaacacagaggatgaccagaaaacacctccaagaagaaagagattgagtgagacttttttgattgcttttgtactcccgagttcctggcacaggcctggcacaagatgggaacttgtctagtgaattaatgaagccatttctaccgttgcctctagggtacctctaagtacgttatattctttgtgggtgttgtttttctgttctgttttttgtttttgtttttgctttttttgagacggagtctcactctgtcgccaggctggagtgcagtggcatgatcttggctcactgcaactccgcctcccaggttcaagcaattctcatgcctcagcctcccgagtagctgggattagaggcacatgccaccatgcccagctaatttttgtatttttagtagagacggggtttcaccatgttgcccaggatgatctcgatctcctgaccttgtgatctgcccacctcggcctcccacagtgctgggattataggtgtgagccaccgcgcccggcctctttttagttttaaatcataagactcttgaatacagtctcttaaagatatgctactgtgttaactgtactggaatcttttgcttaccttaaatgtcaatgtctttcccatttcagatgccagtgtacattctaccaactctactgaaagcttttatttgagcagcccttggcttatttcctctggcttcaaaaattacccagttaactgagtaggattcctaactggccagtccgtttagcgattttttagatgaaagttttagattttagtgcagaagttgtctttgaagattatcaaatcaaaacatccttattttagaaagatgatacagaaaatcataaggaaatctgagtgaacttaccacccttcacattttagggtatagtcatcaggtatttcaggagacttaacttgaacctaacgaaaccaagtttcaggcccctctaaatataaatgttcacttttatacctaagtttctgtttcaaatgttgttattcttgttcttaaagaggccactcaaaattgtgtaagcttcagggctcacaaaatgtggggtccatcactgtcatcaaggtgattaattgatttgtataaatctagttcctttctgttttatgatatgctttgtcatttaataaaatacagttttttcacattgccatattctcttacaattgcttttcataactgtttagtgttccagtgaacagatttattaaatgaactacttattaaatcaatcccctattgttggagattctccctcaccttatattattcctacagttgatacttcattgagtgtctaggtaaggatgtcattgtgcctaaatgtgtaaaagttgaattagtgcttcaaaccacatgtgtactttgggggcttttgatacattgacaaataacccttcagagaaatggtatcaacttactttcccaacagtgatatgtgggagtatccattttcccatcccttgtcagcactatttattgtatcaacctttgccaatgttgtaggtgtaaaaacttaccttgctattttaattttaatatttttcataagttgaaaacttatttcccatcagaaaacgcaataagaatcctttatatatttaaggcattagccatttgccactggtattgcagatggtgatctgcatagtcctaaaatggatttggagaaactgaggcatttagtttatttggaattgtcaccgtcagctgcctgcagaagacgcccttcagggaaaatggtattgctattccaaaaggcaagcatacatcatattcacttggccacattacaggaataatttaatgtgtttcaactaaaggtatctgagcgtctactaggtacctaactctgtactctatcttaccatctggtgagggaaactgtatacaacaaaccataatgcaggattaaaagccacgcttgcagccaggtgtggtggctccacctgtaatcctagcactgtgggaggtcaaggtgggtgaatcacctgaggtcaggagttcgagaacagcctggccaacataccaaaaccccgtctctactaaaaaaatacaaaaattagccggacatgggggcatatacctgtagtcccagctactcaggaggctgaagcaagagaatcacttgaacccaggaggtgtgacgttgcagtgagccgagatcgcaccattgcactccagcttgggcaacagagcgagactctgtctgaaaaaaaaaagtcatgcttgcagtctcaacaaaatacaatatgagcacatcggtgaggtaaattaattccttcattcctgatgaggaaatgatggagtagtaatgggggaagattgttcagaggacttgatgtatatgtgaagcaaagaggtggtgagaagtgcgtggcgcagcgtgtgggatgaatgtgcaccgtaagaggtccagtcccactgcggtgccctagcaaagtgggacgcttcgggaaaataaggcaggaagaggagttgaggtcacatggtgaatatccttggataccatgttgagataaagatattttagaagatgtcccacattctggaactgattctgagacgcaaaagataatgaagatgtgtgggcacaagtgtgacctgccaactgcaccctgctttttgtaaaatgtgagtaagagatcttggttaaaatccacattcctttgcaaagccatggaggtgaaagaacccttcagtgttcaggcttctcagggggacactgagcattgcaaggttcatatcgacactcactctggcacaggtttcagagctcggcacctccccctcccaccccacacccccatccagcatgtggatccattctaaccctgtgatggcattcccttcggttgaggtaaagacgggaatcttttttctgagctgcacccagcacgcttcaacatcttcaagcagatggtcagcctaaaagtgtgaggatagctcaggttgccctgagaggatgcttgcaggagatggacagagctaaatgcaggatttcaggagaagtatgcttcaagaaagagagcatggcatctatgaatttggcagaagtggacatatagcttctgccaaatgatgagttgtaacttttaggcaaattgcttggactttctgagcttttatttccttatctgtgaaatggggtcatagtatccatctgacaagagatactgtgctgatgagatgaaatacatacacatggtttctgacatatggcaggcatcctataaatgcatttctctcatcctcatcccttcttcataaaaagggagtttgggaggcagagtcccctggacaacctctgggaatctggagcagccagcactaacttggagcgaggaagcctgtgccaaagcatgcggaatctctagaaaccatgtgggcttttgttcatcatcatgccaataaaacgccatcggatattaagagaattccttctgagtctaagcatttctaaatacctttcctgaattgagaaagcaaactgtgtaaaagccaagcgtgaaaagactattctgtttgcaaaggcatttttcccatcctgcctggcttgtcacgttctgtgactggactcatgcacccagctggcagctgcaccagccagaccctgaggtaactatagtttaggcccattttttttcctgctccagagactacaaattctatttcaagcacacgcatgtacagaatgcagatgtggggatgaaaatcagaccatcttctgggagcgaggctgtgatacttaactgtagggacgccattggtggcctttctgcagtggcctcgcccaggcatggctggggcatggacctcaagagcggttttggccttttgatgtaccatagcaatcacatgggacaatcaccacacatcccacgtggggccaagacattgcgtgatctgtgatcagacaggcttaaaaggtattctccgcattctgaggaatttgtaacagcatggagattctggaaaactagttccctgaaaaagctgagggtcaacacagggatgagtggagaggggacatggagcccttatgcctgacatgaagggactgctctagtcaaggaaacagccacttcagaatgtgtctctactgtggatacaaaccaagggcgaggttactaggctggttacatcatctagcaaaagctcttatagctcagatagacccacaaatgagacattccttttcaatgactaataaatcattcgtttattcattcaacaaatatttattgagaaactactatgtaacaggtagtctcataggtactaaggatacagtagaaaacaacaacaaacttaaaaaaaaaaaatcccttagccccagttacttgagaagattgcttgaagccagtagtttgaggctgcagtgagctatgatcataccactgcactccagcctgggtgacagagcaagaccccatctctttaaagataaaaaaaaaaaaaaaatctctgagctcatgaaacttacatgttagcaagagaaactgatcataagcaatatcactaattaaaatatgaattataacatagagtagaaaatgctaagaaaacagacataaagcaagtataagagtaagaaatagtatggagaatggctactaaaattctagctgaggaggctagggagggcttcactgagaaaccaactttatagagacctgatggtttggataggtatagacctagattgaaaatatttccctccaggttttcaaaggcattgctccattatcttttggtttctgaagttcctgttgagaaagctattgcctttctgatacctgatccttcctatgtgactttttacctgttctgggggcttttaggattttctgttttccccatcttctggaatgtctcagtgacaaacctgtgtgttgagtatttcataaacttttacaatctgcgatctcatgtccttcagtttacaaggaaaaaagaacattcttataatattgttttggaaaactctgttttttctgatctcttttacccaaatctccattactggggatctgggtactctgacatgattctatgtttcatattgctcttctctcttttcccatctctcagtctctttttttcggaggggaggtggcctccactttctgagattgcgtcaactttttcttcttcactgaattttaaaattctgctctcatggttcctagagactgatcttatcctccaaatgctccccctttttctggactgtttgttctcttccgagtttctttttcctgtttctttgggtgttttcatttgtgttagaagcttctataaaaatgtttgtgacatcttgggagtcagttaatgtaagagggaggcacggttgtaattttgggaagttttatatgtgggtctggctgcttcgctatggggtgaccagacagaatctgaatatgaccctcaaaaatctgtttgtcaggccagacatggtagctcatggctgtcatcccagaactttgggagtccgaggtggtcagatcacttgagctcaggagtttaaaaccagcctaggcaacatggcaaaaccccatcactaaaaaaaatatacaaaaaattagctgggtgtagtggttctctcctatggtcccaggtactcagggggctgaggtgggaggatagcttgaattcatgaggttggggctgcagtgagccctgatcatgtcactgcactccagcctaggcaacagagcaaggcaagactcagtctctcacatacacacaaaagtttgtctcttctcatgggtcattcagcattcctagagaggaccctccagtgtcctgactaaggagctggcccctttgccagcattcggtcgagggcatatcagccccttcccctatgcttggtcagccagaatccagtgtgtttgatgtggactcttccatcttctgtggatgtgatgggtggctacctggctgggtggggtgggaagagagatggacatttgctacatcagtggtccctagcctttttggcaccaaggaccggttttgtggaagacaatttttccatggacagggttagggggagatggttttgggatgattcaaacgcattacatttagcatgcactttatttctattattattgcattgcaatatataatgaaataattatacaacgcaccataatgtagaatcagtggaagccctgagcttgttttcctgtaactagtcagtcccatctggaggtgatgagtgacagtgacagatcatcaggcatgggattctcttaaggcgcatgcaacctagatccctcaccatgcgcagttcacagtagggttcacgctcctatgagaatcttatgctgctgctgatctgacaggaggtggagctcagacagtgattcgagcaatggggagcagctgtaaatacagatgaagattccctcgctcagccatggctcacttcctgctatgtggcccagttcctaacaagccaaggactggtactggtttgtggcctgaaggctggggacctttgtgctacaccattttaaaatcaagttcagtcaggcatcatgcattcaactcactatgcatttctaccttcagaagggttgggagcctcatttcctgagtttccctggctctgcctgttttatgttgagttattcccttgaaggtttaggtatcagcttgctcttgtctactgttagttcctctctcattcccttacttctttgatgtatgcttttgtatcccttattgtcactttaatggaatttctggaggaagcagagacaaatgtattacatgggctgccatattgaaccggaattcattcttttctcttttgagtctccctttccaaagtttactccagtggtagtagttcacccccagtagattctcacaaaaagcaagactcaaattcagtgtcaggattgtggatatcctgtttcagttatctgtttctgaataacaaatcaccctaagcatagtgacttcacatgacagtcatttatttgcttatcattctgcaatttggacagtgcttggaggggccatctcatttctgctggcatcagctggggtagctcacctggggctggggagaccactcccaagacggctcatccacataacctcagtggttccagctgtaaaatgggcgcttagatggggtggttcttcagcatgtgacctcccgtgtggctgggttggactcctcagaagctgagttctgaaaggaaacatccccaaaccaagctcaccaagaggacaaactccagggtgcaaacacatatcaagctttccttttgcatcacacttgctaatatcccattggccaaagcaagtcacacagccaagcccagaatcaacgtggaacagagctgctctccacagatgggtgagtgctaggaggcagggtgcactggggcccacataccccctgggaactctgggatcctgtgctttttccattttatttctgaaacattgaggtgccagattctagcacgatatgaacattcaataaatatgtattagaaccacagaaatcttgttgcatttccactgaaaatgtttctgaatggactagacagatttaagctatgtagcttacccatggctataatgattgtgttcctagttaatgaaagacatgaaaaaaaatcactctatgaggtcagatttctaaatatacctttccaaggaattaagtatcgtcctttttttttttttttttttttttaagatggagtcttactctatcgcccaggctggagtgcagtggcgtgatctcagctcactgcaacctcccaggttcaagcaactctcttgcctcagcctcccgagtagctgggattacaggcatgtgccaccacacccagctaatttttgtatttttagtagagatggggtttcaccatgttggccagactggtctgaaactcttgaccttaagtgattcgcctgcctcagcctcccaaagtgctgggattacaggcgtgagttaccgagcctggccaagtattgtcttttgctttaggctaccagaggtttgcttcttgcatgtttgtttttgagtcagggtctcactctattacttaggctggagtgcagtggcgcaatcatagctcactgcagcctgcaactctgaggctcaagtgatcttcccaccacagcctcctgagtagctgagactacagtcatgtgccaccacacccagctaatttttttttttccaaagagatgggatcttgctacattgcccaggtgggtctcgaactcctggcctcaagcaatcctcttgccatggcctcccaaagcactgggattacaggcataagccattgcacccagcccttgaatttttgaaaattaggctctttaacacctgcttggacttcaaagaacgaaggtgagtacttacacaataaccaaacagtgcattccttggaaattccaaacctagatctcttgttacatgcttgccaagcttgtcctgaacgttcctaagtgcagcaggaaagaagtggctcagcttgtgctgtgtgtcccctgagtcttgacctgtgactaataactgtttcctttgtgtgcaggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggtaagttgtgacatcattttttgcctgccattttgccttagagttttttttgttttttgtttttttgtttttgaggggtttttttttacccactatattgcatttagagtgtttttttgttttttgttttttgttttttgttttttgtttggtccatcatatccctttcatagagtttataccaaattctaatttctttatatcctagtgaagaaagcagattcattatcctgattggttgggcttatttcacccagtcagatgatttcactatctggttttctacaattcatttacagggtatagcttataaaaacgaggacaaatttctccgccacagatttttgaatgctacatctgaaaagaacattagaaatgattcagtccaccattttatctaagggttagggaaactaaggcccaaaaaggtagcggagagacctgatcgaggtcttaagagttgtaggcagtacttcattcatattggaactttcccaattccccctcaagtgttctttcctccatagaaagaccctgtggacattttaggtaatgatcccactgggtcgttatttacacataacaagttagaataaaagcagtgggctctgtattattttccataagaaaagagactgagaagcatcttcactttccattcatttcttaaagagttgtcctttacccaaagatcttactttccaggtggcctttccccagggcccccagttgaatatcctccaaaattaagctaaatggactcctgctattgatgggattgagagtcagttagaaacaaaagcatctctctctccctctctctctctctctctttttttttttttttttttttttttttttatgagacagtcttgctctttcgcccaggctggagtacaatggtgcgatctccgtttactgtaacctccgcctcctgggttcaagcgattctcctgcctcagcctcccaagtagctgggattacaggcgcccaccaccaggcccagctaatttttttctatttttagtaggtacggggttttaccacgtgggtcaggctggtctcaaactcctgacctcaggtcatctacctgcctcggcctcccaaagtgctaggattacaggtgtgagccaccatgcctggcctcatctctctttttttgaagacagggtcttgctctgtcacccaggctggacctcagtggcatgatcatgtctcagtgcagcctcgaccttctgggctcaaatgatcctcccacctctgccttccgagtagctggcactaccggcacatgccaccatatctggctaatttttaatcttttgtagagacagaatctccctatgttacccaggctggtctgaaactcctgaggcaagcaatcctctagtctcggactcccaaatggttgggattataggcgtgggccaccacacctggctcaaaagcatctttattgtcattttggtgtcatgtatacagtagaaagaactcatttgatctgttccaaccaaacaacctggaaaacaggacttagatcaacacaagcaatcagttgctagtatggtctctaaacattttagaactccacagattatttagtgactaatccagccatttcattttatggaaccagaaactcagacgcataaaatttgagggacttattcaaaagcacacagccagctaagtaccaagctctgccccaaatatggctgttcacacttcttggtcaagaactttttgatttcttcgaatgttccctcaccaaatcactggaggcagaacttggggtttctgagtccacaccctggggggaatagcaagttgccctgtttcttcatcatggaattaatgggtaccacttttaaaaaatatgcctctagtgcataataaatgtaaactgatctgtatctaccaatgatcacaaatgacatatttaggcatgtgcccaggtgtatgagtaatttagaactttcaaagtttgacacatgcctcaaggtatagatactacatctgtttcacaaccttacagctttttaaaaatgtgtttaaatattcatgggtacccaaaaattcatgtttgtttttaaactaaattattaatcaagctgtcaccaaaagaaattttttgcattcacaaagcgtaaacttgaaacatgaaataatcacattatatttaaagacaatgtttgtagtaatataatcccacatactgtttttacatggagctgccagttacaacaatcatcttacatttctgcctttgcaattagaggaattgaaggacacagtaatagcaagtaaacatgcaacttagggaagccacacttgattatggagctcaaggctgatgaggttattatgagtaattgggcctcactgtcttgcagcctgtgcaaggatttttatattacaatgagtcaccattttctagagcttttctcaagcttcaaagtatggctactttgccttcttttttacattgtttgggaaagtcgagaagtagtcacaaaataaaagaaatgagagggaggaaaaagaagaaaaggtcatgattctccttaatggaaatctagttgataacataaatgaaaccatcagtcaatatgttgatatttgtgaaaatgatgatcttgttgatccgtaagttgtagtatggatagcctaactttttttttttttgagacagaatttcactcggtcgcccaggttggagtgcagtggcatgatctcagttcactgcagccaccacctcctgggttcaagtaattctcatgcctcagcctcccgagtagctgggactacaggtgtgcgccaccacgccaggctaatttttgtatttttagtagagatggggtttcaccatgttggccaggtttgtctcgaactcctgacctcaagtgatctgcccacctcggcctcccaaagtgctgggattataagcgtgacccactgctcccagcttgatagcctaaagttatttttaaaaaactctcatttaaaatatttaagtggaaagatcaccgatttataaatttgtctgtaattttacttttcagttactttgatttaaataaaaaaaagaacctaaaaatgttcaaatgtagacaatgttttatttggtgatgacagtaatgtttatgctatgtgagcacatgcatgtcgcttccaaagaattattctatttcttgattttatgcattaaatgccttgattatattttatttgaatggtagaagaaattttcaccaccagcattatataagacaaaaaaaaaaaaggctgggcgctgtggctcacgcctgtaatcccagcactttgggaggccaaggtgggcggatcacgaggtcaggagatcgagaccatcctggttaacacagtgaaaacccgtctctacggaaaatacaaaaaattagccgggcgtggtggcgggcacctgtagtcccagctgctggggaggctaaggcaggagaatgctgtgaacccgggaagcggaactcacagtgagccgagacggtgccactgcactccagcctgggcgacagagtgagactccgtctcaaaaaaaaaaaaaaaaaaaaaaaaaaagacaaaagaaaagtatcatgtagatttcaactggagacagtgactttaatcttctaagttcagagacaaatttcactgcacttccttcagtgtttctgaagcgtgagcatatttgctaaacagttgcctatctcatcattgtgttaggctcctcatattttccttagggaaatgctatggagagttcaggtcagaatattgtgttgtaaatgttgccacagtaaatgcaaccccggcctttactgttggttcatctcagatgaatatgtttctaaagtcatgataaaccaacctcatgcattttaaatacctccagaatcacagttagtctttttcatggctcccgtgaggttttctagtttttcacgtcctcgcctgtgactccttcctctggccaaatggggagctcctttagtgaaaccccacatccttacctctgtgagtctccccttcatattcacccagccccctttaataacagggctgctggttccccctcaagccgacttctaacaagctactggagcaaccgtgcaagcttgggctagtcattgcttcaaagcaattactggcggatatttaaaggagaaagagaagactagtccaagaatcctccacttcagttaaaacagaaacacaagccagtaatcccagtgattgggtcagcccactaaatgaggctgcacctggaagagaggaattcttcctcctgcccacatttctctgagctagcccagccggcattggaagggatcacagtgtagacagagccaaaagggccttgggtggcccttctgctgatgaaagctgaacatggagggagagagacttcatagatattcatgtgctcttcgataattttaaggtaggctctgatcctgtcttttgctacgttatgacaccttggctctaagagccgggttcagagaaaaaagaagaatttatctgctgctatttcttcacatccagcaattcgatttgtatatagaaaaactaattttctaacccactatggaaggaaaaaaggcatggtaaagatattagatctttttggtactgtttttttttttttttctggactccagataccttttctttcagttgccgaaagtgtttgaaggcaaaaaaaaaaaaaaaaaaagaaaaagaaaaaaatcttctttcatgtacattcattagataagcagcaaaccaggtgtttgggaaaagtaaacaattaaatatttaaatatcaaccaaatctctttgaatgtattgtaaatattggaactttatttttttttttaaagccttagtttccatactcggaatcttgaaagaaagttcgtgccacccaacatttatgggtggggaactatactggaggaataatactttcttggggaacaagaaaaggagagaaaagctgaagtcatttttcttcttcttttccgtatttataattgcctattttatggtcacatagcttttgactggcgtactgtagatagcctttggattgtctgttcatgttttttacctgatctttaagggcaggctaaggaaatggccaaagtcaggcttctttcatctgccatagttatcgatgtttttgattccaggaacattcaagacagatcactcctcaaagtgtacaacaaggatcctgcacatgcgtttaatcacacaccaaaaactatgaatggagacatgagggtaagtgtttctgtcatatttttacttatcttcagtgggtcaaagcgtccctcctcttgcttgtactcctgatgtaatcagaactctacaactgagttttggagggttctccgcactcatctcacctagtggatcattatttgttcttggtagagaagtaagatttcctggttatttagggcaaagggattaaaataaggctggacacatcctaatttatctttaagcaaggagttatgtccttactttaaatgaattctgaaaatcttcctataaaagggtccctggtccacagtatattaactgactcagaagatctcttgcatttctttctccaattaaagcaaacctaacatacaaaaaggcaaacagcaaggtgcacaattgcatggaaaatctattcatactcttacattagctcttccaagttctaacattctaattcaatttctcaccttctaattcaggagctaccctggaagaattttgttgttgtactgtcttaaatattaccatatcctctctgagccatgctgaggtcataatacaaaaatccgcatgatttgggaactaaaattctctagctttagattgtctcaggagattatccaaacattcaaagcacacagggatgttttgaagaaaaaagaaggagaaactgaaaaagcagattttaagatcatattaatgcaggtccactagaaagggattgagtttctaaaaataaggctacattcctctgtagcaaaactgggaggtaaaaagaagattagcttctcagctgtacaccccctacacacacacacacacatttggaagacactgtgccattttttctcatcttttctacagattagcacttggctggatgctcaagtttagctagaaaaataaataaataaatgattaccttttattgccaaagaaacccaggcactgttctgtcttggagctgcagttttgttcctgagcgaggctgtctctgcttcctgatagtacatattagtttcctgttgctgctgtaataaattaggacaaattcagtgacttaaaacaacacagatttactctcttaaattttagagtctgtagactgaaagtctctggtctgacataaggggtcaccagcaggtatgcattcttttctggaggccctagggagaatcttttcttttttttttttttcccccaacttctagaggtcatcaacatttcttggtttgctgtcctcttcctccatcttcaaacccagcaagatagcttccctttgaccctgcttccatgctcacatccctaaccctcccatgtccacttttaaggacactttaaggacattgagcctccctgatcctccagaaaaatctccctatttcaaggtcagctgactggcaatcttgactcccccttttccatgtaacctgatgtagtcacaggttgaggggactaggatgcagacatctttcagggaccagcattctgctttccatattgggtaagtttagaaccataaaagaagccagcagatctagctgaaagtgctgggagaaggtctgtccttctggactggaatatgaatgacgacattgtgggatcagagcctacacttctggagggaaaggcctctcacgtactcaactgctgttatttttgtgtcagaaatgatgtgtgacttgaattgaaagctgtgtcgctacttcagaaattctaggattttcagccttattttgccagttatactttatgtgtaaaccagagccacatggagacagattgagtcatgccaatcgtgaagcatggactaaatattacagcaccatttgccttttattactctgttattctctttcttggagacattcatcaatgtcttcgctccttgaatatctttattttttgctatgtctagccttcaccctggagttccatggtgctgagagttctgttcctatcacatagagccatttccacaccggtgccccagaatcgcctctgagaatcttgtttgtggctggaaagacacctgttttaaccctccagcagctctggtacctacgtaaggaccagcagtgaggactgagagtatcgaatattgaccgtatgaacaaagctgatcaggatatgcagaacatgtgctgtgggtttctgcagagtggttctgttcttacttcaagatgaaaccctgctgatcactttttctgggttacccagagcctactttaagccctcattttgtgtgtgtgagaaactcaatcattgtccccaaatgaagggacagtaaatgttcaccatctaaccagcagaaaagcttttgtgtttcaatgcagattacttagaaatgagaaatagaaagcggtttcaaagccagctaggtgtgatcatgcctgcagtttgcaacttggttcctgttcacagattgcagacgctaaaaggcatggaattcagctgccctcaccttttggctctgcaggttggaattctttttcctttcttgatgaatgtggctgcattgccattaaagggcaggaagctttgttgagccctgcctctggagcccagctgcacaacccactgcccatggtggagaacagaaacagagaacagagcaagcatcaattgttgtagactaaaccacgctgcagcgtggggttagggaactccgtcctcccttatgtttgcaatgtgagcgtggccatgaaggaattcgatgctaactactcacatgagtcagtcactgcagtcctgcccctgatgtcattagacctcactccccagcctccagagacagcctggcacagacctcccagctgcctgcttatgaccaataaacatgcatgtcatgaaaaacatcagttggaataagcagaggggcaacaaaagtcacaccagaactcctcaggggctcctgagactttccttaaccaatgaatgtaatatcttgcctttgaaagaaaagaaaatgtaaaactctccatctaaaacagtcttcccagagcggttttatgattggaaatgtgttactcaggaagcgtgctagactaggcctcagagtgtgcgtggaatgcatgcttggtggggaaaacgtgtactaaattttcatctagcatctagctgagcatttttgaggctagtctgtctaaggagacttgtggttctcggctggaactcagcatacctggctcctgtttctctacccaccaccctgatctaatttaattgcgtggcttttgtttccttacatcagataggagctttgataattcagttcccaagggactgagctcaccatatggaacaggcccttttgcaaaatttatatatgtactcacagggttttaaattcacaaatgtacaacttgaagatggaaccattccatttcatgactctcaaaaagtacacgtttttccataccagcagtttgttgaaggaactggacaattctgctttgagggtgacttgctagtcaccaaacctggtggctttttcatagtgtgggggcttctccaccttcttgtgtgctttaagacaactttccaagactctctgctctcatcatttaatactctccctcttctctgcttcctttaatttctcttgcatgtctttgatttttacttgtatatagacaattaccagattggccctacctcttaaattattccccaatacccaaggtaactgctgcctcccacccctcttctactgatctttgtatttgacaccagtgaatggtccccttataaatcattggtctccatggcacttttgtgtctaaataccttgtctgcattcacagacacctcagcttccttcattccctaactcttcttcctcttgcctgtgtttaagcaggcttctctagtttggagtttatttgttttgtttttttaaatttactcttttttatctgaacctttgcacttgtgatttttatcttaccacttgtttgactattacatcagtgtggttgacccttgaagccatatccctaactctgccatctctagaattcaagacccaaatgttcagcttctaagtgtcttcatatggagatcatttccgtggtttccaatgcattctgttgaagaaaaaattcctaatcttttttccactcaagtctttatccttcttgattaccttttgaagaatggaggggctatgatagggtgtgtgtgtatgtgtgtgcacatgcatgtgtgcctgtgtgtgtatgcatgcatattttggggaatgtgggaggagggatgtaaaacattgagttaccaatgattcttctcttgcctgacctttattcttccatgcatccagctggtcaccagagttcatccactccactttgcaaggcctctaacagatgacccttctgccactgcctgtaccagtattcttacaatagctaacttatttgagcatttattaagcacttttgtgggatttttttttttttttttgagagggagtctcactgtgccatccaggctggagtgcagtgttgcaatctcggctcattgcaacctctgcctcccaggttcaagcgattctcccacctcagcctactgagtagctgggattacaggcatgcaccactatacctggctaatttttgtatttttagaagaaatgggattttgccatgttggccaggctggtctcaaactcctgacctcaggtgatccacctgcctcagcctctcaaattacaggcgtgggctactgcgcctggacagtaatgttaattatttaatcctcaagataaacttttgagccaggtcttggtataagcccccctgtttacagatgatgagacagctccttatgttaagagatttccccaaggccacacagccagagagtagcagaacagagatttaaacccaggcaccgtggctgctgaaattatagccttcattatctctctactgaatcacctaacagttcttacttcccacatctcattctcctgttctctttttccaagtgtctcaaattcactctccctctctacatatctgcctttcaaaattctactcatctaacatattccagaacaattgtctaattccttcagcaaattgcagtcatgaaaaaaaagtgggggagggagcacagttaagtttctcgggggtcttctgtaccataataacaaaatgtggcctgtgcaccatcttcagattttgagaagaacaaagcaactgtaaaagacatctttaaaactatttgggaaatttgaacatgtgttaggaatcaggagatattaagggatagctggtaattctgttaggcataataataggttagtggttatgttttaaaagatggaacatactaaagtgtttacaggttaaatgacatgaaaaatgggacttgctttaaaatactgcagcaaaccaagaaaacaaaaaggtggaagtagatgaaacaaaatggtaaaatgttgaaaaatgtcaaagctggatgatgggggtaccttttattgttttctctacttttttgtgtttgaaaattttcataataaaatctgtttgttttcttttcttttcttttcttttttctgagacagagtctcactctgtcaccgggctggagtgcagtggtgcgatctcagctcactgcaacctctgcctcccgtgttcaagcaattctcctcccttagcctcttgagtagccgggactacaggtgcacaccaccactcttggcacatttttgtattttttactagagacggggtttcaccacgttgaccaggctggtctcgaactcctgacctcaggtgatccacccgcctcggcctcctaaagtgctggatttacaggcgtgagccaccatgcccagcccataataaaatcttttacaaaataataaaaacttgtttttagagcccaaataaaagacttcctaccccaggaagctttcgctaatgctctgtcagaattcatctttcccttttgggggcctgttgcacattcgcattgtgttataatcatttagctgtgtgttcatctcatgcaaaagactgtacactcttcaaagccacaagccatattatgtgatgattcatcttcacgtccctccaaaaaccagtcatggcatcttaacccctggtgagtgcagagtaaacacacttgttaaacaggatgcgctgagtgtcctactgatggtcctacaaatgccatattattcattttctatcattaatgaggacccactgtaaaaatatctctctgttctcatcaccagaaatagttgtgcttctcctggtttatttttatcatatggacactttgagtcttgtaagtgatcattttccctctttgtgttgctactctaaagcttagaattaaatttgtggcccacccacagcaagggtacaggcatttgtggcgtgtgttttgtgtgttggcttcattcctggactctctttttaattttcctactttcatcttcctttggttgcacattctactttgacttcttttttctgtaaaactgtaaaaatgtataggaactctattaatttcttggtgcaatctatcaggatataaatagtattcattctctaccatcgttgttctagatagaagatagcaaacctttttgtgtctgcagagtaggcagtgtgttaagtactttacatattatttaaattagtcagtaactctggcaaagtgggtatactgacttcgttttcacaggtgataaaactgaagccaaagaggtctttcccaagctcacacatctgatcaatgttggacactggatttgaacttgtttctgcttgtttatacacagcccacagcctcccttccttgatatttccatttaagttttgcaattttgaagtgatgttcctactaagactttagaacaaacaaaatatgctttattaaacatttgtttcatttctgtttttaattattattatactttaagttttagggtacatgtgcacaacgtgcaggtttgttacatatgtatacatgtgccatgttggtgtgctgcacccattaactcatcatttagcattaggtatatcctaatgctatccctcccccctccccccaccccacaacagtccctggtgtgtgatgttccccttcctgtgtccatgtgttctcattcttcaattcccacctataagtgagaacatgcggtctttggttttttgtccttgcgatagtttgctgagaatgatggtttccagcttcatccatgtccctacaaaggacatgaactcatcattttttatggctgcatagtattccatggtgtatatgtgccacattttcttaatccagtctatccttgttggacatttgggttggttccaagtctttgctattgtgaatagtgccgcaataaacatacctgtgcatgtgtctttatagcagcgtgatttataatcctttgggtatatacccagtaatgggatggctgggtcaaatggtatttctagttctagatccctgaggaatcgccacaccaacttccacaatggttgaactagtttacagtcccaccaatagtgtaaaagtgttcctatttctccacatcctctccagcacctgttgtttcctgactttttaatgatcgccattctaactggcgtgagatggtatctgattgtggttttgatttgcatttctctgatggccagtgatgatgagcattttttcatgtgttttttggctgcataaatgtcttcttttgagaagtgtctgttcatatccttcacccacttgttgatggggttgtttgtttttttcttgtaaatttgtttgagttcattgtagattctggatattagcactttgtcagatgagtaggttgcttaatttcattatacatctctttcatggtatctttttatatttaattttgcttcattctcttcttttctgagcacactaaaaatatatccattaaaaaaagaaaagaaaagaaaagaaaaagagtgagttgcccatttagtatgtgtgtctgcagtggccactgaactcagagcactttttctcacagggcagtgttcttgttgagaagaggggtttgggattcagggagtatcaagtcatcccgtagtaacaaaagaatcccacagaaatggaagtttcagaaaacactcctagctgataatctatttagagatcgtttttgacccacctgtaatatccccttcactcatgcaatgacaacggtatcaataactaacattcctgacgtgcttactctgtgccagtcaccatactgagcaatttgcttgtatttactgccatttgattttcacacctatacaatgtgagagaagttcttattattctcctgtttcagaagtggaagctgaggcttaagagaggtcagtgtgcttgctcaaagctacccagctaaagagaagtggagctgaatttagagccaggcaggccaactctagaactggcctttgtaatcatgcctgtggtcactaccgtccgtcctttcccaccactgtcttcatcagtgtgtcgatgagtcatcgccacatgtccatgggcctctcatttctgaagacctaacccagaagccactctcttcatcaagcctctctcacttctttccaaacctcaccactcactgtcccttctcgaaacttccatagaacttcacctccctgccccgctctctttgtgcactccccttttcctgactgcactgagttattgatgcacgcttctttttcttttcctttcaccattttattctttttttaatgaatgatttatatatttatttatttatttatctatttattttatactttaagttctggggtacatgtgcacaatgtgttatatatgtatacatgtgccatgttggtgtgctgcacccattaactcgtcattacattaggtatatctcctaatgctatgcctccccactcctcccaccccacaacaggccccggtgtgtgatgttccccaccctgtgtccaagtgttctcattgttcaattcccacctatgagtgagaacatgtggtgtttggttttctgtccacacgtcttaagtgtctttcagctctaagcttctcagggacagggtctccatttcattcatcttcacgctccctgtggctctctcggacaatgccctgccctgagtagattctcattaaatacctggatagaaaaagatacttacttcagcccttttctatcaccaactttcagttaattagtgccttatctactaagagcgatacagtgatttgtaaaggtacgtgtttgaggcttatagcacattacctaatgtatcccgctattggccactgacccaaatgagaaataagaatgtctgcctttcctcagtctatcagtataatttgatagaagttaattaccctgggctgagcgcggtggctcacacctgtaatcccagcactttgggaggctgaggcgggcagatcacgaggtcaagagatcaagaccatcctggccaagatggtgaaaccctatctctactaaaaatacaaaaattagctgggtgtggtggcgcgtgcctatagtcccagctactcaggaggctgaggcaggagaatcacttgaaccccggaggcagagattgcagtgagccaagatcacaccactgtactccagcctggtgacagagtgagtctccacctcaaaaaaaaagaagttaataaccctgaagtttaagaataacaataaagaaaaaatctgctttgtcagattaaaataagtgttcatcagaaatacacagttatctaacctttttttgcgtggggggggctggagttttcaggagttgaattcacctgtggtagaacgtaaactaaatccctagacaacaaatctaaataagatagatctgattttgctgtgtttataattcactaggagaaatcttgcttttattttgctttatttttattttattttgaaggcagggtcttgctctgtcacccagtttggaatgcagtggcacaatcatggctcactgcagcctcagcctccctggctcaagtgatcctctgccccagcctcctgattagctggaactactggcacacaccacaatacttggctaattttctgaattctttgtagagacacagtctccctatgttgcccaggctggctttgaactcctaggctccagggatcctccctccatgccttccaaagtgctgggattacaggcatgagccactgtgcctggccccttgcttttagattgagtcgatagtcagtatttcaaatatctctaaacttacaccgtaagggtgatgatttttgaacagttaacctaacttcattactgtaagcgtttactgattcactcaatcagccatagtgagtcagatccttcctctggtctcagctctcatgcaagatcctgaagatatattggcaaaaagcaataatgatacagacaataatcaattaactcaataatcaataatgatacagacatctataatttttcacataagttcaggctcatgaaatccttgcctgtgttctataatttgctggagttaacactatggaactcatttatgagtgatatacataatgatatcttttttatattgtgcttttctgggaggcaaaaagatgtttctgttatgattgataaggaaggactcttacagaaatgattagctaggcaaacacatttgaatacagtggctgtccagaacatgggagatattttcttgttccttctctgcttccagttataaagtcttattttttagaagcaagaaaaggtaatatatgcacatctgatatgcaacttccaagtgatacaaatctcatctttcctgctgcgtggctgcttgcttttccttgtactatttttttttttattttttgtcattgagaggttatgacaacatgagccatattgtatttataaacatcacgtgtttccttgatatggcttgcagtttctgccagacagaacacatggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaaggtaagaactgtgcctttatgataggatattatctttagaatcttttttcatgctctggcacgtttatctttcattaacttgtcttctgtattcaagttcaatgcaataggcgattgcaattttaggttttattttaacttcttgcacactgcctagaagaaaacctctctttgttattgacattattctgtttttttgaaatccacttaaattaaactgggctggtcttcaatctataaatcttgtggtctagtttctggctaaccttataatttggaatgggatttaaagtgccaacacagtttgcttttacaggtcttgttgatttatgtgctctgtgacaattttcagtgttttcatgaagttgttgacatacattcagtgtctgaggcaaagtcgataatttgaaggcatggtacaagcaaggagggaaattcatatgtgtcctttaacattccagggaaaaattatttggtgttttgttcttgtgaaaatcactttaaatttaaaaataaaaataacctttatcctggtcttgaaaaaattttaaagaaatagcagtttaatctgtatgaaatcacattaaaaacttctacagttttaaatgacaagcttgatataacaaatctcttatagcaggtttagtgattgcctgaaaaagtctttgacagaaatcttgtttacttgagataactattctgtcaactcttgcagtaattcactcacaatatttttgcattgatttcctttaaaggaatttaataagagcaatgtccttttaaatcagtctgtttcctttcaaaagtacatgtgttcatgaatttgcttgttcatatttctgtggatatctttatcccagtttatagatgagttaatatacctgagaagttgttatccaatgtggtttacgtaatatctattattctatttagtcatcatgataaccctatggaataggtactattacacccattttaagtttggaaaaccaaggctcagagaggaacaagatcaagatcacacacttgtaagtaacagagctgggatttaaatccaggctgactgtcttccttgtttttaagtcctggacagcacagcctcaatagtagctgagagcttcaggtctgtaatcaaatatagatgacttatcttgaaaataataataatatataatgtttacgtggcttcaggataaactattttttacttttctggaattttattttattttagatctgtagcatccaaaacctagtatcacactggttgtttatccagggacctggttacaacttactcagagcataatgaaaacagtgaacatcagagagtgtagagatagagaaaagcactttggataaacgactcttccttctttactacacagacctttcctgctctcttctttgcttcatgtgccgtgttgctcataaaaaaatgtttccataggacagagcaggaagcttgtttgtgagcttgatttgggagcaagaaagtatctttgaatggagactggctaactgtgcctgcccactgcccttcaggctgctggcagagctctcaggagggggacaggaagaatgttaaggctgaaggtggagggttctgaagttagggcagctggctcagctgcctgagagcccgaacttcaccttcaacagtgctcttcccacctcctcctgaagattgagacatcaacacagcagcaaaaatatcctggtgatttgtaatgcaaagtaattactgctaacagcatcaacaggggatgcagctgctcacaacacaggcttcaggatcaaggcttccagccccagttcagcataaaatccaggattggctacacaaccaacacaactcaaagttgattggagcagaaccttccttctccccaacaggtcctagggttagctcccgaagagttctgagccgtggctggctggagtgcacatgagaggtttttgccacatccctctgccctttgatatccaaaccacatcccttttctttgctcttataagtataggtgttggcggagattgcttttgactggggacatatgtcctttcattttcaagttgcatcccttgtacctgcatgttgttcacttgctgaggtcttgcttttctgtgttctttgtgggtgcccagcaaggcatcccagaccatactaggctgttgtctaccacatcagcctaggcgccccgagtcccagaccctactctatagagggcttccaggggaccatttttctcttgatgctgtttctaacatttctcaaatgagcatgtgttacttttatataaatttgggggtagggagagaacacgttaatcttttaaaaagaaaaaagtgtttttaagatacattttgcctactggtaacacattttcttctgtcctagtttttcttgtggagcaggtgatctctgcttgcatgtggtttgcagaagtcatagatactctgtccgcttttgaggaactagagctggctactgcagacttgtaattgagaagacaaacctgacctgcaccaccggtgctccctcaagaaacagcactgaaactaataataattttttaaaagacggttaatggtacagaaaaatcatttagcaggaatgaatgagacggccgggcacggtggttcacgcctgtatttccagcactttgggaggccgaggcgggcggatcatgaggtcaggagatcaagaccatcctggctaacacagtgaaaccccgtctctacttaaaatacaaaaaaaaaaaaaaattagctgggcgtggtggcgggcgcctgtagtcccagctactcgggaggctgaggcaggagaatggggtgaacccgggagtttgagcttgcagtgagccgagatcgcaccactgcactccagcctgagtgacaaagcaagactgtctcaaaaaaaaaaaaaaaaaaaatagaatgaatgagacctagtatttgctagcacaacagaatgcctatagtcaaaaataatttaattgtacttttaaaaataactaaaagagtatagctgaaatgttgtaacacaaaggataaatgcttgaggtgacagacaccccatttaccctgatgcgattattacacattgcatgctgtatcaaaatatctcatgtaacccataaatatatacacctactctgttggcacaaaaattaaaaatgaaaaaaagaaagaaagaggcctgacttatttggagtcgtaggatttttgaaatagaaagaaggtcttagacatcatcttttgtaacccattgccctgtaacctgagacccaggagttccagagtggttggagtgagatggtcaagatcacaaaataaagaagtgacaaaaatagggctggatctcaagtcaccgttcccaagaccagacccttgtctctatgcagtgccatttcagcctgttctctgcttttgttctcacccctctggatcttatgaggtttgtcttcttgattgatttagaaaaacactatctatttgactatctatttgacttctcttagccatcttttgtggtacctgagtccagccagctttcgctaatcctctagaaagcaggacaactctcttttctggattatcttactaaaagagaaccagaaatcctgtagttaggccagagctgattaattggaaatgcatgagcctggactaaaaataaatggattttaaactaaccagatttagattatccagtattttttatggaaggagaataggccatcatgtcaactgaaaaatagcagctgtttcaaattatgagatactttgaatagagcaatattggctcagcaagattgtacagtgttatggcattattttaaaaaacagcctctttgctgtggcaaatagctcctgcagttatgctgtttgaaatgttaatgtatgactcctcacattactttcagagttgttcattgcttggaaccagtgattttaggtggcaactagaaaagcagtttgtaaatggtaataattatatgatgttgttttgaatgaatgttggaaagactggtagcacaaagaacttgagagttacttttcattaactccttaagtcacaactataattcttagtcacgactaaggagagaaaaagtcaatttaaaactgacttaaagaaaattattaaatgagtactaggacagctgatacaaagatatagccaaagtggtgatagtatcttgttaatgtatgaagtataaaaaccaaggctttaagatgaagcccaaattgagggttcaaggaaggaacagggtaaaacttgatttaaaagcatacaattggcaaaaaaaaagaaaaacgaaaaaaaaccattttgatgtccaaatgaattctaattcctctctaagagttctcaagacgatcagcatcgtactatttggcagaaaagacaaactactcattaaatagttttttgagcagatttatttatttaaggtctctccagataaaaggtgtgactacctagcttttcatttaagctagaggacctctttccattgtgcaggcagcactaactcactccatattcctgaaacagaaaatatgtttgactcagttgatcgacacatgtatttgatttctttccttttcttcttttcttgtgacatcaaaggtcgtgctttgccttgttctgatttcactctttgaaactgttccttttcacgcacccttgatagagtaggaagagttaccaaagaaaaacacaaacaacaataaggaatcataccaatgccaatgatggggcaattcagaaatagcaggggcctgatctgtagggtgcttaaacttccatgcatgattttcatgaaatgcagcacctctaaagcataggactggtggtcagggtctgatagcttcgtctagaatgagcatctagtgccagtccttgcagtcacttacaaggaaggagggcacggaatagaacatgttgtagatggttgaccccttgcagtagggactgagggatcatgacggatacatcatggatggaaatccacaaagtggaaaccgtttttgcttgcctttaaaagcaaatctaaaaatatgttttctagcagctgtgtaactgcaaggaaaaaaaaaaaaatctgctccactgcaacacaactcgctcaccagatatctgcagggttcagatcttaatgcttcagaaatttgttgcagattttactgtatatatttagaccaaggagcctattagcttgcaatctgagagaacctctgcattttcatgaaaatgagaaatgtggcactgttggcaacctcgggctataattatgttaatctgaccattttaagactgaaatatgttgttttaaaatgtttctgtatttttattattcgtaacaatgatctgaagaaatttactgaaatgctaataagtttctattcagtatcactttgagactagagcacaaaaaatgagtcagatgtggaattttgatatttttaattttggcacagaatttttatcgacagatatgtactcatatacatagagtatcttaatataaaaactacccaaatataattttatattttaaatatagatacagtgagtatatgtgcaaagctgtcttggcagatatgtgcaataacaaaacatctctacatttgcattaaattcccaatctttgctctgccaaaaattaattttgcgcattattacaagataaatgtttttctatcaagaaccatgctaaagcacccagttccctgtttttgatataaatgtaggacaggactagaatggataatgtagttgaaattctgagagcctctaaacacatatcttgagctaattagttcggcttcctcttcagcagccaaagcttgcattctggccacagacaagtaatgacacgggtgctcttttcattcacaaaagagatgttctcccaggtggtaagatgggaaggaaaagagaatgatccaatgccaagatgtgggtaatcacccatctcacagtgattatagataattgcaatttgagtctatttgttgttgtaacactacgaaatgaattgggagtcttttacatatagcctgatctgggttcagaatgatcaattaatttgggaataggaatgaggaaaagtactttttgtttttttctgagacacgagtctccctctgttgcccaggctggagtgcagtggtgcagtggttcactgcaacctccgcctcccgggctcaagagatcctcccaccttagtcccccaagttgctgggactaaaggcgtatgccaccccaccaggctaatttttctattttttgtagaggtagggtttcaccatgttgcccaggcttgttgcaaactcccgagctcaagtgatccaccagcctcggcctcccaaagtgctgggactacaggcgtgagccaccatgtccagcctggaccattttctcaaatatgatatctttgaaatataatacagtatgatgttcttacattggctgcatccagagtcctcattttttgccagttcttgtatctccaaaacgaatgtgtcattcgtttcatccttctgtgaatacattcaagtgagtattttccgttttattcattttcttctgcctcacagctcactgagtgggcccgtgaatgtttgctgatgatattaataatcatgcgtgctcagtgacacaacaatgatggaactcattaggtattcacagcaccagaagagaaagtgcaagaaggttttactgaagcaagtaagcagctgaatcaggggctcagagttcagtgtcaggactacagtcacagttatgagaccacagccaagaagagattcccagcagggaaaaaccaagccctttgagtcataatccagtgctcgatccaccacaccccactgccttccttgagatgatggtgtggaggagtactgattgatgaggaggattaaacctttttttttttttttgagacagagtctcgctctgtcccccaggctggagtgcaatggtgtgatctcagctcactgcaacctccgcctcccaggttcaagtgattctcctgcctcagcctcccgagtagctgggattacaggcacctgccaccaaacccggctaatttttgtgtttttagtagagtcaggtttcaccacgttggccaggctgctctcgaattcctaacctcaaatgatccacctgcctgggcctcccgaagtgctgggattacaggtgtgagccactgtgcccggccaattaaaccctttttaattaaaaaaaaaaattggaaactaatttgtgtacttcagtgtgttggaggaaacgtcatcgaaatggcaccagtgtcttgctgccttaattttaagaaatcccctttatttattgtcacttatcttctgtcctctctgggagaagtgttgctctaacgttgcttttctgaaaagtaaagataatgcaaagataaaaagagttggggaggttgggttgggcattgagggaagataagctacctttggttcagcctgcagcttgattctttttgaagtgacttgaaagctcttggtgctaatcaagaactttttgtttgttttttgttttgtgtgtgtgtgtgtgtgtatgtgtgtgtgggtggcggggtttggggggaacaggatcgtattctgtcacccaggctggagtgcagtggtataatcatagctggagtgcagtggtataatcatagctcactgcagccttgaactcctgggctcaagccatccttcacctcggccttcaagtagccagggtacaggcatgcaccaccatgcctggctaattttttaaattttaattttgcagagacagggccttgctatgttgcccaggctggtctcaaactcctggcttctagccatcctcccgccttggcctcccaaagtgctaggtttataggtgtgagagccactgtgctcagccctaatcatgaactttgaaaagtgctccatagattacaaagcattttcttcacttgccttacatcctgtgtgggaaggaagtctttccttcctggaggcaacgggtaagaagagcaactagacagtgtgtagctccttactctcggtaggcatttcgtcatatggagcatgacttattgacttgcttctgttctttctcatgagctactcagtgtcaggagtacagggcttgacttaaacatagggatactcaaaggcccacctggcagtttgttgttgggacacagggaagcagattgtgtctctgaagaggaggcttctgtcggtgtcagagcctggtggggaagaagggattggtcaatatttggctaaactccttcagctgttggtgcagcaaaaggcatggcagggcgtgggcagagatgcctgccaagcccggcctcagggcatgtacagctcccaaactggttgtctttgaggctgttatttatccaaataaggagaagcagtagttttgctgaccatctcagatttccaagccatgctccctggctggctgactgacttgctatttgaactgaaaacacgaaggtattcctttgaaatggagcagtcttgtggggctcgtgagtaccctagagtcattacttggaagaagattttttttgctccccacatttgtagataacatgaacatggcttggtctatttgacccttctcttgtgactctggcaacactcaatacagatggacctgatctgggacagaaatagtactcattttcagaggttcttgaaccactgccctcctttgaagaggattcaaaggtcagacctccacactgatttcttaacactagaatgcaagattattctagcacttcatagatcctggccctgttatctgacttcaggtaagatatttgaagtctctgagccccagtttgttcatctgtgaaatgggaattataatgtatctaatgggaatgagatgagaattaaatgaggtaattttggaaagcattggtaaataggaagtcacccaaaatattcattttcttccctatttccatcttctcttggcagatttaattgacaatatttataatagagaaattctagataattatgattgctgtccaaaggatttaaccaagctcacagtagaatggagattgtgatgtgaacgttcagtgaccctgcattactatgtccctctactcactaaagcagtggttctcaaagagtattccctgaaccagcaggtcagtatcacctggggacttgttagaaatacagattcctcggcaccacccgagacctactgaatcagacacagtggatgttagacccagtaatctgatttactaaactctccaggtgattctgaagcccaccatctgagagttggagaaccactgtccgagagtaactcactggttgggtcggtagtctagccattcccccagggcacctggactttcctatcccttgtccttgaccatgccttagttcctgcctggaatacctaagaaagggacctctttcttacctgctgaaattctattcatcattcatgaacccactctcacctcttcagaaaagtgttcctcagtcatccccaccataagaacctcattattctatgaactaccagagtatttgtctgttgcactcatttgacacttagcaaagttattcttgctttctcatattttaatgttcacgtacatgccttatttttcctactagaatgtaagttcttcagaggtagaaatcatgtcttacagatcccttttccctcatcagccttaaccctgggctttgtatataggtagctactctgtaaatatatggacccacagaatctcatcattggaatgggccttagagaaagtctacatgagatttcttatttacagataaagaaagggatgttgaccaggcgtgatggttgacgcttgtaatcctagcactctgggaggcctaggcaggaagatttcttgaggcaaggagtttgaggccagcctgggcaatgtagtgagctcttagctctacaaaaaaaaaaaatgttttttaattagctggggatggtagtgtgcacctataatcctacctattcaggaggctgaggtgggaggatcacttgaaccaaggaattcaaggcttcagtgagctatgatcacaccactgcactacaacctgagcaacagaatgagaccctgtctctttaaaactaaaaaaagtgaaaagaaagaaaacaatgttaacacctggaccaaaatgctagttccgggactccccatttggtgttcttcccccatcaccctgctgtgccgactgcggagaaacatacctgggggctttcagagccactggcctggccccaaaactagcaggtgttctcatgttctctgccacagacttcaactaaacccaaggaaagcagatgggttttcaaagctatactcatttaatttataaacctggaacctcttacattttttcataactaatgaaaactgggaaagtacaaaattttcattcataagcctataaaattgtataacaaatggcatcaattcctagccttacacgtgagaatttccccagctcacacactccgtatacttaggatacccatggaacttcttttatttttgaataaaagttcacagtgaagatcattcacagtggagcaggcggctcttctgaacccaggaagaatgggcatgagggcttttttaatctaggtccccatcattgtttttttcatgtttattttgaggaaaaattgaacctggcagatctgtgaattactgtctttcggtgttaccctctgggactattccctcagacaatcctttcttctcttgacacatgggctgatgttgtttggctgaggatcaaaataatggcacaactaaaacacctttcatcagaagtcatccataacataccctttaaaatttgctccacagacacagctcactttatgctgtatgttttttcttttgcttggtaatagaacctacacatatcctactgagatcaatatgaacacagcagaatgcaggcaatggaatgtgtttcctgtagacgggctaagacggtaacccaggtccacagagttggtttcagaaaagctataatcaaagaaggaggaacagtgaaggtagacatgagacaggcctgaaggggttaaacctactagggagcaattggtagtaagaagctgagaccacatgaggctgtgagaaaggagttattacagaaacagacatcctgggatttgagtagctccattgtgagaagacattgacagaccacgaataaatggccatatggtttccaagttgacatctgccattccccaatgtgtttaccaccattttctctcacgggctctgaaaaccatctatcctttacactgcaattgtatagtgtgaaattctacatagatcaacatcaattcattgtttcagtttaggtatatcatatcatcaaactaaaatatatatacattttaattttcatgctgtaatcatcctaaagttatataacactccatctagctgttttcatatctgtcctttaaactgcaattgtagagcataacattctttttttgtttttgtttttgttttgttttgttttgttttggtggtggggagacagagtcttgctctgttgcccaggctggagtacagctgcataatcttggctcactgcagcctccatctcccaggttccagcaattctcctgcctcagcctcccaagtagctgggattacaggtgtgtgctaccatgactggctagttttttgtacttttagtagagatggggtttcaccatgttgtccaggctggtctcaaactcctggcctcaggtgatccgcccaccttggcctcccacagtgctgggattacaggtgtgagctactgcacccggctgtatagcataaaattctacacagatcaacatcacctcattgtgtaaatttaggtatgttatatcatcaaactaaaatacatatatacattttaattctcacgttgttgtaatcatcctaaagttatataatgctctacctagctatttttgttcacgatataatcaatttggtcagtttctccagtgaaaagaaagaagagcatagagtgcagcgatggagaccctgtgcctctgtgggtggtgcatgcatctctgaggggcatggtcctgagaatgtcaccccataatggaattagggttgtaatggtaagggattttaatcagctaaggctcagatattttatttcataagtaatccggtgcctgtgactgatgatgactttgtgcatgcttctgtgtgtacatatatgtatatgtatacatatgtataacttgtgatatggtgatatccatatagtactgagtgatgtataatatcgataggtatatataagtataatatatataagcatatatactgatatatctattaaatataactaatatataactaattatataacttactcattttgaggcaagtagataaaacctaattgtaagtcaagagaggctctaaatcattcgagccgaagcccagtgagatgccccagtgattcttttcctttgctgtgaaaatctggacctgtgaatggagtgaggtacttctcaacagacttgttcatgtttcacaccatggccagaaatcgaataaggaatccatcagtgatcacgcgtgggcaggcatgaggaacatcgttctttgcagaatagcttgcagtgtcctgaagtgcacagcaggtcacacgcaaacaaccgaggaagctggggttcttgctgcctcactgcttagcagctatgggaagctgggtgaggttcttaactccctgcacttctgtttcccaactattcaaaaagacataagacacctgttctatgtctttcactgagttctggagcccatgaaatgtcacaattgagagccctttgtaaactgcaaactgctatgtgattattggagtgtttgtgggtggggtatggtgagcacggggatttaaaatctcttgttagaatatgaagtgtcacaagcaaataaagcagtatatcctatatggcaacatgtggttgacaagttacatagtagtttcaagaactgtcataaagagaaaaataaagtctaaggcgctaaaaagttgtagttgggtgccgcagataacttactagcatccaatctagaaaacattaaaagggagctgtgcataaaagaacaaggttcgtccaggaaatgggtggatgtgcagagatggagataagagaaggaattatttgtaccatctgttgcaagtggcataaaaaagatatcattttacaaactgtaactatttttggtacaaaaggaggttgtccttggcctggggaacatgggagtagcccagcagaagattgagtgtcagtgagaaggacatttttcttttatccatcctacagcactgcacaattattgattgtggcttggaagcgaaatgatttatttaacattacttctctattctgctccagattgagatctttaatcactgttggacccaggactggtcagccaggtctggccactggagggctcagtagagttcctctgtcaaaagatttatagaaataacgctcatcttaaatatagccataagctaaccgctgactggaccatctctttcctgggaattaaataattttggcagcagtctgtctgtctgtctgtctcatgtctgggagacattccgtttacaatcaaatgaaacaataggctaactaaaaccttacaaatggcaatcttcccaattttaccaatgcaaacaagatgaatttgaaattttttcaacgtaataatcccttcccttcctaatatcatcttcatatctataggcacagttcagattttctttgagcaaatgtaatttttttaaagccaatgaagaaatgaatatgaaagggaaaataggaatgaatatgtgtcacaatactattggccttgccagagcataaaaattacttcctgttgaggtaatcctgaatatttcctagcacgtccattcttaacactgactcagaaagaatacattgcttccactttgcttttaggcctagtcaatgaaaggaagagggaaaatgaagagtgggacactttatacactgctgggaagaggaacgtagtaatggctgtaatgtcccaaggtagagaaggcagagaaggatctggtgatgtaatcaaaccaaagcgtgggggtgttagtggttgcacacactcatactgaaccaaactttatggtgagttagcctgaaagagcccttctctggagaatgtgccttccactgagataaagccactgggtcctagatggcaccaggatattgtttaggaaattggcttgtctggttcattagcaggtactctggggcctttggagattgaactccacctctcttgggtgagcttggcgcttgctaaagagcatttaactcatcctgattcaccgcaggattgggctggctttcaaactcctgacagtgaattactgctcttgtaatgacgaatccatgcatgcatgctacagacagtgccctggagcattttgaaagtgaaaggaaattgctgtgaacctggcaggaaggaagagaagggagaggtaaactagacttcttctcgcattgaaccgaccgactctcattgtaacagggtcaacagaagccacctctctctagcgtaatggacatggtttcttgtggttttaccctttgttgcttttttttggagccagggtctcactctgtcacccaggctggagcgcaatggtgtgatcttggctcactgtagcctctcaacctctcaggctcaagtgatcctcccacctcagcctcccaagtagctgggaacacaggcatgcaccagcatgcccagctaagtttttactttttgtataggctgggcctccctatgttgcccaagctggtctcaaactcctgggctcaggggatcctcctgcttccacatcccaaagtgctaggattacaggcgtgagccacatagcacctagcccatagcagatatgggataacatgtcgaacatggcatgacttgcttagccaagcagcagagagacagagagttcactgtttgtttcctgggggacagcctggccccagacccttcacatacagtcactgggacaagcaaccctgcccataataagcaggtaaagaagaattataagagccatgtctgttagcacacctcacgccataagacagggtctttggaggatgtgataggggcggcatcgtggcctaatcagacaagggggaccactcctccatcccccttcctggaaagtacgtgcttgactgaagacacaaaacaaaacctgcctaatgtataccagattcatcagaagctgatagtgtgtgcctcccatactctggtgagaaataacaaacccttgctgattagattaaaagtcaagagcttccacattccttctactgttttccgacctcttaggtggcatctgttacaaccacttcatccaaatatttttcctagtgagacatcttaggagggtggcaatgtcacgtgctccatttgcccccttctttaataaccacaaagtgatttgatggcagtaaacagtttttttagaaagcctgcaaaggactggatttgaacttgaaagacgtcatggaattcttttggtcagcaagaacaacctctaaaagccttaaaatgttttaaaaatgcacaggctgcccagagcgtggtagttgggtgtggcgtgaagccagtggggcttccagcccagtgagtggagttccttgtcaccgtattcccacttggatagctttcggttccacccagtccccaagggctcagaaaacatgatggtaatcagagcctgcctgggagcgcaggagatgcttcctttctcccccaccttttgctagcaatgcattaatgccagtcctccgctgagagctgcacaagtcacttcgtgttgtggacacgcaccttcttgtacctgttcccctggaagataccagctgtgctgacagcggttgtagccagaggtctctggggatcgcctaccttctcgtccttcatcttgtttagggtggggcagaagggctctggtttcctttccagaatcccctctgcacagccctggtttgccctctctatctttccttctcgtttcagatgtattttccagggtgattgcagttccttgcccggcgctatgtaggactgattaatggctgctacccaaagttcagcgtggtaaaacagggctggttaattaatagacagcctccttatctccctcatgttttccctctggtgttaaaccaggagaagaggcttacgtttccttcagctgccaattcccagacttcaaaagtctggcagcaaagtgggtattgggtgctggtctaggtttttgcagtagcacctttaagtcaacagaaaactgatctgaaagttggctcctctggattgagtatgttgggttttttgacagtttcatttctcggtggctggttgtttgccctttctaatgatcctgtttgccttcagcgaaatatattttgtaatatttcctttgctgttaacccatttacctaggccgtttaaagttccttcattggtgttttccctgtaagcagttgttgaaggactgagtcacccgtgaggtagcctgtggttggatgtgggctgaggttattcagtgactaatttccaaggggaggagaaattgacttatcacggggaaggttactttttatccatgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaagtaagtggctttaattctttgagggtgaaagagtgtcttaagattccatttcagttttctctgcttacttcattgtgtggtctgattgagtggtatgtttacaaattctagacttggaagggtggggtttgaaatacaacaaactgtacataatattccttttccacaagcaatatatatatatataaatgctccacagacatgattacatgaggcagtttcccaagatgattttaaacaaatattttttatactaggttttttttttctggaaacaattttaatatgttgtttcttatcttacgttcaagaaacttctgaatgagtgatattcgatttgacttatggttcttttgggaaataatatatagctacatgtaagaatttctaactcagacttcagatcttaatttgaaatggccccagatattttctggtgtttcagaagtatggtgtaaacagcattttgatccgtgtgcagtctgtgggcagggacacctgcctgtcagcctgctattatgatgaggctcttgaagaaactaccctctttctaagaactggaagaactcaaataatgaagagacaatagaggtttgggcagtaatggaaagaagaaaagacagtgcctagccaagcagatgaatgaggtagaacagtcttgttcatacattgccattatatctagtgcagttgaatgaacattttctgtgtctgggcttaggtgcaggcaaatagttatctgtgttgtattcagataaggggttagaagaatctttatttttctgtgtcggtcatctctttcttgctgtaaaatgaaattgtttaaagcttacattatgacattagtgttgaaattctgtggggaaaaagtgtcaatggtacaacatagctagttacttaaactcactaagggaaaagagatgataagattagtagcatcagagagatcagtggcagaataagggactgggatatattaatgtgaatggcaactcgtatgtgtgtatgtgtatgtgtgtgtgtatgtgtgtgtgtgtgtgtgtgtgtgttgcttatttattttctttgtaagtttagtataattttctcccacaaggtctgactttgagtaccagcgcaggaaaaacccagtatgtatttaatgccatgtctttactcattagccaaataacagttaaaaaccaaaacaaaataaatctgtgttggtgacagattctaggaagatctctccttagtaagaatacccgcagcaaaggctgggtttgttttaaactgtgaattatacaatcttaaccatcatgctgcttccatctatcagattctggagtctctaaattctactttttattgcaagtgtgaccttggaaatcacattgaagacttgaaaacatccctccagtgatgtccccttaccttcccccacatcctaagagcgagttgccttaggttggtccctgtcttttatggtaggattcccaagttgtctgatcgtaagggttcattctagttgtggttttaaaacaaatgtttcccactctatattgggatcattgtgtcatttttcttcttgggctctgtttagagccaaggatgaaatacatgatcctggttctttttaaaactccgtcttagaaagtcagtcacagcttggcaaaccaacataagaattctgccaagacttccaacatctaagtcacctgtgttgatagagacattcaacctcagattaccaattctgtcacaaccgaatgtttgtattcagcgccactgtggataactcagattgatggtgactctttcggtgacccttttggatgatggcaagattattttgaagtggacagggcagggaagacacacaggattagctccagatccgggctgctgactgttcatggcaagcagccgtcctcattggctgaggtcccattctggttggttggtgtccatgccatactggatattagctgtaaaatatttcgactatcactggtgtttcccacatgaatgcccaatacaatgtatcagaattacttttagttaattgttatatttctttctaatctcatctatacataccactagtaaatctattgagatattctagttagatctttaaatgtttcattttaaaggttatttatatatctcctaaccattttttgcatgtcaccaagcatgtttttaaaatacctatgtaaatacctttgctgttttcaaagaaatgtactcaactttttatgaatttaaataaattttacattttctttttactaatattatttatccttctggacagttctatactctctagaatattttattttattttattttactttattttattggagacagagagtcttgctgtgtcgcccaggttggagtactgtggtgtattcttggctcactgcaacctccgcctcccaggctcaagcaattcgtgtgcctcagcctcctgagtagctggattacaggcgcatgcactgcgcctggctaatttttgtatttttttatagagacagggttttgccatgttgcccaagctggtctcaaactcctggcctcaagtgatccgcccacctcagcctcccaaaatgttgggattataggcgtgaaccactgcaccgagaccctagaatcttaatgtccctttttacactcctgccaaaaagaggaaagcttctgctggttaattgggatcgtagtcccccagataaagatgtactctgaaggtggctaaggaaggaaaagagaacagggaatagtgactgacctagttaggactgttgttcataccaagagggttctagatattatattgattgattgattgattgagacagagtctcactttgtcacccaggctggagtgcagtggtattatctcggctcactgcaacctccacctcccgggttcaagcaattctcctgcctcagcctcccgagtagctaggactacaggtgcatgccaccatgcccagctaatttttgtattattagtagagagggggttttgccacgttggccaggctggtctcgaactcctgacctcaagtgatccgcctgcctcggcctcccaaagtgctgggattacaggcctgagccactgtgcccaggcagttctacatattttaaatatttttctggaattaataacaataatgacaacagtacctaccatttgttgtatgtgatttgccttggacactgtgtaatgctttataaacagtggcatatttgagtcgatgtgatgaatttatctcgatgtttgttttggttggttattgcattgtgtaatctgattatgtggagaatttgcccacatatccgctgctcgctgagccagtccctcctgtattttatgacctgtgaagccctgtgctgcttcctgctgagccatactttgctttttattgagccctgaattgtgaaggcagagtgagagaggtatttatagaggatccgtgtcgctctcctgcaaaacctgtgtcacgcggttgcccagcctccctggaatgagcatcagtcaggtgtattatcatgcaatgaccttgggactgttccttctggtctaaagcactgagcacctgagtcatgagggtgtccaatgagcagggaggtcctcatgggctggagcatcagggcaggggccatgcagagcagacgcacctggagcctgacctcgaaccttcatatggatccccaagaactagcacatggggagagagaccctggagtgaggacagcatcaggatatcacaagttaggtttagagaagggagaacagattagcctatcataatgggagctctgtgtgtgttttgggaggggagtagagaggaagtggagataaaattgtaattgtgagggaggagcctgcatactccagggggcccagaaatagcccctataggagccaagaggccaattccgtggtgcccaggtcatgtattcaaaaagggctcccttttgttgctacatattagcaccttatttgcacttctcattggtcactttcattatgaaatccacttgtctatgtaaaacttgcagggcagggattctacaccgctggatccttccaggagcaagataaggaagccatgggagtcccactggttgttcctgcattcttatctacgaagtttaagaaagaaggtgccctctccatggcgcttgggagtttccatggaacttgggggcttctttagaactgtatcctagaataaccccaggcacttaccaagtgcttggtaaatactctttactacatgcagtgaatttttgtgataaagaagcagttagtttgtatcctgtgcattaggctctgtttcattttcaaccttctcctggtgcctctactatccctactgtcttccacatcatccacatcatggggtctcttggctgctcatcttggttcttgccattcaagcccccacctctttcctcgggtccctccctcatccaccctccaaccatttatacccttcttctctgtcacatctcctggaagtcaggatagggactgtgggctcctgtgacctcaccaatagaacttgaagaatggatggagcctgtctctccttccctcagttatttggagaatctcagtggtcatttccccactgcaccttgaccaaagcaaaaatatatgaaatcatcatatcctgagttatttttttttttattctactcccttgctaaacacagtaacatagttgcaaattacagttgaccattgaacaaggtgggagttagggatgctaagtcccccacacacagtaaaaaaaaaaatcagtgtagaggccaggtgcagtggctcatgcctataatcccagcactgtgggaggccgaggcaggcagatcacctgaggtcaggagttcaagactagccgggccaacatggagaaaccccgtctctactaaaaatgcaaaaattagctgggtgtggtggcacatgcctgtaatcccagctatttgggaggctgaggtaggagaatcacttgaacccaggaggtggagattgcagtgactgagctgagattgcgccactgcactccagcctgggagacagagcaagactccatctcaaaaaaaaaaaaaaaaaaaaaaaatctgtgtagaacttttacctccccgcaaacttaactactcacagcctactgttgaccagaacacttacagatgacttgaatggtcgattaacgcatagcttgaatgttatatatattatatactgtattcacataatcaagtaagctagagaaaagcaaatgttcttaagtaaaccataaggaagaaaaaaatgtgtttcctttctattaagtggaagtggatcatcataaaggtcttcatcctcgtcaacttcatgttgaataggtgagaaggaggaagagaagggcttggccttgctctctcaggagtggcaggggagggaggatatctgtgtatcagtcaacctgcacagttcaaagctgtgttcttcaagggtccactgccattgtactcttattgcttaattatttccttccagcctctccatgctgatttctcataggctcaaatgaagagttggtgaatgaatgaaacttcccttccaggttttcccccatgcatctcctttccccctgctcatctccctagattgtatccactttgaaagatgggaaacatggttactatttcccagggctaacagtagaaaaacgtgctcaggacaagttttagaagactcagcgtgagcactattgatacactagacctgcatttattaagcagcatctctaagaagctgtgacattaaaatttaagccaccacactattttttcctgaaatcccacaaaattgcactctccatcaggtgtattcatttcttgtggttgctgtaacaaattaccataaatttagtggcttaaaacgtcatgatttttttaaacaccataggtgtatcattttacttttatggagatcagaagtccttaatggattttgcacatcaatatcaatgtgtcggcagggtcatcctccctctggaggctccagagtgggatccatttcctcaccttttccagcttctagcagctgcccacattccttggctcatggccccttctcatagcaccttccaaactcttctaaccctacttccatcagcatagatctcccctggagctgatttccctgcctccttcctccgcatataaagacccttgtgattgccttgagttcaccaggataaagatctcccatctcaccatcctcaacttcaccccatctgcaaagtctcttttgccatgtaaggaaacatattcacagattccaggatgagggtgtatacatcttgcaggggaagtcacacggttacacactgagacttctcttgaaacacgaatatcaaagtcaactttctgatcccttgttttcttttcagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccaggtaaggtgcagtgagggtgaccgagggtggtacctgggcccatgtgtcactgtgggcagctctacaggggtcaaaccgacagaataaatgtctgagcacccatctctgcagcatgtcctgtggatgctgcaggagtcacagagtggtgtcaaagccaccattgtctgcaaatagtttctaaattggcaggggttacagtcattaagccatgttcaagaagacaggtgcagcaacaatagtaatcagtcccttgtgcctctggagcatggatctaagagcattatcatttgtataaatctgaataatttggaagaaaattgtcattagcagaagacagatgaaaagatcaaaaggtcataataattgatctgctactgctgaaaataaggagtgagtgttttcagttttaactgttggaaatggcagtttgtgtttttccttgtggaatacaattttgttttctcatctggttgtgggaagtggaaataatgtgtctgttttctaggaggataaacatctgaatttgcatgaaaatagaatggcttagatttaatatttatctaggagtggtgctgaaatcagcaaaatttttccagggaaagactctctggggacttgaatttctttttaaatagacatattttataatttaccaattcagaagcttcctactctatcttgaaaaccttccaaagttcatatagtaatagaaaagctaattttgataaagggaatttctctagcctgaattggttgaaacaagtcaacataataatcataaaaatctagccaaagaaattgagtccaaagaaggtttaagcatgctgctacctattgttatatatgaatcaaggggtatgaaaaataagatgtccaggccaagtgcagtggcttacgcctgtaatcccagcactttgggaggctgaggcaggtggatcacctgagctcaggagttctagacaagcctggccaacatggtgaaaatccatctctattaaaaatacaaaaattagtcgggtgtggtggcaggtgcctgtaatctcagctactcgggaggctgaggcaggagaatcacttgaacctgggaggtggaggttgcagtgagccaagatcgcaccatcacactccagcctgggggacaagagcaagacttcatctcaaaagaaaaaagaaaaataaggtgtctagatattcagttattcaataccttattagaaccactgcttctcactaaaaaatgttaatatcacttactattatataccatgtaaaaagaaggccaaaattgtgaatggaatgtgacctgtctaccttactgttttcacacacaagtcagaaagccctgaagtcctctttagcacagttttattatgaaagggcaatcccttcttacttgttcagttacagggaatatcatagcagaaagattccaggagacagaaagagaaagaacatgaaagttctgggatcattaatgaaacaaaagttctaactctctcatgtagctagaataacaacaacagtgaatggcttgatgatgcaggactaagaaaaaataaggattggaaaatagtattcattctctcctttccaaagtcctcatgaagtgaaattctaagcatcaaagaaagggactcttcccgtcactgcagacagctaaggggtataggataaacactcatagtggttcatgggaacagaccaatgtgacatctggagaggaatctaccaagatgtgcgataagtcttggaagcctgtgttgcatacttcacagaaaggataacacacctgtcccctttggcaggctttgaggtgctggttgggaaatggtatgttgctgaggggatggaacttacgggagcaagaatttagaccagaaaacaataaagataatttgtctcctgcatataatgttgagagccagaatcctacctcccacactgacctatcctagataaaagagcatcaggagcttgattttgccatgaccatattgaactgtttccaccccggttcttggatgataaaaacctgaatttgcatgaaaacagattagtttagatgtaatattcttttgggaatagtgctgaaattatcaaaatttttggccaaccaaagatggtgtctgccttctttccagaacctagctcagtgtcatctgtgtgattaccacgcacacacaacttaatgtacatccttgagcctcacttttcaagacgtttagttatggagagaataaaacaaaccctctgctgacctgtggagtcatctctgtatgggatcaaaatcttgaaagattttagcttttggtactatgggtattctttgagagcctccactcccttttttaaaaaagatctgccaaccctagagacttccattttgtaaaatttcagaaaattctatggacttcagttttacatgttagaaaacctttttagaaaatccaaattattctatttccagattaacaatataagaaaaactgacaaaacagatgaatattcacctaaaatacagtcattatcaccagtgtattctgacatatgattgtaattatgaatgtaattttacatgttcacatttttcattccccataatgtaaaatagcacaggaaaaattttatctcatacatcttgccaaggtgactccccacctgtaatcagcttatctccagagggtggaattggaatgcttgggtatatgtgggccggttagattctcttttcctagagacctgcacatagacacacagacacacagagacacacacataccacatggacacacaaagacacagacacacacagacacacgacacacacacaagacagacacacctacacattctctctacatttagactcactattgctgaaagacctaaacactccccgctaactcccctcagtcacatgtcaaaggtgaagaataattctctggtcaaaagaacttgagtctggaacttttgccctcagcactcctacatgcttcccccattgtttcttacatgggacaaagtgacaagggtgaagctcatgccatacttcctcctccaaggacagctcagaatctggccctgaactcttttagatatcttggtaactaggctgacatgtagcattcctggggaatgtataggaaggaggtgaatggcacctatcatttattgagagccttttatgagccaagcactatgtgaagtggtttctatacattatatgatgtaatcatcatgacaacccagtgagatatgtactatcatcatctcctttttacagatggagaaactgaggctcagagaggttaagtaacttgcccgaggccacaaagccagtaggtggcataaaatgtccaggactattaaagaattctacatattccatgctgtttaccactgtgcagtattctgccttgcaaatgagaactataagccccacctccacacaacagagaagttaattcaggagtgaattctaaacatttcaaccagaattcttcaaaaattgtttcaggactagatgctaagtaactgctcctaaaggatatttacaatcataaacacagtagaatttgcataattatgctgctaaatatacacatgccattttaaatataactgccctagctagtatattagcacaattatgcagaaataggggaagaaagaggacagcattcttggtagacttcatttttttaaatgcatctgagtactatgtcaaagaaaaatgttaaaaacaggaacatcagaaacaattaccgaagcacaaaattataatccattgtctcatctataccatgatgttatttagaaatgcttaatctgtgtaagtattgttaaagaattttcaaccccttaaagcttaacttcatgagcacagggtcgtataaagaaccaatccaatttctgttgcaatttcataatattaaaaagcaaataaatatgagagtgtttttcatatgagagtctcaagtgacattttacatcgaagatgtgaagctgcaaaaacaccagtgggaggctgagaaatcggtggctgtgctttctgttggcactgctgggttcttatgctgttctgaagagcacttcaatatagtagcccaaataactgtgggatgttagaaatcagagggaaaaattcttccttccacatgcatactttgaagacatccagtggtagcttttttgaaggaacatgatttggtaacagctctgttgacttgaaaatagctcactcaagactaagtaattgagtcttcagtcttatatttagtcacataccttgtgctaatgaatttggcatttctttctttctaaagatgcttcaatgagcatctagtaataataaattgcatctagaatatctgaagaacacagtgtctatggtataacattcttgtgatggtaggggtctcctaccagggactttggggtacagtgacagatcatagctgctttgactttcagaacagccattctagtgtctgagcttctagaaaagaaagcaatcttgagtgatgaagtggttttatccaagtgacttccattcagctaggactccaagtagagaatagtcctagtgaccaggagagactgcccaaggagaccatgtgtgacaaatggcttagtgcctgaggctctgtcttctctaggttgtaaaattacttcattaaacagcatcattatttctattcatggcacataaaacagcccttaagaattgtaaaattctgggacatttatgttttgctattttctatttgtagtttggatcatatactgtaatgtaaaatacctttagtgaaataacactcaaaattcaagagtgcttatcgcaaagtgactaccttgccttcgaaatatgtaacagattcctccaaattgatttttcaggacccagtaaacttgaactgagattgtatttttacactattctatacctagagcagctacattcgacaaattagcatagagttacactaggaagaaaaattttgcccattccgagcacctataactacagaaaagcaaacaacttgagtttctattatgatttttgaggcatggtagacttagcagaaccttctgtgtacaggaggaagcccacatggcaactggcagcttgtgtctgctgttaatcatttcacatcactttctcattttatgaggattcaatgttactatgttggtaacttttaggggtgagatggatccttggttaaacagttgatcaaatgaaagtctaaattcagatttatgtcattgaaaaatgttcactgcgactggaagacctttgaagatttcctaaaccatgatttatcctcctagaggacagtcagtttgaatgatgggaaaagaaggattacttgctttcctttcttgctggtatagtaaaaagtgagccacatcagcgatatcctaagtagttacagttagcatctcggtaaagcagagtttcttaacctctgtactgttgtcagtttgggcctgataatttgctgtagggggctgtcctgtgcattgtaggatgttgtcttagtccattctgtgttgctataaaaaatacctgagactgggtactttgtaaagagaagaggtttatttagctcatggttctagaggctgagaagttctagggcatggccctagcttctggcaaggccttttgtgctgcatcatagcatggcagagaaggtcaagggagaagtgaacccaggcaaagagggagaaatctgaggggggtctggtttcctaacaactcactctcatgggaacaaattcattactgatagaatgaatccaatctcttaaaagcgagagcaagaaatcactcactacattgagaacagcatgaggcccttcatgagggatctgcccccataacccaaacaccttccactaggccccacctcccagcactgccacgtgggggatcacatttcaacatgagttttagtggggacaaaccatatccaaaccgtagcagatgtttagcagcatctctggcctctacccactggaagccagtagcaaataccaactaccaatcctgacctagccaggataatcaaagacatctctagatattgtaatgccctgcccaggggggcaaaatgccccagcttagaaacgttgctctaaaggaaatttgaactttttctacttttaataaaatagagaaatgaaagaataccccatgttcaagcaatgtaaattgtgacattcgtaaggcaaggaccaggacagttattacctccattctgccctcctcctcgtgataaagcaactcattattgatagagcttgctatgactaccttcaggtcagtcaatctgctcatcaaccagttgttcagaggcagtaacttgtaatggacttccaagccagagtgcctgggttcaaatcccagttctaacacttgccagcagatgggacctttgacaaagtaccgaatcttgctctgcctccatttgctcaactgtgacatagagataataatagtatctaccccacaggatgcaacaactcattacagttcagtgtgttatggcagcctgggatatactaagtggctgagagtttctagtttgagcaaagcactctactaagtgctactaaagaggaatgtaaatacacagagttggcaaggatgaggaactccccgaagaagcagggagagacatttctgaatataatatcagaaaacacgtaaggtgagcaagggtgagagaattaaactaaatgtgaacacagaatagaatgagctgggcttacagatccaaattagaatgtttagagtatcaaaactgcttcgaagttcatttcaggaaagtagccagggttgcacatctgcttgggtccaggggcaaaaagacaagctaggttcagggcatccttttaaaactgcatctgagctataagactgaagataagacagctaagccaggtatgcgtgaaatcattaggttatctgttttgatgcctaatagtgcttgactgattcagctcttgtctgaattgctttttcatgtagctgtaattatggatcaataaatgtttattgagctgctcttatgtgcttagctgtggactggaggatttgctgcatacaaagaaactgagatatggttcccatacaccaggaacataaaccatgaagacagtcataaaatattaaaagcttaatataaacatataagctttgtcacggtttaagtacaggaagcttcggagttacaaatgcctactgaatacctgtttttgagaaacaaccacaatcattgaatttcacacgtgatatttcttttggctttggtgatgcccagggatgctcttcttgtcattcctgagagtgacaatgtctccttgtgagtcagagaggagagaaggggacatgccaagtcacatggcacccccagaggcttgagctccagagaaagatctcttcccagcttcccaaagtccagcttggaagtcaggacacgttttccttgaaaacaatgaggaacgacgacaggactaataatacattgtaggttaaagaggcttccatgggccagctggaaatccaaccaccatttattccaagttctaaacaatgaaagtacaagtaaacttttcaatgacaagcctgccataatttggggtctgcttgtacataattaattccaaagaagtgatacagacggtaattgctatgaattcagaaaagggaacattttcccaaagttatgtgggtctcagagccttcttgagaacattgagatggtctagaattgagggcatgtacgtaatgaaaagatgtcatttgggaaagaccaactagtctctatccaaaatttgctatacttttaccatcatggtacctataaaaatgacatctcgatatgatgttttgccagtctcagaaatcaagtgctgaccaactgaattgttatttcgttcacaggagtggaatttcatggttaagtcatatttgctagttattccttagactcctgagttcaggcatcagatacttgataaacatactagaccaactaacagatttatgcagctagctctattcttacaccagggatactctgtcagaaatgccaatggaatagcagccacaaggtctgtgtgctactttaaacaaatcaatatctcaaaaggaaaaggcgtcgtctgtcactaattagatcaaattaaaatgtgctgctgtatctcctttgaatattcatgaggtgctctcaatcagaagccctaagtctgagaccagaaacttaagccagaaaaaactaaatactgtgagattcagataactcggtcctttgccaactagaacttcaaagagaagaggaatagcttaggtgcagagtaagcctcctgaaaagatgacaaaatcagcttaatgcagaatcgtggggttcccacccaacctaaagatggatcgtcaaaatagcccaggagctgataatcctagactctgttgacacacaggacacatagtttagcctctcttgtgatttacttgtccttctgtctggcggaaaccatggagattacacttgtccttatttgaattctggacttcatttttcatgaatgaagtgattcaaaaaatacagctgggtctaagcatgaattctaactttcaaaaatcacagatcttaaaaagtctgtattgaactgggtgcagtaactcatgcctgtaattccagcatgttaggaggctgaggcaggagggccacttgagccctggagttcaagaccagcctgggcaacagagtgagatcccatctctacaaaagactttttgaaaaattaggtgtggtggcacatgcttgtagccctaggtgctcaggaggctaaggtggaaggatcacttgagcccaggagttggaggctgcagtgagctatgattgcactactgcactccagcctgggcaacagagcaagatcctgtctcaaaaaaaaaaaaaaaaaaagtctgtatatactcatgcagggccaacttgtatcaccagtaaatacttcctctgtctccttgtccatcctcaaagctaaagagaccttggagaatactgggtcctaatagctgactttacagcaggagaaacagcaaggagacttcctaaaggtccaaggatgggagctactctagttaaatgacatttcgctatcctgctgccttaagggtggctccagccattgctcttgacctcacagccacccactgggccactccacctccatctctcacctgacttgctacagtggtctcccaaaaggtctccccactcagtccctgcccaccttccgcctgttctcattggggaggccagagtgaccccgttaaaacgtgagacctttcatgtcgagcctcagctcaggactcgccgtggcccccctcacattttgtctttgcaagcacaagtaactaagacaaaacaaaaaggaaatgcactagagagaccaaatatagcaaatgtttttttcttttccctaagagtcattattttatttcttttgagtccgccctaagatttacagctctaaagcaggcgagagtggggagttcatttccacagtcaccatgaggtccactcaagagaccatctctcctgacaccgtctctcatttgaaggtaaattagctggccgtgttcagctggcccataacatgaagcaactgctattcctacctgtttgtacctgtgcaaaaaatgagatgtcaattccagaacacaaatgttccagattagcctcagggaagagaaagaaaatgcaaaacaggtgatttcataaagcagggtgtaggcttgccctggggagtggcggctctaggcacccagcagagagccaacaggaagtgaagtgcctcaccctagatgtgagtcactaagggaggcagctcagtgccacagagagccctggatccgagaaagcctgcaagctaattgatctgtttccctaagaaaagccctgcctggctaagcctcagtgtcttttgtcctaataaggggatgataatctactcaagagttctgtgcaatttttatttttatttttattatatttatgtgtatatatatgtatatatgtatatgtgtgtgtatatatatatagatatacatatatattgatatacatatatatagatagatagatatacatatatatatatatatatttttttttttttttttttttttgaaacagtctcgctctgttgcccaggctggagtgcagtggcatgatctcggctcactgcaacctccgcctcccgggttcaaacaattctcctgcctcagcctcccaagtagctggtattacagaagcccaccacagtagcccagctaattttttgtatttttagtagagacaaggtttcaccatgttggccaggctggttttgaactcctgacttcaagggatccgcccacctcggcctcccaaagtgctgggattacaggtgtgagccaccgtgtatggcctatttttatttttcaatgtattattattttagagatgtggtcttgctctgtcacccaggctggaacgcagtggtgcaatcatagctcactgcagcctcgaactcctgggcttaagcaagcctcccccacctcagcctcccaaaatttggggattacaagtgtgagccactgtgcctggcagagggacaagttctgtgcaatttaaatgaaaatagctattagatcactttgtgtactggacagttttctatgaataaatttttcattgacataaaaccatgaagccatagagttgtgccagcccttcggatctgaggggggttgtgtccttattcctgacttggggctgtttcctggtcccatccagaacagcctacacagaaagtgaattgtgaaatagattaaaggctgcctggagccttccctaagtgcatttgctgtgctgggcagagcactgctagaacctgggaagccaattgtgcatgcggggaacaccaggcctgggtgggactgagcttggacctcctggttggacctgcccgctttttttttttttttttaatagcttcattcaagatcacagacccagaatgggaagagctatgggatttatgtaaatcccttccaaccagaaacttatgtaattccaggattctaagtgaggctggatttctgtgggtagtgggtgtgagagaatgggtacccctgtttaacaaggggtaggggccttctgagactgtttcctctacagagtaagggttcgttcagccttttccgtggcctgccaagaactcaactccatgttccctcacttcctgtaattgaccttgtccaggactttctgaccttggagaattcacctttgctctttctgctgcttcgtgcattcttccaccaaatgtctaactgactggctcctctccaaactcaaggctttgccaaatgccaccagctcagggaggcctttcctggccatgacacttgaagttgcaacactcccccgcagtctcccgtgccccagatgtaagttccatgagggcaagccctgtgcttttaccaccatatccccagcatcttgagctgtgcctggcccaagaaatatttgttgaatgaatgaatttaaagggatatcatgaaggcttacacatcctcaatggtttacaggttataatgtgcttcgctacacatttttctcatttgccctcattttgatgtctctgtagggtgacagcctttgggacaggtaaggcagttgttttcccaattcgatggttaaggagcggagacccagagacgttaagtgacttctgagtggagatttgtatctccccgtggatgtctgttaatgaacttgaatgcagcatgcccaaaaataaagtcctatcttccccacatcaggtaacaacagcttcattcatctagtcactcaggccaaaagtcttggtgtcatcttgattgctgtctccccaaccctgcgtttggacacccagacccagagaacagtaagatctgtactcagaggtttcctggctccagccattgctctcgacctcacagctacccattgggccaagccacctccagctctcacctgacttgctgcagtggtctcccaagaggtctctccactcagtccctgccaccttcagcctgttctcagtggagggggccagagtgaccctgttaaaacatgagacctttcacgtccaacctcagctcagacttccccatggttcctatcacactcagggtcaaagtgagagtccctaagatgacacacaagtagggagaatgcccttctcggctggactgggacagctccagggtatccctattgtccttgtacaatacttgcaatgaccaatggctcccctgtccactttctgaagtatcctggtgtggagaataaatgatttgattcccctcgccacaagccctggacaggtcaaccgtctgcccctctgacatcatttcaatcaccctccccttccttccttcactgcaggcacactggcctccccagctctcctcagtactgccaggcatgctcctgccttgggcagagtgtatatgtgtgagtgcacctgcccttcccacagcctagaacgttcctcctccagacagcacacatggcctgctctctcacttccttaaggtctttattcaaaagtgactttctcagtgaagccctgtctgctcaccctgcgtaaaatttcagctcttctttctatctctcttcccagatttttttttctccttcatgttcgttggtgtctaaggtttatcatctatttcgctaatggtcagtagaatgtaacctccacgtaagcaaggagttttgtctgttttgttcatgtctatgtccttagtgcctggagcattccctagtatgcagtaggtgctcaataaatgtcagttggattaatggctgaaagaaaggtcaccgctgtaaggatggagtcagagaacaaacacagttaattcctggtccactgtttttgcttccactaaattgtatttggtctacggcttctccgcttgccctggaaccctgctcagaacactgctcccttctccttcttcttctccctccggataaattctgccattcttttcagcatcattcacatctcacctattataagaacttgttcttccgcagcctattgctccgtctccaccatccaggagtaccttattgatagcactgagcacagaggaaccccacagaattctggctgggctgtagccaccatgcccacccaagccaagtcatccgaagcctaggatcaggaagaaaggcatcagcatcactgactctcagcgcccgtcatggtgctcacgcacaaagtgatggtggaagtgaactgaaattgacatgataatcaatcgtctcccgaggccatgaagaaaataaacagcatccctaggagtatgtgaagaactatttattagagagaataccatcatcgccacagcattccctttccacatctcattgccagttttcattctgtcaacacctcagtgaatttatgaagaaagattagaaatagctttttcctctagatccttgtaaatggagcttcatttttgcctgttttttttacaggtatccttaaatgtgtctgtcttcctgcactgtaagtgaaatgcagaacattttagatgagcccctttgttaggttacagactctttcctgacttgggaaaagtgcctaatgagaaggtttcccccaactctgtctccttgaagattaccagaaggagaggacataggaagaaatagaaggggcacaaggggccttttcttctcatttattaccctcctctgtcattcagaaagcaacgtcagtatagcatgggaacagcaaggctgaaaaatagcccagatgcaatggggttcagttgggataatgttgaaagtattcagggtccaacctgggtaagaggcaggagaaatgaccagagactgttcagacagtatcgaaggtggagaaagcaaggccaggctacagataaagaaatagtttgtatgaataagagaaatgaagacaacaaaaaatcgccatacttagagggggtcttggagtttcagatctagacagtaacaccattctgagttagaactcaaggtcagaggatggctgtaaagattttgaggctgtatagtgccaaatttctgtaggggttgtaagtatggatgttgaagctacaaaggatggcagctggggtatggtggatgggagcaccagggatgggaggggatttcctgggtagtggtagggaacttagggatgagatagtcaagaattccaaagcaggggagatactgagacattagacgaaacaaaatattgaagtgctttttaggggagacagaacgtagccagtcttcttgctcatgccataagcacagggcccggggagaagaaatggcagccctgactgcccactacaccagtgtctcccaaatagatctaaatgtgtcaatgagaagttaaatgtattgggagtttggggaacaatgtctttagttacacagcttttccaccaataggttaacttctggcagaaatagaaaggtcattgcttagagtcacatttgaagctttaccacaaattcagacaatttaaattcctttgttttgttgaactcgtctgaaaacagtctttaattactttgggtttttttttcctcataccagagtcagggcatgaacaaacaagggcatagcctcgctttaaacctgttcactattgcatcctggaaaaatgccttcggcactgccaagatcaaagagttttagttcaggtagattgctcctagaaaaaaggaaattgacattgtcaaagaaaggcatgcctgggaaaggggatgcagtgcctctgctgtgtccacggcagctagcatgttacctagcacgtattaagggctcaaaaatatttgttgattgactctttggccatgtaacactttctggggtggggagagagatgacagggaatgagcaggaatacaaagaaaaaaattgcaaaatttagaactagaagcaaatggcggaaccacctagtagggactctcagaaggccagaatactgcagttgttactgactacagtgggttgaggctgcagtgagctatgatcattcgtgctgtactccagcctgggaacagagtgagaccttgtctcaaaaaaaaaaaaagttctataaatggagtcactggctaaaaatcatcccctaactggttaggaaggttaatgcttcagattagggactaatcacatcagctcggctagctggtttcagccatcttctgtaatatgtcttctggaaacttaagaacaaatcctttgggattcttaataggggaatcgccagcttcatatgctactgacttgtttcttaatagccattcatttacttagatatataataaggacttaattcaggcttagtgacactttggtcagtacaaagtctctagtcaaaaaaaaaaaaatcaaggtgaaacttgaatcaaaaagttatataagtgggccaggcatggtggcttatgcctgtaattccaacactttgggaggccgatctcgcttgagtccaggagatcaagaccagcctgggcaacatggtgaaaccccatctctactaaaaatacaaaagaattagccaggcgtggtggtgcatgcctgtggtgccagctacttggggggctgaggtgaaaggatctcttgagctcggtgagttgaggctgcagtgagctatgatcatgccactgtattccagcctgggaacagagtgagaacctgtcaaaaaaaaaaaaaaaaaaaaaaaaaggttctataaatggagtcattggctaaaaatcatcccctaaacacagattcttttttttccttttctgtgttccaaaggcagaacagaccaccagcggtatgaattttgcttcgtcttcacagacagacatggagcttgcaggaaagttgtttagagtaatcggacttttaacactggaaacagcacttccctgaatttgacttgagtttttttattaatattatgtttggatcatgagaagactcattcagacaggctgacttaagacattaaatgactagttaaccatatacactaatcacataaatatggtttgtggaatgatataaaatggtttacgaaatcatttttaagccatcttttcaacagtaattgtatcagtcctgtcatattttaaaccaagcgatattggcaagaatgagcctaaatgtctttaatattctgatgatgagcatgaaaaattgccactgcaataaaatgacagggttgtgttcatttctcttcttccatggcactttgctttcttccctttcaactttaaaacacacttcctaacatttcatcatgggagaaggctgcataagtttccagttgctgtaatttacttaaaccataaaattgtttccagattaccaaccataaaatggaaagacaatcttatttattaatgtataaatcagataatgtccccaatatgaatcctgaaaccagacacactttgacgattaaataggagggaaaatgttttctcattaccatatgtcaaaagaatggtatttttgtgaagtggctttggtcaagagagtagagcatacacttgtattcggtgctctgtgtgctcccacccaggagagaatggcttcccctctactgtcaagcatctgaactctccaggggggatgtcagatgagaagccacctgactcagtatctctgatgcagcgtgtctctttcctggtggccttgcaggtgacatgccctgaacgaggccatccagggagccttcactcccttcctcacagatacaaaaaggcaagccaagcatgtgggtacctggagtgcatatagcccttttgttctaaaagcacccagactcttatcccagaccgttctgcaactctgtcaatgtcagccttaaagaagaataggatgttgtttgggagttgtctctctctgcaccctaaaactattacctggtgggagctcagggtagaagctgagtactcactgagccaaggaacatgccgaaggtgtgtctgcagctccccagacttccatgtgtagatgacgtggtctgtgttgtgacattctatagttctaacctcgaggatgaatcagtagaggagcagcaatgttgtttatccagaatgattcaggtgctttgtttctttttttttttcctttttttttttttttttttttgagacagagtctcgctctgtctcccaggctggagtgcagtggtgcaatctctgctcactgcaacttctgcctcctgggttcaagtgattctcctgcctcagcctcccgagtagctgggattacagtcatgtgccaccacacccagctaatttttgtatttttagtagagacgggatttcaccatgttggccaggctggtctcgaactcttgacctcaagtgatccacctgccttggcctcccaaagcactgggattacagatgtgagccactgcgcccagcctgttttgaattttaatgctgatgctctcctttgttggacgatgtaatgaaacctgttgaccagactggaagcagaaagaaggctggtctagccctaaccagcattgttcttgtggccagcgatggaatcccaggactcccctctgccatttccctcttagcagagtctcatttagtctctacataaatgagacctacctatttcttgcatttcttaatattactgtcttctgcatgtactaaggttgtcatcatgccttcctatcccacactccagctgtacagaaccctttaagcaacttccttaccaaagctgtctagactctaaaaatgccacgttacctttttttttttcttaaaggaatatcctttgcatttgcctaggattgaagaaaagcagtaaagtggtacatctcaaggtagccctgaatgcacctctgctcttactgtcattcattttactccagcaccactgcggatagagtccctgtgggacgaatgaggacactgggcaactttcacctggggctgagcattcttccgaggaagtcattcatttcccaagagtgtgtgcaagtctgtgccccccatgtggcaggaagagtgaccaaccaccactcccattttttctgagatgctactgtgacttgggtcaataagcttgacattgctgatggatgttcactaacctgctttccttatttgaatttcttaccattgtttctctttgatatgtggactattttatggcaaagagggttgccaaggtatgactgaaatgctatatggctgagaggtttagcatcggctggtgtacctggaaacatttgcaaatcactccgtggagatatatttccacactcaccgtttgagatttcttatttccattctattacagcagagagaccatactattaatacttaaaattgcttggtgttttttttcctccttggtggatttgcaacctttaactatccagactgcatgacttatatgcaagaaactcagtattgtgacagaccttcaattttaaactaaagaaaatgcatggagttctgatatcagaagcttccaattacaaaattaagatcagtgttacatatggcactgagagttacattccaaaggcaaaactcaaggccgcaatgcttgagttggacaaaattacccttgaatatcatcttgattgtcacaaaattcaggatgcagatgcaccagcttaatcagttggctttttctagtggaagaacaggccatcattactttttttttttttgagacagtcttgcactgtcacccaggatggagtgcagtggcgcgatctcagctcactgtagcctccacctcccaggttcccgtgattctcctgcctcagcctcccgagtagctgggattacaggcatgcacaaccacacccaactaatttttgtatttatagtagagacggggtttcaccatgttggccaggctggtctcgaagttctgacctcaggtgatccgcccacctgggcctcccaaagtgctggaattacaggcaggagccaccgtgcccggccagaccatcattactttttccactgacaatcagataaattagccagcatgtatttaatagtgtaagaatatactgtttgcagcatgggaatccccaccactcacaaacccagaggcctgtgggactgagatccgcagtgaggagtgaggtcccctctcttatctcaggctcatgcaaggacactcactcatgggagataacagcacaggcaatgcccatgccatatacattgttctcctctctctccttttcctgttttgaactaacaaatatgcataactgaattcacatgaggtgacatgtgaagcctctattcacttactcgtattgttgtttttaacaatgtgttgaaaacatggcaatagttctgcgaaacgtccattgtctgaggtctagaaatgtgagtctatttcaaatgccagctaaactgtaatgaaacatcaaagagccctggagagagaggaacagtatctgtatatggaaatcattgggaaatttttcattaacatcttgagatggccaagctgttagggatattcgtgttcctgcgtgattctataaaaacctccaggctaaagttcctatgacattagatctaacatcatctaccttcaaataaatgggttgttttgttttgttttgagacagagtctcactcttttgcccagtctgtagttcactggtgcaatcttggtagcagagacagggtttcaccatgttggccaagctggtctcaaactcctgacctcaggtgatctgcccacctcggcttcccaaagtgctgggattacaggtgtgagccaccgcgcccggccgggtttcagtcatatttctccatggtctaaagaagagacatgtttgtgttgcccctaagctgtgacacaagtgttactacccacacagcaaacagctccatcatttacaccaaaaccactccgcagcctcccagctgaggtgtacggcatagaaatgtgtgcagctaggtgagatctggcctgggacactgcgaatgctagggaacagcccttttgtgcaaggtgaaagaaagaaagcagggcagaaagactcaaaaacataggatgtgcaaacaggagtgtttccgagggagatgtctttgagttggtccgtgctgtgtctttttttagccagtcaggtcactggcttgatactgaacactgatcacgaatcttgacctgagctaaggatgtgcggctcttcatgttcctgagccaggttgggtgaacttccacggccttctaggtggtaccttttataaccctcaggtggtgcattcacccggacaaactggtttgaaagtccataaagctttaacaaacaattctcttgttttacagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggtaagtaagtgtttttggagctgtaggaggcctgtgggctgcctgggatgagccctggctggtctcagaaatgtttaacatttccctaagtcacgtatttggtatgatgtcaggggattcctagatattcctgccaatactgaaattccagatttattcattaattcgggggcaaagcactgtattctcccttcggttttcattcattcgctcattcatttgttcattgatatggccacacggtggtcatcttgcagacacggggctgcctgcctagaacttagaattcagtggggaagatggaaatgggacaagtaattttatgtgtgtcaagtgtttaaaagtgcaggataaatgtttcaccaataggactagcctataccaagggcagtccccagacaaagtgacataaactaagcccagaaagatgaagaggacttagggggaagaagggttgtccagtcaagggaatttaaaattgttctaagtgcaaagtgaagccatcggaaggttgtacactggggaaggacatcagcccagctgcaatatggggatggatgagaagggacagtagccaataaggaatgaccagtgtccagatgggagaaaaaggagtacttggactagggcctactttttattttatctttttaatctcatgacagatgacaaggcctgctttttaaatgccagcattccccagaaagacagcccagttctgttagtagtggcgttcactagtatccaggtctttgcaatgaatgtctcatccagcagtctcaagccaggcctctgcaagaagatgaggtcttccctctcatcgggttagaaatagaaatccttagcaggaacacattcagatactaaattacacagaaagcatatggcaagttgggtgaaaccccaaatttagggaagccacgtgtactagttttgtgcagcacggtagagtagacagaattggggacttcagtttagggctctgttggtcgtggttcttctctggctgagcacaatttagctacaaagccaacagggccactctgccatcattcctgatcctgacgggatttgttgttttgcttagaaatcaatcagtggccttggccgaagccagagaattatttcacggaaattgctaaacttgtcttcagagcaattgccagtttgtttcggagatacttaattcattcattttttaaaatggattgtaaacttagggagaagaaaggaaactactaaatactaaaagctcccatccttctataatccattctagaaatgattcatatctgaaagcactgctctaagcaatatgtacgtgctgttttgtattctccttttatttctttttgctttatagagaagaagaagaagaataaatatgtagtgagtgcttcctatgcacttttcatgcattcactcatgaactccttaccgcagcatctagggagaggtacagtttttattctcatgttccagagaagaaaactgaatgcacatccacacacgtgacacacatcatcatagtccaaatgcctcccatttgaactccttttatgttaagatgcctcagtccctttaaagatatataggttgtttcatttctttgttctaaaaactcttgtcaatttcttttcaaatgtggggaaaggagccagtgtcatttcctcagatatatttcccaaagtggaatcggtgggtccaaagggacagttcagtgccactggtgacatgctgttagttttctcttctgaatggctgagctgatttgcaacgccactggcaatgagcacgtggactcactccccacgtctctgctaggtttggactttctcactctaacgtatcagggcgagatatcgtccacaggggcttcgttgccatagcagccttgtatagtgcacaaaatataataattcttccagaatgctaggaagtcagctacaagacaagtattatccctgttctgtagacaagtaaacggaattatatagaagtcaaggaactcatctggccaagagtaaaggaaaacccagacttcctggctacttatggaatgtgtagtttactgtggaaagagaacagatggaacctcccatctcaaaggtttttatactgagcattagatcatttaacacacaaaaccctataaggaagatgtcattacccatattttacatgaaaagaaacagaagctcagggaggttaggttagttttccaaagcgacacagctattaagagtgacagccaggctgggcatggtggctcatgcctgtaatctcaggaccttggaaggctgaagtgggaggactgcttgaggctaggagtttgagaccagcctgggcaatattgcaagaccctgtctccacaaaaaatgagcgtggtggtacatgtttgtagtcccacatacttgggaggctgaggtgggaagactgcttgagcccgagaggtcaaggctgcagtaagccgagatcaagccactgcacttcagcctgagtgacagagcaagaccttgtctcaaaaaaaaaaaaaaaaagtgacagcctgactggctgataattgagtagatagtggtgccactggctacaattaggcccgtattataatggacattggagactcagaagtgggcagggtgggaggggatgagggataaaaaaaactacgaattgggtacaaagtacactactcaggtgatgggtgtactaaaatctccgacttctccactatacaattcatccatgtatccaaaaactacttgttcctcaaaagttattgaaattatatatataatacaattaggcccacagagacagaaagagctttgtggaagacgagtggaaataatgaatttgacttgtttatggaaaagttcagtagtggcgtgaaggcgttagtatgtggatctgaagatgattgtgtgctgctgacgagggtgcgggagaccttggtgggtggtggtagcagaagtggcctccctagaaagtatgtccagcaagaagagaagtggacccagggacacaacatatcaggatttaaaaggttggcagaggaaggagttagaaaagagattgaccaagacggagcagcagaaagggaagaagatcatggaaagtttcaaagtgactaaaaggaaaagaagtggctgacaaagcttagtgtcacattgaagcaaaggagagagtccacaggggtgacaactagaagatcgctgaaatgaacataaagagccatttcagagaatgaaggagctatgacatgtaccaaatataggagattaagaggttatagatgaagatttttttaagtgagtatagattccattaagaaatttggttgtggcttggcatggtgacccacgcctataatcccagcactttggccgaggcaggaggatcgcttgaggccaggagttcaagaccaccctgggcaacatggcaaaaccccgtctctacaaaaaatacaaaaatattagccagatgtggtggcacatacccatagtcccagctttggaaggctgatgtgggaggatcacctgagaccaggaaggttgaggctcggggaattgcaccgctgcactcaagcctgagtgacagagcgaaaccatgttaaaacaaaaaaattgcgctgtgaaagttatcttcttaaaccagttatcagcattcaactgtaacaactagtacctagtcttcagccttttcctccatggaataaaagatcgaggggagggaggtaccttggtggcctcagaatgtgtaaggagaaagaggtatagaaagaatgtgtgatttcctttggctgaggaattagcagaatggttcttagtagcaaacagaaggtagcacagtgtcatctttgttggagaaataccttgttatcagaaatgatatggcatgttgtgagtgtgtgtgcgcctatccctcaaagagtgcctatccctctctgtctggggaatgatgataaagtaatttgactgattctgtaaggaaaacttccaatggattgtggtcagaatcactgacattggaaggcactgttaactctaacatgcagctgtcattggaaatgttatcagatatgttttacttggtactttcatagttggagaatatccttttgaacaacagcagagatgacaaatcttgctctttcgaggatgattttgatttgaggggtggaggaaccaccagaaattggtcagagccatgactggtgatgtgagtgaccatttaggcttagaaacataacgtggctgggcgcggtggcccacgcctgtaatcccagcactttgggaggccgaggcaggtggatcacctgaggtcaggagtccgagactagcctggataacatggtgaaacctcgtctctactaaaaatacaaaattaactgggtgttgtggtgtgcacctgtagtcccagctactcgggaggctgagacaggaaaatcgcttgcacccaggaggcagaggctgcagtgagccaagatcatgccactgcactccagcctggacaagacagagcgagactctgtctcaaaaaaaagaaagaaagaaacataacaaaaagctcgctatcgggtctcctggagctccattgtcagttctttaaaatgccttctggcctgctcccctgctgcctccccaagagggccattagaggggctgggagactggccctatttggatggtcactcatggatgaagaccatggggcgccagcagcatcagcatcgccaaggccaagcaagaaagaggatagtttcagggagctccctggctcatgagccactttgagctccactggggcctggctgagttgtgtgtgctggagcgggaaaggttcccgaaatgactgagccaggatggaaagacagggtaccaccacactatagccactccagggtctgcaagtggccagcagtgctctgtcctgcaaggccagcctggcctgtgacaaagctttacaggaaagagaactgaacagaagtgtgtgtgtgtgtgtgtgtgtgtgtgtgtgtgtctttattagtaacatggatccagcctctactccagaagagtgtgtgtgcgtgtgtgtgtgtgtctttattagtaacatggatccagcctttactccagaacagtgtgtgcatgcgtgtgtgtgtgtgcgtgtctttattagtaatatggatccagcctctactccagaagagtgtgtgcgtgtgtgtgtgtgtgtgtgtgtgtctttattagtaacatggatccagcctctactccaggtacctgtatcaatagaattgcattgtcctttttagagtcccctcctgaagaatttttgcatcttgccttattttcttactaaaggagttgtgtgcagatgccctctttcttttcattttggaaatctgaagggattcaggacagtacccagttcttactaatctccccttggcgattggctgaatctctgcccagaaataagttgcatgtccttaggttacatttgctgtgcagaaaataggcacataagcactctatattaggtctcagaattttaaaattagttttctctattataaaattgcagatattcagtatgcagattttagaaatacaaaaaattggccaagtgcggtggttcacgcctgtaatcctagctcttagggaggcagaggcaggaggatagcttgagcccaggtgttcgagacctgcctgggcaatacggtgagaccctgttctcaaaaataaaaaatagtaaacaaacaaacaaaaaaccttatattggaaaagcacagctggagataccgttaacactttgttttatacacttctaagcttttctctatgcaaacctgtgtgtttaaaaaagctctacttccaggggttaagaaaagaaaaaaaaattaaaataaaaaaaaaataaacaaaattgatcaattgatagaacaatcagtggatagatagataggagcataggcagctctgtggcctgtcttcctatggcactttcttactaaacttctagaatgtgatcattgcacactgcataccataacactgtgtgattcatatatatgcatattttttgtaatgagagaattaggcctttttagaattaccagtcatctgcattgggatgggatgcatagcttagactttcctttgtggccttctgagttctctgatgcacttttctcataggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccaggtattcctcatgcacggcggcctctgtctcggttgccctgagctcttcctaccttccttttcctaggggctccgtgaagacctagagaatgtagaaccatagaaacagcatggcttcctctctcacacacacaatccaagtctagagccttccactgcaactatagtcaatctataaccacttctttttttttttttttttttttttttttttttttttttgagacgtagtctcgctttgtcccccaggctggagtgcagtggcgcgatctcggctcactgcaagctccgtctcccgggttcacgccattctcctgcctcagcctcccgagtagctggaactacaggcgcccgccaccacgcccggctaattttttctatgttttagtagagacggggtttcaccgtgttagccaggatggtctcgatctcctgacctcgtgatccacctgcctcggcctcccaaagtgctgggattacagtcttgagccaccgcgtctggcctacaaccacttctttaagctgtgcgtacttttacgcaggaagagactctagggcatttgtttttggagaagagccgaaaggagaggggccacggggagcatgccgacagccagtgaaggctgacttctgacagcttggaggctccatcctcctccacactgaacggggacaaaggtggatagtcagccaagctttttttttttttttttttttcattttttttgcaaggatctgtgatgtatttagaactatgagtttagaatagaagatgaattcataaggaaaaaaagccatcatggtgatttgttacgaaaaacatctgcatttcattcagatactgtgatccatccgttccttgctcttttccattgttaaggaatatataaactctacgggaatcaggataagtgacccttcaggtcacgaatcttggtcaacaaatcccgtaaatctgccaaagcagaataagctgtctcctgggtaataaggaggtagagatgtgcatctctgcatgagaccacatatttgctctgtgcaccttctcccacctccctgccctggctggtaggttggtcgttgaggatacagtgctggcctaggctctatacagatatcctccctgacttccagaagctcataatccaaatagtgctagaagatagggccaggtgtcatggctcatgcctgtaatcccagcactttgggaggacgaggcaggtggatgacgaggtcaggacttcaagaccagcctggccaatgtggtgaaaccccatttatactgaaaaaaaattagccaggcatggtggggtgtgcctctagtcccagctactagggaggctgagacttgagaatcacttgaatgtggaaggcagaggttgcatgagccaggatagcaccattgcactccagcctgggcaatagaccaagactatgtctcaaaaaaaacaagataaatgtatccaggatcctggagcagccatggggatgcaacctcctgagccctttcctctaataggaaaaaggcttccaatcggttctgcttcttcagcacagcgacagcacaagccctaagttgtttaaccacctaatgaaagctaagaaaacaatttccccttgccctctgcctaccagaaaacacacagaaaggcagctggtttgagagacctgccccaaggccccagcatggatcatgacggttgctagaagagtgagggctctgatctccaaaggctactctgtctcttaggcaacatcccagataccttgaacatctgatgcaaattcatttaaatctcctagtgaatctcatcgtctgtgatggccccatcctttgcattagcttcctctcgctttgcaattttaaagacacattgcaatgaaatgaagtgtacgggttgggctgggttgtgtcagggggtgacaaagtcacatgtcttcagtgtccgggcagtaacagcaagtgaaatggaggagagaccacagtaaattggcccctttaaaggatagtagccactcagttccaactggctcttaacctgatagaataagtatccagtgtttctagatgtttcaatatttcaagcaaatctggagacacaggttttatatgaattaccgccatttaaaaatgttggaaagtaattgaaaactaattactgagtactctgcaggccaaaggacacaattgcagttcagagggggcctatcggctcccaagttcgttcttacctggggctcctggaggtcaagcccttcccttcactgctcctgccttttggcaccatctgctggccatttcgaaattgttacctcctcattgcgccctttaagaaaaacatacatatcatttgtatggaagtacctaactgctctcaaaagtgagcatttgttggtttggggacagggatggaattgctttagcataaatgccgcacttcccctgggaatttcacaggcgttagaggtgaatttgataccaaggctctcttgatgtctgtagctacagcgtcaccccatcagtggctggcgtagtttggtcctctggccggctgggagggatctctcacacttgtctcgccttgcaacccttgaactgtgcagctttgtgaaaaagagcagttttcttaaacaaagaaggtctttggtcaaggtctaggaatgctgtgttaaccacacaagtttctttattgctccagaactactcaacttttctggctttctgggaataaagaacagtgagcaaatgtgcttttgagcctgggaagttgggcagttctaaagcgcagactcgcagggaaaaataagcatggtgtttcctaacctggctgttactgtttctacctctgcatttgtattccctgggtcccattcagctttcctccccatcaaacttctgtcttttcaatcgagggagtctacttaagacaaaaacagcttagaataattaagctatctcggcaccaattctccttcaacatgtgcggtattatataccaaaaatgaactgcagccgcacagtggctctaagtccaataatggagctatcattagagatatacgaaacactagactagtctcaaaagaacaaaaattgaattagaaattcaaatattctttgaactgtgttataaaatagtgaaactgaataaaaccatttgtgcttggcagccagctccagtaattagataattaaatcattggaaaatcctagactgtagagcatatcctatttgagcatttcattttcaaaactgatggattattctcaggaatagaaatttgttgcagacacaatggggtgggtagatttcaatgggacaaggggaacctaagcagaagatcaaggaaaccactaaaagcttgttcatgttatcttctgctctccaatttcacaggagttatcggtctaagagtggttctcaatcctggctactcattagaattatttgaaacccttagcaaaaataccagtgctcaggcacgatggccagagtctgacttcactggcacggactggaggctaggcactggtgactctagaacattccagggtaaaaactactgtttttacctcttggctacaggtaatatgaatgcttagtccatgaagacacctcctggaaatgttgagatagccagctattaccaatgacttaaagccttgacttcaaacaatgcacctcattcccagtggctaatctagtatgttctctgctagctacatttggtatgagagctatatggaacctttatagtgtgatattcccattcccaaataacggttgggtctgtaattagctagcaacaatgggaaagggttttgtcaaggttttgtgcctaacagatgttctcctccaatgatgattatgtttgcctgttacctttcctgatatcattttgaaaaaaagcccactttttctaaataatgaacatctttttcccaaaatgccacagtacttggattttaccaaagtcatcccatatctacagaagtgactgcacttcttcccctccttgtgggtggctgaggagagagagagaagcttctggaagagatggtacaggttctgtggaggccagataggcttggcataaagagaggatggcgacctcctacttctttcatccccaatctctttattctgcttcctgataaataaaaaattgggttgttcattacatttgtaggactcctgagaatttactgtcccttcccaagagaaggaggaggtaaaatatcaacataaaaaataaacacagtagtgcatagagccctatgtatttgaaatgatacaattcaatacaatttccttaatgtgtctttttatgagatggcgcctcgtggaaatgtgccagggtctcatttatcttctgacatgcataacaatggtcacgggaatgcggatccctgagaacagcatattggagtttcccatgtgcaacagacccgtgtcccctgccaagcagaaataataaacggaactagtacagggcttgacgattaggctgcttacaatgtgccaaggtctagtcagatcttcagacaacaagaagctttctaagatggggagacagcaccccaataacatgggttatatagctgtgaccaggcatcccttgtcttgttccctgaagcctgcaggaacagatccaggtgggatcaggagtcgttctgaggtctggctttcctcctgaatctttctgatttgtggtataaccactgttccatgtcactgctagacagcaaaatcagtccaattacattatccattgttggcaagactgatagtcttagattttacctaagaaatcaaaattgagtatgtgagatataggtccattttcaggttgggggaattaggtttaggcatttgctagtttctccatgaagtgatttggataacttatttggtccaattaaaattttaatggacaagagcattatttctgtctcttattttacaagagtgcttataaaaatggcaaagcattttcaataaattatctttctagctatgaggaataactgcaactctacttgccctcccactgtgggcaactagaaaactgaaaaataagcaaatgtatgaaacaaatgttttcagaaattaaacaacacaggaccgtaatccttaggagaatggggggaaaaaacctacagttgacccagctttctgtctggaggcacttttcagatcttggtgcaggaaggaaaaacccaagcatggcactgacagtgagttgaggagataagaccaaagtttagagagagctgaaacagctagaactggtggactggagaaccaaacacaagaaagctctgcagagaaagaagtacatcaataaatgggtctgttattaaatattaagccaagcatgtacagtgtgaaagcaaccgctaagccaggcagaaactaagtcgggggctgtaagccaaaaagttcccgaagttcacacaggcctgggagatgttcacgttttgaaaagcaaaaagcgaagaggccttgttgagcacctgggcattttgtagagatcggagaaggactgtgcctcagtcttaggactaaactagccccagaggaaagactacccttgatttaacctaactgcttaaaaataagcctttaaaggacaaagctgatccacaagtaactggactgtctgccagagaaagtccaaaatctgtaaaggaaaacaacaaaattcagagctccatgcccaatatccactcaaaaattactagacatgtgatgatgctgacaaatgtgacctataacattaagaaaaatttgtcaagagaaaccaaccagacatggcagggataatgaaatcagcagcaaggacttcaaaacagctattataattattctcaaggatttaaaggaagacatgaacataatgaggaaagaaatggaagatataaaaaatatccaagtggagctttcaagagctgaaaaacaatatccaaatgtgcttaacagaagattaatcactgcccaaaatgtcagtcaccctaaaaacagcaatggaaactgttcaaactgaagtatagagagacaagagactaaagaaaatgaattaaaatgtagtgaccagtgagacaatattaataaaagatgaagtggaaagagaaaaatattcaaaaaggtaatgactgaattttttccaaatttgatgaaagctgtaaatccacagaccaaaaaagctcagtgaacccctagaatggtaagcacaatggaaattgcaccaaagcacatggtagtcaaattgctaaaaaccagagataaatggaaaaatcttcaaagcagctgggggtggagagaaaacccattacatacaggaatcacaattaagaattaatgccaacttctcatcagaaacaaaaggcaagtcaggacacagtggaatgacgtctttaaagtattgaaaggaagaaaagtctttcagaaaacagagaatacttcctaactcattttatgaagcctgcattaccctaagagcaaaaccagacaaaaatattataagggaagaaaaccacaaaccaatatccctcacgaaaatatatgtaacaaatccttaacaaaacgttagtaactgaatccagcaatatataaaaagaataatacattatcctggggttttattccaggaatgcaagattgttttaatacgaaaaaaatcaacgtatttgaccttattaacagaaaaatcgtatttcaataaatgcagaaaaagcatgtaacaaaatttagcatcaatgataaaaacagcgctctagaagtagaaggaagcttccttaccttgataaacaatgtttgtgaatgacctacagaaaacatagttaatggtgaaacactaaacacattccccataaaatcaggagcaaggccaagaaacctactctgacatctgtttaacactgtactgaagattgtagcaagttcagtatggctagagaaagaaatagagtcacacaaatcgaaatgtaaaatgtctaattggctttactcacaaatgacatgattatatatgtgtaacattaaatggaatctacaaaacatgctactagaaataagtgacttgagcaagatcacaagaatcaagtcaatgtacacaaatattaaaattttgttatatccatttgtacaatgaaatgccacttagcaataaaagaatgaatcactgaaaaactcagcaacagggctggatctcagaaaaacatattctgaacaaaataagctggacacaaaggagcacatgttatataattccatttttataacgttctagaacacaaagaactcatctataatgacagaaagcagagtggtggtttctttgggctggggcttggggattgattgtaaaaggtctcaaaggaattttttaggatgataaaatatatagctgtctttcagcagtggttacatcagtgtatacatttgtcaaaattcatcgaacggtgcacttaagatggatatgttttattgtctgtaaactttgtgcctcaagacagttgattttaactattgaaatgtaggtatcacctcttaagcaaaaaccaacttaacaatttgagcttccaaaaagtaatttacttgaagcatttagagaaagatggtgatccacatcatatctttagcacttttttacactgtgctcagataagcaggaactgtcctgcagcctggagacagtggcaagaacaccagacagggagggcagggggactgggaaagcagacagagaacctatgtagaccttgttcattcatgattcactcctcattgcccacgtgccagccggtgagctatgacagcttccctctttagtaccctcagcaggatcctgtaaggccccgctttctagacaggaggataataaagcctaggattgaaacagagcctctccctctcctcctcttctagtggagtaagtctagttgtgtttaaacattatgccccgttgtattttccaatatttcttatccttctcagaaacgttatattgcgattcattcatagagcaaatacagttgccccttgaacaacatgggggttggggtgctgacccctcatgcagtaagaaatccataacttttggctcccccaaacttaactactaatagcctactgttgagtggaagccttaccaataatataaacagttgattaacacatattttgtatgttgtacatattatatactatatttgtttttttcacatgcctgctgtgtcaaatatatactgtattctgacaataaagtaagttgaagaaaagaaaatgttattaagaaaatcataagaaagggaaaatcataatattcattaagtggaagtggatcattataaaggtcttcatcctcattgtcttctcattgaatagattgaggaagagaaggggttggtcttgctgtctcaggggtggcagaagaggaaggaaatctacatataagtggacccatgcatgcagttctaacctgtgttgttcaagtgtcaactgtatatgttgggtacctaccatgtgccacacgctgcttgtagctgtgaacaaaatggcatgctccctgccttgatagaagaacaacttggggtggtggggaaattgatgagttgaattcagaagacctggttctaatcctaactgtgctctctaattgccgagcacaccctgagcatgtcctttgacttctcagggcctcacttttcccacctttcaattttatgaattttaaatattccaccaataatttctagcatgatatccattgttaatatccactatctaaccagaccccagatttacgtaagcttgttttaaaatttgggcaggagggttaggtgccctgctgtgccccatagctcatggcacagtgacatcatctgtctattcaaaagcccttttcttagtccatgaaatcatccttggtggcaaatcgaatcatatgaggagttttagaaattcccaacaaccagacggtacctcagaccagtaaaatgagaatctctcagttgggacccaggcattggtcactcttagacccatttaattatctactcattttcccctcacaaccctgtcatcactcattcccgcccccttcaaaggcaggagctctgtgggattggacacagggactgaagttgagcaaatcatcttgatagcacgtggctttgctgtgtgtggttaatcaaccgatatgaacagtgctgacctgtagccctgccacatccccgcagtgagagcaagacaaggcacaggagagctgatcccaacacatatctaagcccatgggtcacagcaggtttcaaccatttagagaagaattttggattcttcattgttgcctgttcttatcaatgttactgattcattcagttcattcattcaacagatgtattttcagttttctgctaatatgccagacacagtgtaccagagactctgtggagggcagaaattaaccaggtggagggaagagcattctgggagatgggaatagcaggtgcaaaggcctggcaaataggagtctggcggaggttgcagtgagctgcgatcacaccactgcactccaccctgggcaacagagtgagactctgtctcaaaaaaaaaaaaaaaaaaaaaggagcctggcccctatgaagaactgaaatgatgtatggcttgagcagagtgccaggtgcatggagggagggagattagccacaagggaagcgaccagattgcccagcgcctggagaatgggctgcagccagagagagcataggaggatgttgttctctgtacactgtctctaaaaatggtgctttttggctgggcacggtggctcatgcctgtaatcccagcactttggaaggctgcggcgggcagatcacttgcggtcaggagttcgagacctgcctgatgatcatggagaaaccccatctctactaaaaattcaaaattagccgggtgtggtggtgtggtgggcacctgtaatcccagctacttgggaggctgaggcagaagaatcgtttgaacccgggaggcagaggttgcagtgaactgagatcgtgccattgcactccagcctgggcaacaagagtgaaactccatctcaaaaaaaacaaacaagcaaaaaaatgatgccttttagcaaaatagtgactgactggcttttaataccacaataaaaagacattagcaaaagtggtgtgagagcatgatcatgagtcctgtagagaaagtaaccaaaagtgatacatttctatgtggttccctcccagacaaaatgccaggctccacccactagttcaccctccctgttagcaatggctggtacgtgttcaggtttagattggtgccagacactttattttattgtctcaccgagtctccatgaccaacctacgagctatgagatattactaccccttttttggatagacacagaggtgaatagcttgcccatggacacacatctactaagtggtaaaactggaaatcgaacccaggcagtctttccccagaggccagttcatcaccatgcagtgctgatgttgggacctaatggtggttctgcttgtggcctgtgttgaaatgttttatctttattcagagaaaacagaaggcatgatgtggctttaagcaggtggtgacatggtcagattgcatttcccctcaatttacatggataatggacagttgacaaagacatcatcacccccatgagatgataaaccagtccatgaaaccggaaaacaggaaaccattgaaatttgttaaatgatatttcagtggaactttggggataatatactaggcataatatcattattgtgatggaggctgattgagtgaattcactcgatggagctgctgttagaaaattgtcctgctccagggactcaagtgctcaaccagactcctgcgaagcctgaataaagctcccacctcctatattctctgggatgagaaacaagaatgttctcggaactgtttggaaattgtgagttctgtatacaggtagcctacctccaatctagagaaattcataaattgccaaaagccctggactcatccagaatcattatcattgccaacattaaagtcctatgttttaagcatctgtgatttcatggtacttggtacatggaaccatgtgaacgaaaaggacacagatcctctttgaactgatactgacgtatttcatagccaaatcaccacgtgttgagttcccattctacaccatgcggtatttcatgtaaccctcaagaatggccaaggaaagtggattccccatcattagaggtaaggaaatgaagaccaagggagtctaaataatgggcccaaagtctcacagtgggctagagagagagtatgggattagacccaaagtcttcttggctccaaagcaggtgccctgtgctgctccctctaaagatacatcagtgagagtttacgcctgttgtccatgatgcattgaccagagtagaaaaaggatcctttgtcttgcaggcagtctggttgccagttggctgccaaaattcagatgttggtggaagaagccacattatgtacagtctttgctccctttcctttctcattgaaataagtaaagattcagccgcagggctgtctacccaaagtgctccgaagacttcaaggcattcactcgcctccatttcaggcaggcagagcccactgaggttgatttttttgtgttcacagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtggtgagtgccagtcacttgcatgttgagctgtttcacctgcaaaggaaaattatcattactaagaaggaggtccttcccagttggtggtcttgccctctctttattgagcacctactgtgtaaaagttagagttctgctgatgctggtatatgtggacacttcagcacctgtccatggaggcccaggaaattcagtggccctcaggtgactgaatttctttaaaagttgcggcattgctgggcatggtagttcacacctgtagtcccagttactcatgaggctgaggcgggaggattgcttgagtccaggagttcgagaccagcctgggtaacacagggagatcctgtctcttaaaaaaaaaaaaaaaacagagagagttgcagcttcatactctcctccagggctcagcaacacacaaaattaaaaggagtaaatggcaaaacccaatggcaaataggaagcctatatttcatctcaataaattaaaactaatggccaaaataacacagctctaaaattatcttcctattattcaactgtagttaaaattgcaaaagaagaatttaaatgtaaaatgtatctgatccagaatgaaaaatgcttccttagctgttatgaatgttatttaaggttcttattgaaagcatctatcaagtcctactattgaaatgagcagaattttattactcccccgtcaccaggcaggcacatcttttatggtaattgtatgttttggtatgcaatgaagatttatcatagaactatctcaccttttagtataatgaatagtaattttgaggggtttctccagtgttgataattctcttgtttcttggaaaacttaaatctttcaaatggggattgtaagggagcagtttgcaaactcttctcatggccataatgagaaaagatttccatgatggaaagcattgtgctcagtcacctatctcctattggagctgtggctcgtgtcgccctggatgccaacctaatgtgtttgattaaaattagagtgtccctctcagcagtctagagggaaaaaaacatcaatttgagttattcttttcctaataaattaaattaggctgctgttcatccatatctcaaaatagcttccaaaattctacttagttcacacatttatagacagagttaatcacccaccatgagttggtaaggctgttatttgtctgaaatgtctttgtgacagcccaattatctaaaactaggtctccagtttcttctttaaaacttcttttaaaatgcatatcctggctgggcacggaggctcatacctgtaatcccagcactttgggaggccgaggcagccagatcacctgaggtcaggagttcgagaccagcctggccaacatggcaaaaccccgtctctactaaaaatacaaaaaaaatagctggccattgtggtgtgtgcctgtagtcccagctactcaggaggctgaggcaagagaattgcttgaacccgggaggggaaggttgtggtgagccgagattgcaccactgcactccagcctgggcaacagagcacaactccgtctcaaaaaataatagtaaaaataaaaataaaaatatatatccttttaaaaacatttatataaattttccaataaaattatgaaaaaaaatttttttgagttggagtcttgctctgttgcccaggctggagtgcagtggcatgatctcggctcactgcaacctccaactcctgggttcaagcctattctcctatgtcagcctcccgagtagctgggattacaggtgcacaccatgatgcccagctaatttttgtatttttagtaaagacggcgtttcaccatattggtcaggctggtctcaaactcctgacctcaggtgatccacctgcctcagcctcccaaagtgttgggattacaggcatgagccaccacgcccggccagtaaatttcttctttttaaaaattgtgtttattggttagctgagataattctcacttctggcctagaaaagccatctttaatctcaataatactctgagattacagcctagcataggaatgagacagaaaaggtagtggaacgaacatatcataagagggctttatctggttggatttgtgggaaggccacagatgagtaaaagaggcaaagagcccttgaggatcttcagtctagcaaaggcaacctgataaataggagtatagccccgaacaggggatttacaggtaccagttgtacccacacaaaagagagactaacccagggatcaggaagacttaacctgaatgaagtcattctttgtatgacccacaggccacaaacagtatcttgcacatagtagtttcagaaatggtttgttaggctgggcacaatggttcatgcctatagtcccagcagtttgggaggctgaggtgggagaatcacttgggaccaggaattcaagaacaggctgggcaatatagcaggaccctgtctctactaaaaataaaaaattagccagctgtggtggcatgcctctgtagtctcagctactcaggaggctgaagcaggaggatcgtttgagcccaggagttcaaagctgcagtgagctatgactgcacctctgcattccagcatggatatcagagcaagactcaatctctaaaacaagaaagaagaaagaaagaaatggtttgttaaactcaactgaggtggccttgaagatggggagattgcatcagcagaggctagagatggaaggacttccaggcagtagaaccctgcaaaccaacaagtttctggcctggaaaatgcaagatgtctttagagaactggggagcagtccagttaggcagcagagttgggtgcaagatactaataacatcccatatttggggagtgtcattcccatttgcacactgacttcctgtatcttagaccatactcaggcctcacatacctgcttgatgcctgtctgggctgtgcctacagagattggaagattctgtaagagaaacctggatttctggcttttcttgaaagttccggggttcaaccccagattcacaatttctgtggatggggcttaggaatctgcagtttacaaacaaagccggtgattctgaagcactttcacatttgagagttactgcctagaatgatgaggaagacactgagtgtttgggtttgtttggtttttgtttttgatcaaggaagtagcaaagctagagctgtattggagagaggtccctctggtgatcatgtgccggactgattaagaggaaaatagatcagtgactaggagaccatatgggaagctactgtatccgtcaggcaaaaggcagtgaggcctgaaccacatagtagaagtaagaaagaagtcaaatgcaaaacgtcctatggtattcaccgtctaagactagctctcaaaattcttctttaaaacaccttttgaaatatatatccttttggctgggtgcagtggctcatgcctgtaaccccagcactttgggaggctgaggtgggaagatcgcttgagcccaggaattcaagaccagcctgggcaacgcaggaacacagggacacccaatgtctacaaaataaaaattaaaattaaaaataaaccctagccgatcatggtggcacacacctgtggtcccagctactcaggaagctgaggtaggagcatggcttgagcctggcgggtcaaggctgcacgatcacaccactgcaccccagcctgggtaacagagcaaaaccctgttaaaaaaaaaaaaaaaactaaaaatatctatatacatatatatccttttaataatggtagtgtaaattttccttccataaggtataaagtaggttaactgattggatggctagatctgaatggcaagacagcaggttataaaagacagctggaaatagctagaagagaagaactagaatgtttctagcatgaagaaaagacaaatatttaaggtgacggatatcccaagtacactgatttgatctgtacaaattatatgtactaaattatcacatgtaccccaaaactcacatctattatgcgtcgatttttaaaaagagcttattttttaaaagccagaaatttcaactctggaatatcagaacagtgatatccctctttccttcccctctccctcctcgttctcctttttgttcttctccttcttcttcttccaagtactagaatataagtctccttgtggagcatgttaggttgaattactggtgagccattcagaaggcagagagaagaaacttgggcctaaaactgtgaagagatgggctgggcacagtgattcacacctataatcccagcactttgggaggccaaggtgggtagatcacttgaggtcaggagttagagaccagtctggccaacatggcgaatccctatctctactgaaaatacaaaaattagctgggcatggtggcgggcacctgtaatcccagctactcagcaggctgaggcaagagaatcacttgaacccgggagacggaggttgcagtaagctaagatcaggccactgcactccagcctgggtgacagagagagactgtctaaaaataaaaaaataaaactatgaaaagaaattgggtctagataatttctacatgaaaataataattggtcttctaataacagtcaagtgaaatacattccaacaaactgcatgcttctttttaacaaagctaggatgaaaagccacttaaacaaatagaatgctgtaaactgtgacgtctatgaatatctgacattctgtggagcaaagctgatattttaaaagtcatattgattaccatgtcaaaaatttatttccagcattcattttagccccatgtctctgttacatttttgaatgaacaaatttgatttttaatgttttatctaaagtaggtatcataaacgtttgcatagaagtgatattgttgtgtacaattgtatcaatatacatttctgtatattccataaagctgtgaagtttaagcgtctccgtatgcaaggttgtgaaatccaagaggcatattgtatagaagagatcaaaacagaattctaggcagactgactttgagtcagatgacagctccttgaagtattaattacgcactgacagacatgttggttgttcacggaaccaggaaaatatttggtccttagctcttccagcaaagctttgcaggactggaccctgtgtccagtcaatacagggaagtcattctgtttggttgtgcaatagaaaagaacttttccacacgaagttaccatatttatttagagcccttcagtgaggtggcacaatctcttcgtgtcaagaatccaatagctgtaggaagtttcccgtgggtgtgttcacagaacactgggcccctttccatagttcacagacgtggacaatgagcagatgaggctttctccctctggtcctgaagtagcatcatttcatctgaaatggccacaagcaattttggtttatttttcataacagaatcaaagacatcaccaaaaactccatcccacttcttgcaggggaggaatttgttattttcccttggatcctgttgaacacatgtggcatcctgcctgaacccctcccgcagctgccatgcgatccagagctccatccacttgcccacctaagtggaaagggccttcgagggccatcagtttgcagacgacactgtgcattcctttttctctttcggacgctggctccacaatccgggctccaggaggtggaatcgctgttcacttactgccccctagtggtccgcatttctgaaagttctttatccctgtttcctttgagatttttctccgtagatttataggtgtttaggatggggttagtaatgtggccaaggaggtggttgttttctcaagggtgagacctcgtctccgatctccgtctcttggagctagcattcccctctatccacagacaccacgtctgtcgtcatttttattttctgcaatcatttcttctcttggtagcttggagaagagttcatccttgttgatgagacaatcagtataaaccagaggttctcatttaggggcaattttgctcccccttccccagggacattggacaatgtctgggtctggagacattctggtttgtcacaagctggggtaggcaaggtttctactggcatccagtagatgaaggccaggggcgctgctaaacatcgtaccgtgcagtttccccacaccacagcgaagaattacacagcccaaaatgtcaaatgctgaagttgaaaagcctgatattaaccactgtgggcttcttgttttactgcaccgcaggtcggtctccctctctctctctttctctctttctccctctctctcctaccccaccctcccacctatccctccttctgtccctctgttggcatcagcaccactgaataaaaagactcggtcctctgttagccaggcacaatcgtccctttggccaatgtagaacattccctggaaaaccctccttgtacctgcctcacaccactgcaaaatgttcccagccactgttaaaagatgagcgacccccctccaccaccaccacacgaaaggcaggggggaggagctggggctctacacaaaatcagaggctgagacgggcactcggcccctcctcttcctctgtgaggcctcgtgttcagctctatgtgctggtgtccttgctcccgcagcgagttggaagactttgttgaagacttgaagaaggactccacggcagccagccgattggttactctgaaagacgtggaagacggggctttcctcctgcgtcaagtgggagaggctgtagctaccctgaaaggtaaactttctgctgggtcgggggaggagtctgagctgtctttcctgcggtgtttaaaaatctgccacatagaggattcattcatgtatgcaagtatttattaaacgtctacatgtgccaggcattgttctggacacttgggataccccacagcacaaagtaggtgcacatccccctcttcttggagctggtattagagtgggtgctgtaagatttcacactaaatgattccagtaacactttctatttgctaggctcttacagtgcaccgggatgcatgtgccaaacccgttaaaaacacaaggtgggaggatcacttgatcccaggagttcaagaccagcctgggcaatatagagagactcacatctctaccaaaaaaaaaaaaaaaaaaaaaaaaatatatatatatatatatatatatacacacacacacaaaaaaaaattagccaggtgtggtggtgcatgcctgtggtaccagctacttaggaggctgaggtggtaggatctcttgagcctgtgaggtcaaggctatggtgagccaccattgcaccactgcactccagcctggcagcctgggtggcagagtgagaccctgtctccaaaaaataaaaataaaaaacaaaaaataaaaaattaaattaaattaaaaacctgtaaccaggcacggtggctcacgcctgcaatcctagcactttgggaggccaaggcaggaaaatcgcctgaggccaggagttcaagaccagcctaggaaacataacaaaaccccatctctaaaaaaaaaaaaaaagtttttttttttttttttttctggccaggcgtagtggctcatgccactttgggaggctgaggcgggcagatcacttgaggtcaggagttcgaaaccagcctagccaacagagtaaaaccctgtctgtactaaaaatacaaaaattagctgggcatggtggcacaaacctgtagtcccagctactcagctgaggcaggagaattacttgaacccaggaggcggaggttacagtaagccaagatcatgccactgcactccagcctgggtgacagagggagactccatctcaaaaaaagaaaaaaaaagttgaattagctgggcatggtggtgtgcagcacctaaatagtcccagctatccaggaagctgaggcaggaggatcgcttgagcccaggtgtttgaggctccagtgagctctgatcatgccactgcactccagcctggatgacagagtgagaccctgtcagccagtcaaattaaaaagtaataataataaccctaatggtcaattggctttatcccaaatacacagacaggaaacaggcctagaggagctttacccttgcccaaggtgagtttctccaatgctcctctgtgctcttaacccactgccacctgaagatgtgtgagccaccctgtggcttgtgaactctgcacttctctgtccagtatcggagtgcgggatgagggttgtcgttctggctttttctcctccaattcacctgctggtttgggcctgcaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggaggtgaccgggccctcatcgtgctgggggtggcctgcggaggggtgcactgggaaaccgagagtggacgtttgggacttcagccttccaccatgctcccaggacacatccagtgtcctgaggaaaagccccaagtccttctcacccttgaacttttattgcaatatggcttgaggttctaattcttcaacacaggattgctaggtggagcccatcctagggtttaaaattaatagacacagtaaacattgttttaaaatcatctgaaaggccaggtgtggtggccactcaggaggtacaggcagaaggatcccttgagcccaggagtatgaggctgcagtgagctatgactgagccactgcactccagcctgggcaacagagaaagactccatttcttttaaaaaaatcatcggaaggtgggttttttaaaataacattttgaagttgaaaaattgattgaaatagtttattagcctccttcacttcaggggcatagatgaattcagttcaaagaaatgtaatagaagtaaacaaagtctttcttaaatgacctcctgaaggagtatctgtgagactgttggtcccacctagaaaagaggaacaaagcattttgagtggcctgggccaggcttccttaccaaaggtaaacctgctcaccgaagaggtcacagtggagtaaagaccaaaagacattcaggaatttcactgcaaagaaaattccaggactccacactcactgaaaacacatatgcatgcaaaatttgtgttgccagaagtaccttcactggccaggcacagtggctcacacctgtcatccccgcactttgggagctgaggtgggtggatcacttgaggtcaggagttggagactagcctggccaacatagtgaattcccataggtattacaggcggtggcgtgcctgtaatcccagctacttgggaggctgagggaggagaattacttgaacccaggaggtggaggctacagtgagccgaggttgtgccactgcactccagcctgggagacagagcatgaagtcagcttcatggagatgattattgaaaatgggaaagatcactgggtgcagtggcacgtgctcgtaatcccagctactcaggaggctgagatgggaggatcacttaggccaggagttcaaggctgcagtgagctatgatcacaccactgcactccagcctgggtgacagagcaagaccccatctctacaaaaaattattttaaaaattagccaggaagggtggtatacacctgtagtcccagctacttaggaggctgaggcaggaagatctcttgaacgtaagagtttgaggctgcagtgggctaggattgagccactgcactccagcctgggcaacagagcgaggccctgtttcttaaaagaaaagaaaatggaagagatggttgaggcagaatgatagggaaaggagagaacaaatccttggggatctctaagaatctaagggattggggtaaaaaaagaaacagcaaaagaaagagcactgagtagcagaagagttatagaatgcaatgtcttttttcaaataaaaaaaagtaacataataaaaaggggatgagggactaactaaaaattagaggtcaagtaccatgtttgacattgcctcacacataactttacaatgttaatgttagtcctaacgacaggtcctgaggaagtcattatcatcaccatcgtcatccccatcttcatcactccattttatgcaaaagcacctgaggcttaaagaggcgaagttctcaacgttatataaagcatgaactaactgctattcaaacacagatctgacaccagacactctgtcttttccactacatcatgggtggggagggacatatagcttcaaatgactccaaacaccagaggaagttgaggaataaacacgaccgttagatttcgagtcactgtgtaccttgtggcaagacttcgttgaatccaggtggggaagccagtgagcaacaggttgagatacagaagagcaaacagaaggaattagaatgtgggcggcccacccaagatgcttggcagtgaaaggaggagggaataagcaaacttttggcttagaactaagcatatttgagggctgcataggccagaatcaggcggaggagttagagaggctgctgttagactcatgattcattttcttctacccaccccccaaacaatgatggagttgcaagggtctgagcacaactgcaccagcagaaagggatatgtctatacatgtccctaagcggctactctgagctttgggatgtgtgactctcacctggctttgggatgacatagcctgcaagtataccaccatgagaaagtgacatgagggttaatgccgctgtgcatggtttctcctagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgaggtagagtcctatttctgtttctcataaccccataaaggagtctgatacatggacctttcccttaaagcatttataggtcagatgatgacatgattgtgtatggatcagagacagggttttggaagtggaagtgggattcagtggccaggttaagagataggtcatgtggtttcagagaagggtgagacacctggcctgtaggaaggtgagacacctggcctgtaggaaggtgagacacctggcctgtaggaaggtgagacagcagtgtgctggtaaatgtttaacaaccagctctctggtagcggttgtggcggcggggtgggggggcagagtgggtgcgtgcagatctgtgtgtggcatttgccaatttccatggtgtaaatatcgcaaccatggctgatttcaagttatgacatgacaccactactgctgaagttgggagaaatgtaacaatcagctctcctgggccaggacaagccggcttcaagcactccactgaggtgaaggcagcctggggagggtctgccacacatctagatgataagtggaacctggttagcatgggagggtggtgagggcatcctaggatactaaaatgctggatcaaagtctgggaccatgactaagcctgtctaagtggaacaagaacgaggacctaagactggggaaatgggctggaaactgacttgagtgcttgaaaaacagtccatgatgtttggagtttatttggaaggtatcagagaaatgctgcagctctaatccgtgattttttttaaatggcatcttctggaaattaatctagaaacaacgtacagaattgattgaggtggtgggtctagaattaagagagctggatgagaaattactatagtcatctaagaatgaacggtagagcagtcagaatgaaaagagaaaactaggtcttaagaccaaatgacatgaggccatgtgtggtggctcacacctgtaataccagcactttgggaggccgaggcgggtcgatcactggaacatgagtgcaagactagcctgggcaacatgacaaagtcccaactctaccaaaaaaaatacaaaaattagctgggcatggtggcgcgtgcctgtagccccagctactcagggggttgaggtgggtggatcacccaggcccagggaggtcaaggcttcagtgagccaagatcacgccactgcactctagcctgggcgacagagtgagaccctgtcttaaaaatcataagatcaaatgacatattatgtttttaaatattctttttatcaagggctggtaccagtgctccgataacacatttgtcttttctacttcttttttcttcttgcctcgtaacttttcctccactcatttgctttatcacccaacaaccttgtcgtaaccctcctgcctctactgaaagtcaccagtggagaggtcaggttgggtatatcgagacgacctggcaaaactgccacagccacggtcgcagcctcggggcctctgaacactaggtggtttctctgtgtcgcaagggccctggcttgcctctaatcagagccagctattttaaaaacgcatatcacaagggtacagaaatgtgattgacagagtgtgattctattcccagtacctagtagggcaggggagggaaagacatttcctcctaagaattggcagatccgtcacttaagacgtcttgccactttaaacatctcaacatttaaaggatgtcagtatgatggcactcttatttaacaaatctctgttgagaacctagtgggcatagttatcattgtgatgtgtgtattttacgctttgagaggagacacgagtcatctctgaaaatgccctgatccacaggtatggaggcctgggtttttctgccagctctgccactgacaaatggggtgagctttattcattcaacagagattactgagcctgttatgtaccaggccctcgtaggctcgggggaaagccagtgaacagaagagacaaagtctctgccctcaagacacttacctacttgtaggaagagacagaaaaaaagtatatgccaggtggtaataaatgctaggaagaaaaaataaaggagggttagaatggtgaaggtggtggctattatttatatgtaatgaaacttgggcaaattctccatctcgctggacctcaaagttcccatatgttgattcaatgatctttgccaattcttaggttataaggttccactaatcttggtgtgaatttccactctgcccccttagaattattaatgtgctggttcaaaagtcacagaaaacattcttttaaaaagtatgcagatgttttaaaatgcattttatgtataactctctgttgtggaacttaaaggagtttacaggtcatctaaataatacctcctccctcattttataagtaggacaatgtgacccagagggcatatagcaattctttgatagaagtggtactaagacacaggatttttgttcttagtgttgtgggttttgtttgtttgcttggacatctcttctacaatgaaaactcaatttaaaaaaattttaggctgggcatggtggctcatgcctgtaatcccagcactttggattataggcatgagccaccatgcccagcctaattttttttttaattgagtgagactcatgtctcactcagggcagaaggattccttgaggcaggttgtttaagaccagcctgggcaacgtaacagaacccattgctacttaaaaaaaaaaaaaattagccatgtgtggtggctgaacatgtgtaatcctagttactcaggaggctgaggcaggaggattgcttaagcccagatgttggaggctgcagtgagctataatgacaccactgcactgcagcttggatgacagattgagaccctgcctctaaaaaaatacatcttggtagtagaaaaaatacttttaaaagcatcttttttaaagttcaggggtacaattgcaggtttgttgcataagtaaacatgtcatatgggtttgttgtgcagattatttcatcacccaggtcttaagcccagtacccattagttatttttcctgatcctctccttcctcccaccctccaccctctgagaggtcccagtgtccgttgttctcctctatgtgtccacgtaacttcctttacgtgctatattcctccagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcaggtaagttccggtcccacagcaggaatatatggaggtacatggctttgggcaaatacagtgccatccacgacagcacatactcatcaacagaaccaatgtctcagttcttacaaatcttacaaaatgtaaaacctggaagagcaaatcctctggtgttccttagatctttactactatctctctctttttgttttttttttttgtttttttttttgtttttgaaatggggtcttgctctgccacccaggctggagtgtagtggtatgatcttagctcactataacttccaactactgggctcaagcaatcctcccacctcagcctcccaagaagtagctagggctgtagatgtgtacaccactgcacatgtctaatttttttttatttttttagagacaggtttcttcctctgttgccttggctggtctcgaacttctggcctcaagcaatcctcccaccttagcttccagagtagctagaattacaggcttgagccacacttgatttcactactactgttttatgctaaccacagtagagaagctgagttctgtgttaggattctagaataatggccaataaaggaaaatttaaattcatagtgtttgcgttttctatgcatttgtgatacttcacagcaagagctgggaaaatattaggcctgcatttaagacaagagcttttgcagaaagaaaatggtagcttttatgagctctcgggggatattagatcataaggcaaaattgcattttttaatcaaaattattagaatatgtatttaaccaactcaactatggaagttaaatgccaacatgtgaataataatataacttctaagaatctcaacctattaaatatcctatcagttacaagccacgcgtcttattctgatcttaaaattatggacccggatgttattttacttgcagtctaatgtctctgcagtgtcacattccacagtgccttatccagcaactaaaattaatttggaaaggaatccccatcttgacttgcatgttgagaaacattaaagtgtattccatttataaccaccgtacagtcatcccttggtatccatgggagattagttccaggactcccattggataccaaaatctgaggacgttccagttcctggtataaaatggcatggtatttgcatgtaacctactcacatcctcccatatactttacgggccagaacacttcagcagtgtgattctgctgcctgcctccatatactttaaatcatctctacattacttatgatacctaatacaatgcctacacattacttcatttgtgtggattcaacatagtacttggcacaaggcaaattcaagttttattttttggaatgtggagggaatttatatatatatatatatttttccatctgcagttggttgaatccacagatgtggaacccatggatgcagaggaccaactgcacttgtctcctccccagttttcatccatttcatcccctaaagttccactcactgcatccctccccctcagtctgtgctaagaggcttttcttacacctttccccaccatccagctgtgtcaggtctgtctagggtcctgggcggggcggctcttctcacacaaagtgactttcctctcacagtccccgtggagaatttctgatggagaaaatgccctagctcatcacatttttttttttttttttgagactgagtctcactctgtcacccaggctggagtttagtggcatgatcttggctccctgcaacctccgcctcctgggttcaagcaattcttctccctcagcctcccaaatagctagcattacaggcacccaccaccacgcctagctaatttttgtatttttagtagagatgggtttcaccgtgttggccaggctgatctcgaactcctgacctcaggtgatccacctgcctcggtctcccatagtgctgggatttcaggcctgagtcaccggccagctcatcacatttttatcttgtgtaattctgttctctctgccccattattaattttgtcatagagtcctttgatgttttatataggtctcataactgttccttctcatgattgaacaacaaaaacatattacattttgttcacttacctcattttggctcttgattctatctgattttttaaatttgcctaaatcacttttaaattactccccaaggtattttgacttagttaaaatgctcttgttttttcttttttaatgcatctctgacctggtctcagaaacagtacagtgatggacaggctaccagagatgtgtaaaggtagcatccgtgacctgtaaacattagtttctgtcattttaatttatttgtcatggagttatcatttttaatgtatttttgtttattaaggaggcaaatttctaagtgtagagttttaaataccatttgtatttccccttgtgtgaattttctgactacttggataatggaggaatatgggtagtgatcaaaaattgataaaggctggcgtggtggctcatgcctataatcccagtgcttttggaggccaacacaggaggaatcacttgaagccaggacttcaagagcagcctgggcagcatagtgagacccccctctttacaaaaattaaaaaatccgctgggcatggtggcacacacctgcagttccagctactctgggctggggcaggaagattgcttgagcccaggagtttgaggctgaggtgagccgtgatggcaccactgcacttcagcctgagtgaaagagcaataccctgtctcaaaaataaaacaaaaaaggcctggtgcagtggctcacacctgtaatcccagcactttgggaggctgaggcagacagattgcttgatcccaggagttcaagaccagcctgtgcaacatggcagaaaccccgcctgtaaaaaaaaaaagaaaagaaaagaaattagccaggtgttgtgacacacacctgtaatgccagctactagggaggctaaggtgggaggatcacctgagccccggaggctgaggcctcagtgagccttgatcacaccactgcattccagagtgagtgacagtgagaccctatctacaaaataaaaaaaattaaaaaatttgtttaattaaaaaaatcaaatccacttcctctccaactttgttctttgttctcatttgcatcccattttttctctggccctccctaagccagattctactctgacattgaccttcagcagaaacccctcttgctgatactgttttttcagactgagggatgaagtatttggaggccaagccaggggctatggatttgcctttgggcttcaattttttttttttatctatccaagtaatactcagctttttccataacaagaatgttatttaataatagtaggtaatactttacatagcatttacactatgccaagctcagcgtataagtcattcaatccttatgacaccccagaggaaagtatattatactacccatttaacagatgagaaaactgagaccgagagaggtttagtaacttgtgcagggtctttttgggatttaaatccagtcactctttagggtctatacacttaatccttgctctatggagagaacagaaaatttttaaatcagattgcattgggtttgtagcaatataccagactttctggatgttttcttgaaaaaagattattcttgtaatggtgcactgttttccagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggtctgataggctaagccctggtaaactggcctctgggttcagatgatacccttagacaaggttctctctgttggaacataaaaagtagtgaggcagagaagtagtaactcgaccacacaagatccccaggaagcaccacagatggaacaatggcagccagtatgattggactagacccagaccatgagttttatccttattttacttttagctgcaacaatatgaaatgcaaatcacaagctatttcccatgtgggcatcataagattgaaaatgagggtaggagggggaaacgcaagaaagattatcttccaaaggtaactgaggtgagctgacaccgttgtgggagtctatacagaaagatgttcaatgagctttaaattccacttaactaaccaagtgttagctttcatgttaaatgtaaaacacaatttccaaagagatgcagtatgggagggcctttcatgaggactgtattagtctgttctcagggtgctgatagagacatgcctgagactgggtgataaagggaagagatttaatggactcacagttccatgtggctggggaggtctcacaattatggcagaagatgaaggaagagcaaaggcacttctcacatggtggcaggcaagaaagagattgtgcaggggaactcccatttataaaacggtccgatctcgtgagacttattcaccacctcgagaacagcacgggaaagacctgcccccatgagtcaattacctcccacctgatccctccaatgacacgtgggaattacgggagctacagttcaagatgagatttgggtggggtcacagccaaaccatatcaaagacactgaatgttgaggagttccaattatattataattatttaatccattcaccaaaatgacaacttatgcaaacacaaatacaaactaaatgcaaaggaataaaatagcctttcagctattttctcagctaagatctaggaagcaagtgttctagacagtgagggaccatacgatctgtcccttttttgctagcacctaggagatgttaaaccactatctgttgtttcaatctcccacaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggtatgtggatgaggtgactgacattggctccttgcctcccgcctgggtctctccagccatggcactcacagatttgttagcgagaaggccagggaagcgcatggaccgggaccatagaagctgtgtcttctggccttagcctttgctttcccaagatggcgctgaacaaggctctcaggatgcctataagatgtgcaaggaatgaccatttcacaaaacaactcacgctttcctacctctggctgtaaaattgactttcctttctttccatcttaagagattctgcttcatttcaaaagcaagtaagataaggattagaaataccagccattgtcctgtcttgataaggacagactgaaggacacgttacgtgggttcccgttccttggctttaccacttagagccactgaccttggatcatggactcaaggccaatgactggcctcctgtggtccataaccaggtccctgttcaatatcaatgtcatcttttcagatattctgaaaagctgaattattttgttttccattttccttggtctatttgagaaatgatactgtatcagttttagatatttattttttaactatgacacagtccactcataggatgaaggatggcgtgccaaggctgtgcccaaaactgatcccacattcccatcacggatgtgattctaccccaggtctatgtcctgagaacttgtctcatcagagacatataaacaattcctagaacaaactttgtgtagagtatttcatttgcctcatgcttcttataggatttttctgtcaatcagatagttggaacaccagcaccttggggctcaaaaacatgttagctttttaccgacgtaccaatggctttgtgccaacccataaattttcctcttttctttggagtagggagaattttcaatctacattgtttttactgcacttgttctactctggtttccatggtaataactgccaaaattgagctgcctggattttgcagggaaaacagaactgctggttgatttgtcacatacgtgagccctttcacacttcactaaaactcacagactagcctgggacatccccgcaaccaatcaggctatttgcaggtttttagaaggcttggataattgttttcataggaactacagatttataaagctggtatctttcaggcttgtggataattttttacacctctctaagagaaatactaaatttgttgcagccacttacagcccaccactgagggacactcttctccattgaagtctaaatatttgatgccctctttgaccactgtacagacattggcatatctggcttcatgtcatattcttggtggttacataataaaagtggtggccaggcatggtggctcatgtctgtaatcccagcactttgggaggctgaggcgggcagatcacctgaggtcaggagttcgagaccaacctggccaacataacgaaaccccatctctactaaaaactacaaaaattagctgggcatggtggtgggtgcctgtaatcccagctactcgggaggctgagacaggaaaatcacttggacccgggaggtggaagttgcagtgagccaggatcacaccactgcacttcagcctgggtgacaagagtgaaactctgtctcaaaaaaaaaaaaaaaaaaaaaagcgtggtgaatgaagtgctctaaccttaacttaaccaaaccctgttagccctctggctgggatagaaacccagcctgctaaatccgcaactcgatcaatggccagtggccataatgattctcttgtttctgcaccttctcaaggcaggacaaggagcagctgtggccccttctaaggacagttgtggaaccactttctgtgctccacatctccaggcatcagaagaaaacacaggctctgaaatcgagggtctaatagctcaaaggagatggcaattggcatttgtaagcagctttctaagtaagcggataaaccaaacacatccggggcaagctaggactggtatgactaaggaacagcaaggagaccaggtacagcagagacaggggagcaaacagtcatggaagaaaaggccagagaaagtccctcatcagccaccttcagattttaggaccagtgttggaatgtttactgagggaggacatacattattctttctgctggcagagatatctccaaatgacaacatttgacataaagaaaacactaggcaattatttaggctgattcatttaaataagtggtctttcaccaggcacagtggcttatacctgcaatcccagcactttgggaggctgaggtgggcagattgcttgaggtcagcagtttgagaccagcctggccaacatggtgaaaccccatctctactaaaactacaaaaaaatcagccaggcgtggtggcgggtgcctgtcatcccagctacctgggaggctgaggcaggagaattgcttgaacccgggaagcagaggttgcagtgagctgagatctcaccactgcactccagcgtgggcgacagggagagactctgcctcaaataaataaacaaacaaacaaacaaataaaaatagtttttaatcctagctgcacattagaattactttgggagttaaaaaaaaatcctacagctcagagattctgatttgtgtattctctgagtggggtctcaagagtatttgagaacaacagtattttttttttaacctgggtggtatatagcctggttgagaaccactgttgtccataaacttgggtccctgagttaccagtctctccttctctcatgatcatattatctgggcattgcccacatgcccgcttcctttttagccctgtagacacagtctatgtctatactttctccctttgtctgagaactgaccttcctgactgaagttcacaagagccaacagttggctcttatagttttcagagacaaatctccagggttcaggcagctcctaggccactcggaatgacatcgttgcttaaaagcatcactttactctaaatgagcctcagaacacctcggagcgcggtagtacctgttactatttcagagaaggattgctaagagtacttttattgtaagacttaaaggtttaaaacgtcttgtgagcttttgctgtataatttcaataaaactcataaaaaaagaggaataaaaaagaaagatagttttttgttttaatttatttacatattgagcattttttaaatgtcaaagcaagaagccctcctaagtaccaatttatgttcaccccagacaggcagaaaaggtagtaatgtctattttatcttggcattccccaagaaaggaaggcagcctttgcctcggactctgcctccaagccagctttgtcaacatgagagcacgtgaggagcaggatttcagggtgctgcctccctggcctaaacctgcgtgcaggacccgggttggggtccacaagcgtctggttgttcctgcctgtttccctccattctcctcagtacccttggatccctgttaacctcagtattttaattccttaggcattccagaagtgttcctttatggatgtaaattcaaacagtcatgctgagccatcccgggctgacagtcacgttaaagacactaggtcgggcgccacagtgccacccaaggagaagaaggtaacgtggcaactgcacatttgccacacggttgggagtccttccttccttgctctgacactaacacggctcttatactcgacctttgtcccctctgtcttttttctctctcttttttttaactaatggagacacaggcataggttaaaatcagagatatcttgctcaggttttcagagcaaacactgtgttccagcccacagcatacaatagtatatgcagaatttagacactatcttcccaaactaaagagtgaacacctttcagtactttctagaacaactctagaaagaaatatatagaaacagcaaccaagtatttagcagtttttctaatttgtaagaccctttgggaaaaaaagaaaaacaactatatatgttaagaaaaataggtaaaaatcggctgggtgcagtggctcacgcttgtaatcccaccactttgggaggccgaggcaggtggatcacctgaggtcaggagttcgagaccagcctggccaacatggtgaaaccccatctctacttaaaatacaaaaaattagctgggtgtggaggtggacacctctattctcagctactcgggaggctgaggcaggaggatcgcttgaacccaggaggtggaggttgcagtgagccgagattgcgccactgcactccagcctgggcaacaagagcaaaactctgtctcaaaaaaaaaaaaaaagtaaaaacctttgatttgggaaagaaaatgcatggtagaaagtatctaccaccacacactggtgtaacctcatggaaacatacaaatgtgtatttgcacaaacgtccaaggatgccaaacagaatttttgctaagtattatccatttataaagtgtaccttccaagatagtaagttcagtatagttttagtgttaacatacatgtgtgatgtcaaaaaaagaatccaggctctgaaacaaagtctgctgtcattgtataagtaagcactctagggaaacgaccatagcctgaatgtttgaaatgcaactttaagttgcacctagagcatctctgattttcagatataaagacatcttacttgaattaagcttccatctaaacttcaggataaaaagcttgcaaggcctaacatttttctccagggacttatctttcagaattcaaagattctagctttccttaaacaaaatcaaactaatcagatgcaagagagcccaatagctactacagatgggtacctcagtccatgtacgacagctcaaggaggtagatgtagtatcacaaaactgaaaggctattctaacacaaccattcaagagacacagttttgggctcccagctcccagccaagaggccttgccaaggaggccagcttgcttccccctggctcataaccaccacggcacccttgtgtaaactctctgccacataaattgacatgtgacactgttaatgggggaagggaatctcgctatatccaaggggggttattgttgataaatgtttctcatgaagaaaacctggcctggcatggtggctcacacctgtaatcccagcattttaggaggccaagacggaagaatcacttgaggccaggagttcaagaccagcctgggcaacatagtgagatgaaagaaagagagagagatatggagggagagagggtaggagggatggagggagggagggagggaggaaggaaggaaggaaggaaggaaggaaggaaggaaggaaaaagagaggaaggaaaaagagaggaaggaaaaagagaggaagggagggaaaagaaagaaaacctactaatttgaactgaacccatgaaaccatgttggaaatatattgatttttattgtttttggttttttttttttttttttgtgagaccgagtctcactctgtcacccaggctggattgctgtgacgtggtctcggctcactgcaacctccgcctcccgggttcaagcagttctctgtttcagcctctctagtagctgggattacaggcgcctgccaccatgcctagctaatttttgtatttttagtagagatggggtttcaccatcttggccaggttggtcttgaactcctgacctcgtgatccacccgcctcagcctctcaaaatgctgggattacaggcgtgagccaccgcacccagccggaaatatattggtcttttcagtatgtggaatttccttatgagggcttattaaaactaactcatggaaggcctggtatagcatgttatacttaggctaatgtgaccatttctgtctagaacactgactgggaatttggactttctcaaagatccctctggagaccattattgtctcattgtagaatttttcttttcttttcttttctttttaattgaaatggagtctcgctctatcacccaagctggagtgcaatggcgccatctcagctcactgcaacctccccctccccggttcaagtgattctcgtgcctcagcctcccgagtagctgggactacaggcgtgcaccaccacacccggctaatttttttgtatttttattagagatagggtttcaccttgttggccaggctggtcttcaactactgacctcaggtgatccacccgcctcagactcccaaagtgctgggattacaagcgtgagccaccgtgcatttctaattggctagaaagtggcatgagatttcttgccccataattagaaatccatatcccattggtctcatttatctcagttgaggatccactggctaataagcaggtctttattgagtgcccaacactgagtttagtcacaggtgcttattctggataattaatctcagtagattaaccttcttcagaatgaccatgtatatcagacttctcttatccccaattctgggtccttattaacctcttccagggctaagtatttacccttccataaatcggatgttttcttaagcattttttctcctgtcatcactgaaactccagcctagttcttcacttgtatgcaattttcttgtaaccctgtctctcgttttggtttattgtccatatgcctattgagtgcttttccagttgtcttcataatccaaatcccagggcctataaatacatattaaagaggcataattacctttcacccagagtcttgaccatctaagactaagaaatcactgtgagtttgcatgacaattatgaccaagctcctgcacttgctttgatacattcattcatttttttctagcccagtgataaaaagtataggtcgtgtgaaaaccaaacttcacatttttatcctagtgactttccattagagcatttatgctactactcagttttaaaatacatatattacaggggggatttttgaaatttatttatttatttttgagaccgagtctcgctctctcgcccaggctggagtgcagtggtgcaatctcaactcactgcaacctccgcctcctgagttcaagcaattctcctacctcggcctcctgagtagctgggattataggtgtgtgccaccacgcctggctaatttttgtatttttagtagagacagggtttcaccatgttggtcaggctggtctcgaactcctgacctcatgatccacccacctccacctcccaaagtgctgggattacaggtgtgagccaccatgcctggcctgaaacgtttaatgatgggaatggcacaggccatgaccaaccaacagacaccagccctaacctccagtaaatagacccccagaacatctgccacgtgtgtgtctttagatcacatgccaaatccatccacgattcagggggcaaattctcatttgggtcctagcatgatatgctgactccatatttggagttgtaaccttaggctgaaaccttttttttaaattcatttacatatatatatacatatattttgagacagaaccttgctctgtcgcccgggaggctggagggcagtggcacgatctcagctcattgcaacttctgcctcccaggttcaagcgattctcctgcctcagcctcccacgtagctgatattacaggcacccgccaccgtgcccagctaatttttatattttcagtagagatgggatttcaccgtgatgaccaggtcggtctcaaatttctgacctcaagtgatccacccaccttagcctcccaaagttctgggattacaggcatgagccactacacatagcctatttttattttttatttttgcgtatatgtgatggagtctttgccatgttgcccaggctgttctcgaactcctagactcaagcaatcctcctgcctcagcctcccgagtagctgggattacaggaagctcaattatttttcttctttaaaaccttttacttgacgtattcattgtttcatattttaaatttaaaatcccacaaaagaagccatgtggctccgctgcagcagccgaatcatggcacttgtttgggggcttcctggggagcaagcagaagtaaaacaggaggtatttggtggctcgtgtaccttgtactttgcacagtatttgcgtgtgattaattctgactgcgttgtttgtgtgtcattcctcaggcgtgtatgaacagtctttccattcttaagtaaggtcataggggttgctctgggttgactttggctgggcccgggtgtttgtgctttgtgttgtcattgctttaaccaagcagccttcatgggaattgtgctccatcctgctataatcaatcacctcagcatgaagaaagggcagcagtgccttggaaccgacaaggcatcactagtgttagtgttatgtcagggcctgaggctactgatacaccttgggaaaggccaggcctccaggtgaagcgccttgaatacctgggtcctcaccactggatccttcactcctgaatcttggtgagaccctaagacatgtatcttcagtctacactggaaaatatagagaatgaaagctgagtcgtgacgtcaccgtcaccaatgtaacctcaaatatctgctttgtgaatgtttaggttctattgtaacagcatgatggatatgaaccaaggttctattgtaacagcatgatggatatgaattgaggttatattgtaacagcatgatcactctgaatttggatttggtcatcgtggctatgaggagtgtgaaggttattttggcacttcgacacctgcagtacaaactgcatttcaatctgtcatttgatcaggggaaaataatgttttttcgtccccaaatgccaaacccaaccaaggcagatgtctttataggataatctccataacagaagcagagggaggactgaaataatgagctgtaaggggaactaaaattcccctgggctggttcctaagtttataggcaagaaaactgaggccaaagaagtaaagtgacttatctaaagtaacacagtttagtggcagatcttgattaggatcaaaactttctgtcagcccatacattgtgcttttcacaattcttcaggttttaaattctgctaagctcacaatctgatgttgaaaagaggacatgttagtaatgactctgtccctttattttcttcaccactcccctacaaaattttaaattcttgaaatcttttgctaattgagattttcatcttgtgcaaacacagggcatttttggcagttggagaacaaagcaatccaaggtaaacagctgtaggctttggattggtgtgtaagaaatatgcgtggcccgcatgtcttagaaatgtaattaaaggaacgatttagttatagtccacttttttggggggatgtggttttgtggagtaacatgtcctacactattctaccagaatttggaatttttccatgaagatgtacggaaatctgatgttgaatatgaaaatggcccccaaatggaattccaaaaggtgagttcaccagatctgggttccgaccaataccatgcacattaagtacctgcctctgcagatccattgctgattaacgtgtgtggtttccctcctccgttctccctctcaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaaggtatcttggtctgctggaaaatgaaaagacccagctgctttcctaaatctgccataatcaccattagtgaaaggtgtcttgtaacttaattgctttctttcaggtggcttttttttttttgtctgttcgccatgaaacccttctttcatactttctccctcaccttccaaacaacaacaactaggtatctaacagctaatcagttctgtttttgcctctgttgctgactggtgttgggtaaacacgaggctgctgggtcagccatgtgctgttgaaatggttgctctgatactcacattaaaatccgtttgatcagtagtgagcagttgattctgtttgattcttctgattaaccccagttggtgtctcctagatctgtcctgcatgtagggctgtggcttctcaccttgagcttctctgcacatcgtggggcagcctcacagatgacctactcatgcgcttctccttctcttccccctctcactggtccttcccacagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 1632 - DNA, 339053 bp, Homo sapiens; identical to SEQ ID NO: 1631

SEQ ID NO: 1633 - DNA, 8922 bp, Homo sapiens
ttttttttttttttcaaatgcccctttcattatgaaactcttttttaacttttaatttaagttcaggggtatgtgtgcagatttgttacataggtaaacttgtgtcatggggctttgttgtacagattgtttcatcacccaggtattattttattttcattttagttttttaaatttctttttagaggcggggtctcactgtgttttgcccaggctggtctcgaactcctcctggtctcaagcaatcctctcgcctctgcctccccaagtgttgggattataggcatgagctactgcactcagcccaccatttgttttaaaaagggtggatcctatttgtataaaaagccatgtgcattttctgtgtacttgtctacacattaatttccaggctgggcgtggtggctcacgcttgtaatcccagcactttgggaggccaaggggaggcagatcatgaggttaggagatcgaaaccatcctggctaacacggtgaaaccccgtctctactaaaaatacaaaaacaaaattagcagggtgttgtggcgggcgcctgtagtcccagctactcaggaggctgaggcaggagaatggcatgaacccgggaggtggagcttgcagtgagctgagattgcgccactgccctccagcctggacaacagagtgaggctccgtcttaaaggaaaaaaatttctggaatgatgtccaataaatcagagagagggactagaagactaatgaggacagaagcttttattcttaacacctatattttgctaccatttatattgtcatcatatgcatataacattttaacatttaaaaactagtttaaacagaaatggttgccctggaatgtggcctgtgttctttcaagggaggccagcagtttctacagtggctgagatggtaccttcatctcacacacctacgcaggagtgcatttgtgctttgatgtggttgtcccttgaagaaggaagcagttctctttttcttttttcccttttccattataggatcagtcacttcttggggcattagtagtctcatttccagtggcatcttcccttggcaaaaggaatcccagataggacctcatctttctaaacaaatgctgttttgggtcctaaccatcccatgtttgctttgaatatgtttaagttgcctggaattatcaacaaaagaattaaatttattgtaggtcagggcatcttttgactcattgtataaaacattcactttaaatgtataccgaaatgtcctttaggccgggcgcagtggctcatgcctgtaatcccagcactttgggaggccaaggcaggtggatcacctgaggtcaggagttcaagaccagcctggccaacatggtgaaatcccgtctctactaaaaatataaaaattagccgggcatggtggcgggtgcctgtaatcccagctactaggggggctgagacaggagaatcgcttgaacttgggaggcggaggttgcagtgagccgagatcactccactgccctccagcctgggcaacaaagcaagactccatctcaaaaaaaaaaaaaaaaaaaaaaaaaaatgtccctcatacctaaaccttacctcttgctaatttgctgagggttcattttagataaaaggtgtttaggttttcatattatgtttgtaactgtatagctatgattcagtttcctaaatgaaaaaagaaactgttttaatgtacagactatttagatttgaaaagactgtgagagctttttcttttatagcaagacaagtcaagaatagaaggcacactgcgagagggatgtcttttgaaagaaaagaaacactactttttatattctcaaatcactgaagaaagctttagacataatttcaaacactagctcctgtttaattcagatgcacagaatgcattaaaaccacgagtgtagtggacgtgatttatacattctcttagcacaaatcagtacctatcttcactgtaattagacttttcttcctttctccttctcaaaagctacttttgaaaccttatgttttccctggacatattttctgtacttcataaaatagctcagttctgcaactaactgcaaatatttgcaaaagggaacaaatgtaaaataaacgtcccctaatgcagtgtttggtgaagaaacatatgtctgacattagttggttaacctgaaaaatagtaagaaacaactctacttaggggaaagggggtagaattgagcccgtactgtgcaaatcaagagaaagctataatttacgcaatttttattaaagagaatacaagtgctgtaggcttggggtggtgctaggtcatatttaagcctaattgagctttttctatatcattagaaaaatgggccaagtttcctatattatagggtaaatacaacattttcttcctgcaaatattaaataccactggctttttaagacgtaaacatccaaatctcaaatgtctttattcatgccaatgcaatacaataaaaatattccccatatacacttaaatcactgcaagtaagccttagaatccccacaagtattattacttactatatctcagaaactttcacacacattatttcaaatatagttctcccaaaaaaaccctgcggagagatacctgtaaaccaaggctgagactagcctagacagttcgttctttagacaacaggagtggagatttgaacccagctattgtgactcaagcaagcctagggcatgtttctgagatctctaaggtgtgcgctgtgaaaccggtggctcattttatgggttggatttccaaacacgactatcacaatcatgccaggaatcaatgactgacttcttgcctccgtggcctgaagttctcctctgcacctcctacctttttgccatttcagtgatgcaccaaagggtggagttgaagaacatcagttttgctgctgcttgttggcaatactctcaaaaaggcgtggggagggagaggtgtaactcacccctgaagtcaagcctggagattacttgtcaggaatgtcaaaagcatttgttaagcaaccttcttcctggcattttaagaagaaagccgcatacatagatcaaatcccttccttcagaaacctgtactctctgaacagagccttggaattcagcctagagaaagaatacttggtggttcatagaacttggttcacaaaagagtgcttgctgcccacgcattttgcacaatgactcccaaacacacagaatgcacattggcaacaattttacgcgtgtttccaaaagtgctgactggaattgaagggacacatttggcactttttttttttgaaatggggtctctctctgtcacccaggctggagtgcagtggcgcaatctcggctcactgcaacctccacctcccaggttcaagcgattctcctgcttcagcctctggagtaactgggactacatgtgcctgccaccacgccttgctaattttttttttttttgtattgttaatagagacggagtttcgccatgatggccaagctggtctcaaactcctgacctcaagtgatctgcccaccccccgcccctcggcctcacaaagtgctgggattacaggcgtgagccactgtgcctggccacatttgtcaactttcattggtcaatgattgatgcaagccagaataagaatagattgggccgggtgcagtggctcacacctgtaatcccagcacttaaggaggtcgagagagcagattgcttgagaccagcaatctgagatcagcctgagcaacacaggaagaccctgtcttcacagaaaaatgaaaaaaattaggccaggtgctatggctcacacctgtaatcacagcactttgggaggctgaggtgggtggatcacctgaggtcaggggtttgagaccagcctgggcaacatgatgaaacctgtgtctactaaaaatacaaaaaatagctgggtgtggtggtgcacccctgtaatcctagctactcaggaggctgaggcatgagaatcacttgaacccaggaggcggaggttgcagtgagccgagatcacaccactgcactccagcctgggcgacagagtgagactatgtctcaaaaaaattaaattaaaattaaaattgagcctgatgtggtggcacatgcctgtagttccagctatgcaggaagttaagatgggaggatcccttgagcttgggagatcaaggctgcagtgagctgtgattgtaactactgcattctagcctaagaaacagaaagagacactgtctcaaaaaaaaaaaaaaaaaaaaaacaagaaaaaaaaagaaagaaaaaaacagatcagaggccctggcctggggtcagtttctccagaaaggcctgcacaatggagttttcatgtaaaaaatttcttacatcctgattttaaaaaatcagatgatcaggaaacattgagttccgattcctttgttacaacctccactaaagctaagtaacagctgctgtattaagatggggctccccctctccatcccacacctgcctcccttacatgcctaactcctgttgtaaatagggaccctaatctgatgtttttgtagtccctttcctaggggcactgtggggaggtggaaggaatttcacctttgttgttggacagacttagatttgagaactggttctactacttactgtttgtgtggtctgggacaagtcacttggtccaagtaagcttctgcatctgttaaaaaaaaaaaaaaaaaaaaaaaaggggcggggagctaagaattcctgcccagcaagttggtttgcagatcagaggcagtgtgtgagaagtacttaacccagcacctggcatatagtagatgttcaggacatcgtagcaggaataagggagacatctcacaaaacattttgtgagaaaggatcagtttctatctagtcaatgtcttaaacattcataggttgttcatggtgggagctgctcgaggaatcatcctagttttatggaggaggaatctgaagctggaggaattgtctccttcaagattacttagttaaaggcaaacaggttcatagccagtggctcttcaccaacccacaaaaaggcctcagattataattttgaagattaagtatatgaaagtgctatttgagtgattaagtgtaagcatcagatcattttgaactggtgagatggctcacacctggaattccagcactttgggaggcccaagagggaggattgtttgagcccaggagttcaagaccaacctgggcaacattgtgagagcctgtccctacaaaaaataaaaaaaaattagccaggcatgctggcacacacctgtggtcctagctactctagaagccgaggccaaaggattgcttgaggccagaaggttgagcctgaaatgagctctgattgcgccactgtgccacaagctgggcgacagcaagacactgtgtccaaaaaagaaagataattttgattagcacaaagatgggacagctacatgtgatcagatttggaaaaaaaaaataaccattcattcattcattcatttactcggcactgattgagtctagtttggacaggtattgccctagtctctgggatgacagcgagaggcaaaacacagacactcactgcctgcatagagctcagaatgtaatggtgggaaggcagaggaggaaacagatatacagataattttagatggagatacctgccatgaaggaagtagaggaaggccaggtgcagtggctcatgcttgtaatcccagcactttcccagcactttgggaggctgaggcagaaagatcgattgagcccgggagtttgagaccagcctgggtaatatagcgagaccccgcctctacaaataattaaaaaaaaaaaaaagaaataggattacctgaaaaggagccagtcttgcaaacagccgggcaaagagtgagcaagagttttttgggaagaggtgcacacagcaagtgctgagacccagaggaaggaaggggcttgtctgctgaaggacccaggtgccctgggagaggtagccagaggcgcttagtaagcttcaatcaggattttaatcttaatatagtgctgagggttttaagcagaagagtgatagaagagagttagcttttgtgcaagcactattattcatggaagtcccctttcgatggggtagtggggactcctcactaagctgtccttctatctctgtggctgtctcagagaagcactgtggaactccagggtgctacgtagctcaccacggtgacccccaatgcaggccacttacagaagcttgaagatctgtgatttgctcacccaggctcccatgccgagtgttcttgtcattaactcaaaagccaaatgctggtatttctgttcttacttgcttgattgtttgtttaccagttctcaacatcttcagtgtccacttggttactaaaatgtttactccttagcccagtgtgtaggcatgtgcctgtaatcccagctactcaggaggctgaggcagaagaatctcttgaacctgggaggtagagattgaagtgagccaagattgtgccactgcaatccagcctgggcaacacagcgggactctgtctccaaagaaaaaaaaaaaagaaaaggaaagaaaaaattatccaggcatagtggtactcacctgtagtcccagctgctcgggaggttgaagcgggaggatcacctgagcccaggaggttgaggctgcagtgagccatgatcaggccactgcactccagcctgggtgacagagtgagactctgtctcaaaaagaatataaaaataataaaaataaaataaaatgtttcctcttgatcacaaaaaaaaggatatagttctatgcaatcatgtctgaaacaggatacgtgtgtcatgcatccctgagttcgggttacctcaatgacatgaccatttacctaatctttgctttttcatctgctctcaattgaaaagaaagaaaccattaattatattgaaagatgctgacttgtaagcttctcccctctcctggctcaggtcagttgctcagaatgcacccagcaaagattggctgaacaaagacagggagatgttgtgagtcccactgatgcccttaacaccgggcattgttcaacttggggtcatttgtgaaaatgatgggaatgcaacttcctcactttacagatgagaaaacagcctcagagaaatgctgggatatgggatatgagttggtctcatagcctgtgagtgccagagccagctcgaatccaagtttctgactcacagtgactcttatccagcaggacgtattcttcagaggccatgtgttgaaaacagttaggtgggttgggggctgcaggccataccattaggaaatggggggcatgtcctctgggtggttcctaagcatttggatgttacagccctgcctttctttattctgttgttctagaagctccaacctggtatgcttttaaggcagatatggccacaaatgaagcacattcacatgactgcactgcctttctggatgaaacaatttgaccaaacactggtgttgagacagttggtgatttgggctttgccacgtggtgggaatgacacaataaatatattttgatatgaattaggtaaagatctgtctctaaccttgggctatatgtgaacattaactgcccattggatactggggaactataaatgtctccgtccaactctgttcaactctaatttttttttttttttgagacggagtcttactctgtcacccaggctggagtgcaatgacgtaatcttggctcacagcaacctctgcctcctgggttcaagtgattctcctgcctcagcctcccaagtagctgggattacaggagcccgccaccatgcccagctaatttttgtattttttagtagacacagggtttcaccatgttggccaggctggtctcgaactcctgacctcaagccatccacctccctcggcttcccagagtgctgggattacaggcatgagccatgacacccggcctgtaattttctttaaagactgccactgggtggaacccactgggcccagtgagaactacggaaaagagacccattcttgccctcattgttagtgtccacatccggatttacctaaaccccacccaggtggcatttgcatagtaatgaaaaaccggtattttctagctgtgaatcacacttcaaatcctgagcggctgactgtcaggggtgcgtcaggcctgcttgctgggagaatggacgagctggttgtggagcgggcgggtcccgccacccgtgggctcagcactggactgctcccagaacattaaaggtctggctgatgttccatgccacatctggacatgaagacccatgtctgcccttctgtagaagggccaaagaagaaaggaggcatcacatgtttctgctgtggggggcccttccgagcagcagacaggagcaaggtacaggagtggcctgattctggggtttccctgccccccctggggtccctaaactgctgtgtgatatgtttctaactatctggacagctcacccaagagtcagttgttcccagtcgcttcttgctgaggataagccaaaagagggccgggggccaatctggtttctttcaagtgaaattatgcttctcaagcagagaatgattgcccacagcagttaaaccttgtttaatggtaattaaattgcttttcttcactttgaaaaatctcttaattttctgtacaaaggcaggaagcatttttctttgattctacaggatgtttctaagtatggtgtaatcagttcatcttaccttgccgggctctgaaagaatgagtgtgtgggatcagatttagaaatgcctcaaaggttagaaagccgagtgctgccgattaactcaagctcagatgacc

SEQ ID NO: 1634 - DNA, 46816 bp, Homo sapiens
cggcggcgggcccaaggcgtgaggcgccgcccgggtgtccccgcggcgcaggaggcggtggagcgcagagcgggcgagcgcggtgagtacctggcccggcctcgcccgccggtccgcgactcccgccggctccggcccgggcggtgcgggcgccggggctgcgggctcctgtgtggtcgggtggggtcgcctagcggaccggtcctgcggggggccctgtctctcagggatgagcctgccggagtcggcaccggttttagggaaagcgcggccagagacgattggttcgcttgtcagtgttgggttttgttttgtttcgttttgtttttacctattcatcaccatctctgctcctctcagtggataaactttttaatcagtggtgacctcgtcatcgcgttaaaatagttctgccctcagcccctctttatctgtagatggcagagcgagcgccggtaaagatgctctgtcgtggagggctcagtggggcggaggagatggggagcctctggcgttgtcggagaatgcaccttaaaaatgactctacccttgagcaacgcaggaagcacgacagtgatacttctgtttgtgatgatggtattggcggtatgatagtttgattatacatctgaagcttctcttcctgagtccttggcttgttaaacttggaggtattttctagcgtgcttttgagatagatatgggatgtcgtgacgtttcaccgtcattcaaggctcgcgggagcagggccttcatgtctggtaattaatgttgttttttgaatgttgtattaaaatagtagcttcgatcttggaagtaagaagccaagtattttaggactgagtgttagcgttcattttgtattattgttcttgtaccatttgtttaaagttgtcatgtaactaaaagaatgaaaaaagatggatttccagtatttgtggctcagaggattttggcctaaataaacacagttccaaccagtttagaagctgcatttttctctttgtttttgtcgaggcataaaatacatatgaaatcaataagagcacgaatcttaattgtacagctcaatgaatttttacatacttattaccctgtggaaccaccagatatatcaaattataaccatagaacatttccatcatcctattttcctgtgcttcttccaagtcagttatatccttgttttcccatctgtattctaacttctcttatctgcttttagttttctctgttttgagcttcatgttaatggaatcacgtagtattctcagcatattgtttgtgggacacacccatgctatttcatggtattgtattattactgtgtaatagtctattgaataatatgtgactactcttcagttgatggacatttatgttcccaatttttgtatatgatgtgttttggatattaagaatactgtgggcctggcgtggtggctcaggccttttatcccagcgcttggggaggccgaggcaggtggatcacttggtcaggagttcgagaccagcctggcaaacatggtgaaaccgcatctctactaaaaatacaaaaattagccaggcgtggtggcgggcgcctgtaagcccagctacttgggaggctgaggcgggaggtggaggttgcagtgagccgagatcgtgccactgcactccagcctggacgacagagcctgactcggtctcaaaaagaaaagaaaaaaaaaagagtactgtggacattcttgtaaattaaatgtcttggtgagcatctgtatgcatttctgtcagctatagaatgactgagtcatggcataagcagaaaattaccaacatggagtcattaccaaccataccattaccaaccaaaggcagaaaatttaaccaacatggagtcatcttttttttaatgtaatagaatttgttattttaactaatataacattcaaggttggttttaaaaaagcataactattatgagttcaagacgtaagtgattcattcattaccatgttattatttaccctttgaattgcacatttatgactgtcttctgtcggactgtcattgtttgtttaactgttagacaagtctgttagagctggtgaggatctgactctgaagtttagcataacatttacttaagaactgtattactcaagttagtggttttttagaggaaatgaaataccaaaaggatatgactgaaagtggattgaagaatcacgggactgcaagtcaaagaacttacattgttattgtcatgctacacaagcactaggtataagtgtaaaattgaattatagggctagttacaaatgtgaattcacagcaggagtacagtgattttcatatggactgagatactactagcacatttataatgtgaacacacaacaaaaatcactaaacatttgtgggaaatcggtagcatctaagagaagcttcagaccaaacaaatacagaactaggcactgaagcagtggagctaatgtaagacaaaagaaagctttaaagtaagtattagtatcttcaaatttgttaaggtattatgcctactgaacacatacaggctgccatgaaaaaaagcaattgattcttgaatatttaaacatggaaagtaggaaagggccaggtgtggtggctcatgcctgtaattccaacactttggaaggccgaggcaggaggatctctggattccaggagtttgagagcagcctaggcaacataatgagaccctgtctctacaaataattttttttttttttgagacggagtctggctctgttgcccaggctggagtgcagtggcgccatctcggcttactgcgagctccacctcccaggttcacgccattctcctgcctcagcctcccgagtagctgggactacaggcgcccgccaccatgcccggctaatttttgtatttttagtagagacgggtttcaccatgttagccaggatagtcttgatctcctgacctcatgatccacctgcctcagcctcccaaagtgttgggattacaggcgtgagccaccgcacctggccacaaatcatttttaaaattagcagtatggtagtgcacacctgtcgtcccagctgttcaggcagtggaggctgccactgcacttcagcctggctgacagtgaaactgtctcaaaaaaaaaaaaaaaaaaaaaaaaaaagaaagtgggaaagactacccatgacatgcaaagtagatctagaagagtcaatatacatctaataggagttccaggaggcattagaaataggaaaagaagaaataaccacagagataacagagatcgcgaaggtaggagtgtccaggcacagtcttgggcatcctgagccagggagaaataagtatcagaggacaaaggactggcaaatatagatcaacccttccctctctggtctgtttctttgtctgtacagtggggacgaacaagaagtatgccttttctgagagcttatggaaagatgtgttaggtttgctgactgttccccactcttcttccctaccagctcacagaagggattggggttgtgtgcccttatatgttgtttaacctttttatcacatgtatttattttgtgaaatttttaaagtgtaaaaattttttagaagttaaagcaggggttgccagtatggctggctgcctgttttagtatagcctgtgatctaagactggcttttacactttttattttttttattttgtatttatttatttgtttatttatttatttatttatttttgagacagagtctcactctgttgcccaggctggagtgcagtggcgtgatcttggctcactgcaacctctgtttcctgggttcaagtgattctcctgcctcggcttcctgagtagctgggattacaggtgcatgccaccatgcccggctaatttttagtagagacggggtttcaccgtgttcctcaggctggtcttgaactcctgacctcgtgatctgcctgcctcagcctcccaaagtgctgggattacacgcatgagccaccgtgcccagccctatactttctaatgctttggggagaaaaagaaaataatgcttcatgacccatgaaaattatatgaagttcaaatttcagtgtcccttggaacacaactatactcattcacttacatatcatctgtgactgcttttgtgctgcaaaggcagaatcaactggttgtgacatttactgtctgacctaaaatatttgctgattcctggtttagaggtcagaaatggacttatgcatatataggaattttgctaatgataaagatggcatttcaaactagtgacaagagcatggattgcatggtaaatggcaagaattagctatctatttgagggaaaaattacttttattaggattacttcaggtagggaagctaaaatcaagaaataggaaaagattgatagatttgagtctattaccaccaccaccaccaccaacaaaactttgcttaataggaaataatatctaacagttactgagcacttatgcttgtcatgttttacttgaataagtgttataattatactctaaggtaggttctgtaattattcccacttaacagaggaggaaactgaagtttacatatattatggaatttgtctgtaatgaagagtagaaaaccatgatgcagatctttgaattcaggccatctggctcccaagcctattgtggacaagacaaactgagaaaaaatatttgcaacatggtaacaccattttgtaggtactatctacatcagcacataaagatgtacctaattcctttaaaatattctgttgtataaatgtcttcagttaatttaacctttcctctattgatgaacattaagttgcttataattttattttgctgttacgtgtaacactgataaacatcctatgtatgtgactttatatagtagtatggatacttctgtagtatagaatcaggaaagtggaattgtgaattgctggattaaacggcctgtgcatttaaatcaagtttgctctccaaaaatgtgtgtgtgtgtgtgtgtgtgtgtgtgtgtgtgtgtgtgtgtggaatcataataaaggaatcataatatcttggaaggaacattgactgttcaggcaaaactgcctcatttttgagaggaggccctgagaggtgaagtgttatgcccaagattacatagctattaagtagctgttacacttgactctttaactggtttttgctgtgccacagtttggcacatttttctcctttgtcttgctgaaatccaggtaccatgattatagttttctccagaaacacgctgttaaaaggatccatttgatattacttgtccttggtactcagcacagtgcctgacacacagtaggtaatcaagtatttgttgaaaaagtgctgctttcagatgatcagtacttacagaccacttattcaataacatgttgacaacccatgcatcactgtaatacttatcaagtaatcaagaacttatcaagaaatgaaacattctgatctcctccttcctagatatttacacttcataatgctttagttttctgactggttatgttttccaaataattgtgtggctttgtttttgctttgtaaaaaatgaactcaaaattataaatttagtttttgaaaaccttaatgagaaattgttctgtgcagaaaatttaggaagattatacagaatatgttttataatacactcaaatggattatatctttcagagggcagtagattagtcttccaagttagcttgacatactgcatgcaatgtacatgtcctggaaatgatgcataacatttgtgttcatagtaccaaaaattgtgtataatcaagattgagtaaaaactccttaagggtcttattattatgtaagggaccagtgctgtagcattaactatctttaacacttctgttgtctccaagtcacaaggcaaggagaaaagatatggtaagacctttaaaggaatatgtaaatatgtagtactctatttttggggagatgaggggcttagttttgttttttaaatgcaaattcataatcaacaaatctttatacttcagtaaacaaactggaggggtttttttttgttgttgttttacaaatgcctttttggcactgctactgaatctgacttggctttattttttaaacagcttcattgaggtataattgacataaaataaaccacatatttaaagtgtgcaatttgataagttttaacatatgtatacacctgtgaaatcatcactgcaaccaaagtaatgagcaaatccattactcccaaaagttttttcacccctttttataattccttcctggtaccacctcccacaggcaatcattgactgatttactttcagttaactacaaattaccttgcattttctaaaattttatataaatagaatcatatagtaagtacttctgttgcctggctcctattactcagagtaattgttgatatttatccatggtgaagcatgtgtcagagtttattcctttttattgctaagcagtgttccattgtgtatctgttttactacagtttgtccattcacctgttggtggaccctgggttgtttctggttttgggctctacacctagaagctgctatgaacatttgtgtacaagttttggtattgttaaagtataaactgaggcagaataaaattttaaagagttttgtctgagcaaacagcaattcatgaatcagacagcaacaaatcaaaagtgatttgggactccaccaaaggaatgcaagtggaagacttctataggatgaacaaggaaacaaggcaaagaaaatatttgattaattatatttatatagttgccttgtttagtccatcctattggaaagtccctagttatgtaagttagttgatggcttctaattggcgtagcctaagtttgtttgtttcttttttttttttttttttttttttaagagacagggctagagtgctttggtgcgatcgtagctcactgcagctttgaactcctgggctcaagtgatcctcccacctcagcctctcaagtaaccagggcaacatgaactacagacatgcatcgccacgcctggctaattttttaatttcttatagaggcaaggtctcgctagctatattgcccaggctgatctcaaattctggcctcaagtgatcctcctgcttcaacctcccaaggtgcttacaggcatgagccaccatgcccagcctgatttttctttaatataggcacagacaaaaaataaccaaagtttacatttgcaaacagcccaaattaagttttgcttctattgcttatatttgcaaggtcaaggttgttttaatggcttaactggctttgtccaggggatttacagacctggtctccatcttattttaatagtatgaatatgtgctttcatttcttttaggtaaatatctaggaatggaatggctggatcatatgagtaggcttactcacttattaagaaacttggcctggactacatagcaagactctctctctaaaaaaagatttttttttaattagccaagtgtattagtctgggttctctagagggacagaactaagaggatatatgtatatatgaaagggagtttattaaggagaattgactcacaccatcacaaggtgaagtcccatgataggtcatcagcaagttgaggagcaaggaagccagtggtggatcagtacgagtcccaaaagtagggaagctaacagtgcagccttcagtctgtgcagccaaaggcccaagagcccctggaaaaccactggtgtaagtccaagagtccaaaagctaaagaacttggagtctgatgttctaggtcaggaagcatccagcatgggagaaagatgaagtccataagactcagcaagtcagcccttccatcttctcctgcctgctttattctacccccgctggcagctgagtagatggtgcccaaccagattgagtgtgggtctacccctcccagtccactgactcaaatgttaatttcctttggcaacaccctcacagacacacccatgaacaatactttgtatccttcagttcagtcaagttgacactcaatattagccatcccaccaggtgtagtggctcccacttgtagccccagatactcgggaagctgaggcaggaggatcacttgagcccaggagttaggctacattgagctataatatgatagaggcactgcgctacagctctggtaacagagcaagatgctgtcttttttttttttttaataagaaaataatctaacttgttaagttcataacttattaacaaaactattttatattcccatcagcagtgtatgaaagttctagtccttccacgttaacaacacttggtatggtcattctttttaatgttagccattctatttttagcccttctgtgtagtggtgtcttattatggtttgatttgcatttccctaatgactaacaatgttgagcatcttttttttttttttttttttttttttgtggagacgggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagcatctttttcaagtgtttatttgaagggttcaggccttttcccacattttaattgagttgtgtttgttattatttcattttgatcattttaaaatatattcttggtacaagtcctttataagacgcatgctttgcccatattttctccaggtccatcacttgtcttctcattctcttaacaatgtctttgaaagagcacagattgctaattttgatgaaattcaatttatcatttatgctattgaatatcatatctaagaaatctttgcctaactcagagtgacaaagattttatcctatgcttgcttttggtttttttccatttaggtctatgattcaccttgaattacatgctagtggatgtggagtggtatctaattgtgcttttgatttgcatttcctttttggctaatggtgttgagcatcttttcatgtatttatataggccatttatatatcttctttagagaaatgtctgttcagatcttttgcttgtcgagttatctttttttttttttttttttgctttttaaagtaagacagacaaatgatttacaaatgttctctaattgtatgggttatttcttcactttcttgttgatgtcctttgcaacacaagtttttttattttgatgaggtccagttaatatttgttttgtctttggtgtcatatctaagaagctgttgcctgatccaaggtcacaaatatttacacataggttttgttctaagagttttctagttttgactcttatattcagatatttgacccattttgagataatttttgaatgtggtgtgaagtaggagtctagtttcattcttttgcctgtaaatatccagttgtcccagtactatttattgaaaaaactattctttctcccattgaactgccttgctattcttgttgaaaatcaactaaccataaatgtgatgatttatttttgggctttaagttccattccattgactatatgtctatttctatgccataccacattgtcttaattacctggggctctgtagtaatttttggaattgggaagtgttttccttcaatttcatttttcttgttcaatattatttgggttattctgggtttcttgaatttgtataaattttaagatcagcttgccaatttctgcaagaagtccactgggattcttgaagaggattgtgtttaatctgtacattaattggggaatattaccattttagcaatattaagccttccaatcatgagtgtggtgtctttctgtttatttaaatcttaactttcttccaacaatgttttgtagtttctatgaatacaagtcttgcagttcttttgttaacattattcctattttattctttttgatgccatattgtatacaggattgtttttttaatttcattttcagattgcttgttgctaatgtagagaaatacaattgatttttgtatatcgatattgtatcctacaactggctgaactcatttattagttataatagatttttagtgaattccttaggattttctgcatacagatcatatcatctgcaaataaggatagttttacttcttccttttcaatctggatgccttttatttcattttcttgcctaattgccttggctacaacctcctctagtacaatataaatagaagtgacaagaacagacatccttgtcttattcctgatcttgggggaaggcatacagtctttcatcattaaatacaatgttagctatgggttttttgtaggtcccttttcttagattaggaaggtgtcttctagtttattgaatggtgtttggtttggtttggtttggttttttgagatggagtctcgctttgtcgcccaggctgcagtgcagtggcgtgatctcggctcactgcaacctccgcctcccaggtccatgtgattctcctaactcagcctcctgagtagctgggactgcaggtgcatgccaccaccacacccggctaattttttgtatttttagtagaggcggggtttcattgtgctagccaggatggtctctatctcctgacctcgtgggatctgcccacctcggccttccaaagtgctggaattacaggtgtgagccaccgcacccagcccctattgaatggtttttattaggaaatggtgttggattttgtcaaatgctttttccatgtctgttgagatgatcaagtgaattttgtcttctattgatatggtatattgcattaattgattttcagatgttaaaccaaccttgcagtcctgggataaatcttatttggccatgatgtatgattcctcttatatattgctgggttcgttttgctagtattttgttgaggatttttgtatttatattcatataggatattggcctatggttttcttttaatgtctggatttggtagcaggatgatactgaccttatagaatgcttcctcttctattttttggaagagtctgtgaagataattcttatttaataataataattcttatttaaatgtttgctaggctgggtgtggtggctcacgcctgtgatcccagcacttttcgaggctgaggcgggtggatcacctgaggtcgagagttcaagaccagcctgaccaacatggagaaaccccatctctactaaaaatacagaattagccaggcgtggtggtgcatgcctgtaatcctagctactcggcaggctgaggcaggagaatcccttgaacgtgggaggcggaggttgcggtgagctgagatcgcgccattgcactccagcctgggcaacaagagcgaaactctgtctcaaaaaaaataatagtaataataaataaatgtttggtacattccaccagtgaagcctcttggcctggacttttcattgtgagtagtttttttattattattaattcaatcttttgtcatataagtctattcatatctggtatttcttcttaaatcagttttgttagtttctatctttctaggattttgtccattttattcagttatcttttgaagagatttagataataatgagcaaaaatcttagttaccaatgtcgttaacattaatgatgtttttcattgctttgtataaatccatattcctttctggtattatgttcctctgcctaaaagacttacagtacaggtatgatggtgatgaattcctttagctttttatgtagagaaagtattttgcctttttcaaagataatttctctgggtatagaattgtaggctggcatatttttctttttagttctttaaagatcattgttccactgtctaattactttcagttttcaaagagtaatctgtcattattatcttttgttccttgtatgtgatgtgcatttttcatgtggccagtttaaagattttctctttacattggatttgagcaatttgattatcatgtaccttgctataattttctttatggctatttgggattggttgagcttcttatgtgtgtttatagtttccatcaaatttgggaaattttcagccttatttgtttaagtatttctcctgactccttcccccttctttggggactccagttacatgtatattaggctgtttgaagttgtcacagagcttatcaatgctttgtttatatttttgattcttttttctttctgtatgttgcatagtttcttttgctacatctctagtttactaatattttcttctaaaatatctaatctgccattaatcccattcagtgtatttttcatctcagacactgaaattttcatctcctgaagtttaacttggatctcttttatgtcattcatacctctacttaaatttttgaacataaacatcattttaaaaatacagttatgatagctgttttggtgtcctttttctgcagattcccacatctgtcagttctaatcattggtcagttttaattgttgatttttttcattatggatcatatttttttatacctggtaatttttgttgagatgccagatattgtgaattttattttgttgagtactggatatttctgtattcttataaatattcttaaggcttgttgtgctattacttggaaataatgtgatcctttcaagtcttgcttttaagatgtattggcaggattagtgccatgtttagtctagagctaattatttcccactactgagacaagatttttttgagtgctctaccgagtgccctgggaattctgaggttttccagtctgtctgttgggaacatgcactaatcctggccctgtatgaatgctgggttctgtgtcctctaattttgtgtgtggtcctttccttagcccgttagttgcctcataagcctttacttatcagtgctctgccaaatacccatgggatatcctattcagatttctggagttctctctgtgtgcagctgtatccactctggtactatatgctttaatcctagataccttggtctcttcagactatgagctgcatcccatgaactcagggaatctgctgggctctgcttaggttcccctccttgtgtggctcagaaactaaggcagtaagctggcaaccacttgtttcttgtttctctggggatcactgtcctttgttacctgatgttaaatatcttgaaaatcattgtttcatattttgggtttgttggcaggaaaagttgtttgtttgtttttggttgtttcaagacaaccaaagagagcaaatctgagagtaaatctggcccgttacttcatcttggtcgtaaaaggaagtcagttttttaagcagttttagagagttagaattgatggcttgtaaggtttctttcaatcctgagatctttggcttcatattacatacctttaacagcttattttcccatcttcacattatccttttctctcctcaaaacacttaactatctgcatttgtgcttagaaggcttgttgggattaactctgggctgtgaatgaaccgtattcatgatacaaacacatttcatagaatgatgacaatcaagatgtaacaacagaaaaatgttttctataatattcttaatatatttatatgatagaacagctataatgtaatcttctagattatggccaaagagtttctttcgggaactaggcaaataagattttaattgaaatctttcatttttaataaccacagaattatgcaacttttacattctgaagtaattacagtatcctttcattttattggaaaatattcaactgtaatattaagtaggatatctcaaaacctgtatttcccttaaagggaagaggaagaaaaatgaccttagctttttaacactgccactgataatttccattctattttattgaaaagtaaaccttcagtagtgacctattgtctgagttatagctcatagtctaaaatacattgtgtatataaagaaaacatatgaggtaccatattaataaaagatagtggtagttctgttacccagtttcacttcagttttgagtataacatgcttaagtatgtatatctttattaattaaagtatgtatatctttattatacaagattatgtctccacattttcagttctttttcctaataaatgggctagtaatagttaaaacagataccgctaggtttatcttttaaataatgaaattcaagtgttttcttatgctagggattatggttttgaggtatggttaagtcctggaaataatactagttattttttgattagatggtatttcttaaagccaactattttttttctgtttttttctacatcactcaaacaagatttataatcagtaagagagatgctgtaatagtaaaagactcccttggccaggcgcggtggctaatcccagcactttgggaggccgaggcgggcggatcacgaggtcaggagatgagaccacgatgaaaccccgtctctactaaaaatacaaaaattagccgggcgtggtggccggcgcttgtagtcccagctactcgggaggctgaggcaggagaatagcgcgaacccaggaggcggagcttgcagcgagccaagatcgcgccactgcactgcagcctgggcgacagagcaagactctgtctcaaaaaaaaaaggactcccttgtagtgagttaaatttttcaagatacttggttatcatttcgtttactaaaataataaatgactaaggagagttaagaccattatttgtggtatattggccataagaagttttcttctgtcctatgttttatacagacatgttaccaaaaaaaaaaaaatacgcattgcagcatttgccacagaaagcatccaggtttttctactcattaaaaaagtggctaggactgataacctgtagtgatcttccaggttttgctgcagtgagaaaaccattactgttaaaaacctgctgtcatatcacattatccttctcaacaagcactttgttacaatggaagttctctttgcagtggagtcctccttgcctcccttgtcctaagttaaacctctatttttagagttaagaatcattaaagacatggaagagttcgcacaactggttgtggcatgaacgatagcatgtaattttataaatgtataaatggtttttgaatttttttctctgctgataaggatgattaaattcttcatgttttttctttatatagactccaaacctttctagacttgtaggaaatctgttgatgcataatacagtggaaagaattatgtgatctaatgtgcaaataatctactggaggacattggatataaaaatgttttcttaatgtgtttttcagatgtctgtgagcttttgaagttgttctttcccccacttaattttaagtctcctagattggctgagctgagcagtagaaattaatgaggtagaatgcttgagttgaataaactgggagaaaatctctctctccagtaaaccgttattactgtaacagaaacagtttctataaactcagttcccaaatggtcataagctttagttgggaaatggtgcggtaattgaaatactatgttaataaagagttataggcaatataattttcaaataattagagaacagtagaatatatgtaatacagactatgctgacgtaattttaatgtttctttgattcaagttatagctgtgtagacataatagttaaaagtattatacatagtttattgttttttaaggtattttaaaaaattctcccaggccaggctcagtggctcacacctgtaatcccagcactttgggaggccaagacaggcagatcacctgaggtcaggaccagcctggctaacatggtgaaaccttgtctctactaaaaatacaaaaattagctgggagtggtaggcagatgcctgtagtcccagctactcaggaagctgagatggaaggatcacttgaacccaggaggcagaggttgcagtaagccaagattgtgccactgcattccagcctgggtgacggagtgagactccatctcaaaaaaaaaaaaaaattctcctagtatttactgaatattctaaattatattagtacctctcatagttctctgcatgtagtagtcacgtagctaagtttactgaagccacaaacaaatttgatatccttaagggaacaaaattctgattgattctgatctgtgtctttcagaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggtaatgtgaaaaatatgttggtcaatattatgttagtaagacaaatgctagtattgtatgctggtattgtattgtagtattgtactgtagacaaatgctagtattgtattgtagacaaatgttagtaatataagtcagtcattatccacagtattaaaacactgaaagtttttgcacttcattgcaccaagaattttaagtggccttctggaaaaaggtatgagatcataataaaaatggagaataaggactagggaaatagaataaaacagctcttgttgcatgtgtatgatttatattcctcacttacctgatcttggtgttcttttttatgtttttaaaaaatgtgtaaactaaaactcaaaacttgaaaaccatttgataaaggaaagaaaaaattagtagactcttagctatttttcgtattggaggaaggagaagctcatgtctgaacaaggggttatacatagtttaaaaagcacatttggcatttggaaaagtaaggaaatacctgttttcctaatacatatttcagaaagggtatggaatttttatgtatcaagatgggatgtgactcagaggttgaagaacactgctataaaatttaagatattgattgatattaacagtaataattctagatccctacccatctcctttacactcactgctagacatttaattgctgacttaaaccattttaaaaataaatgtttcttgaaagttctctttgcttgattctataaactgtgttatcacagtggtccccagcctttttggcaccagggactggtttcatgggtgacaatttttccatgggatggtgaggatggttttgggatgaaactgttccacctcagatcatctggcattagttagattctcataaagagcgtgcagtgtagattccttgcatgtgcagttcacaacagagtttgctctactttgagaatccagtgcagccactgatccgacaggaggcggagctcagacggtaatgcttgccaggctcccatcactcacctcttgctgtgccgcctagttcccaacaaacaggccacggaccagtagcggtctgtggcctgggggttagggacccctcgtatagcacatgtagactttttgactccaaatcatcatggccatcacttgctgcactgtagcattattataatacactgaggcccttggaggccatcagggagggcattatgctttgcagtggcattgcagctgcctttccttgtggcctcctcttttttctgctgtcacttcctgccatttttgatggattatttttctcaaaactcttctgatttttctgcaagctcagctttttgtcttctcactgtatgtttgtagcttatggcagaattggaagctgcggaggaaataagataactaagtaacatgtgtaaaatgtcctcacatcagctctacctaaaaagaaagggagctgtgccagttttatattctgcagctcctgcttttgtcttataactctccttggattctgatacttcaggatttttctctaaatggaacatattctgttcctcacttttcctctactgtgccactgtctgcccactgcagggagaataattactaataattagtaatgacaactaattcctatccctcttctaaactttagctcagatatcacttcttctgagaagtcatctgcaacctcaggtctaagacagcagtacttctgtgtgctcttgtcacctgtacattcatactgcttgtcacagtatgtggcattgcccatttcctggtttgtgcttcctactaaagtgtaagcctcaggagggttgggaccaagtctattttattcaccattttatacccagatatttactgagtgactcacacatctgtaggtctaaccttcttctctctcctgagcgccatacttaaaaatcagattgccactgggcgcagtggctcactcctgtaatcccagcactttgggaggccgaggtgggcagattatgaggtcaagagatcaagaccatcctggccaacatagtgaaaccccgtctctactaaaaatacaaaaattagctgggcgtggtgacacacgcctgtagtcccagctacttgggaggctgaggcagaagaattgcttgaacccgggagatggaggttgcagtgagccaagattgcaccactgcactccagcctggtgacagagtgagactccgtctaaaaaaaaaaaaaaaaaaaaaaatcagattgcctcgtagatgcgcatgcttttctctcaaaggcatctcaaatcactgtgtttaaatctgtaccaatttttctttgacttcactctagtcagtgattttatatgtatgtatgtatacacacatatatatatacagatatatatatatatcacatagcactatattgttattatttgtctatttttctgtctccttcactagactggccctgtcctcaaaattgagaccatgtggcactctttgtatcacataactgacacgaaggcactcgatttcttttagttgacctaaaccaatagaaattttggctcttgggtctagattttaatattgctagaagtaatttctttatttatcatgattaccatattgataggctctagtatttttaaaaagtcgtatgtaaaaaggaacaattgtcatttgtagtatattttatagattgaataaaataacagaacagtgaactttttttttaaccttttcttttaagcgagtaattgttactgtgcagtggggataagtattttcacaaataggtaaaaatcctgcaggtctagtttaataccctttatgtttaagtgagtaaaatctgtcttcccattgaatttgtaaactttgacatggagacgtctttgttcctaactctttcctttaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcaggtaactgtcagggcttaatgattaagctacattctcctaaaaaaaatcacgttttactcagatttccttaatttatcttcaccgattataattacttagaataattttacaggctttaggggaactttatttttttatattctctctttttttaaagcatgtgtagtatattgtgttatagacaatttgaactatgaaataaattaagagtgacacctattagaaactaaatttgatggccttgataattgttttgaattcattttaagacaagttgaatttttaaaaaatcaactttactaaggaataatttacatgcagtaaaatccacatattttaaggatataggtatcatgactctttttttatttttatttttttttttgagacagggtctcactctatcacccaggctagaatgcagtggagtgagcacagttcactgcagcctcaacctcctgggctcaagtgatcctcctgcctcaacctcccaagtagctgggaccacaggtgcatgccatcttttttattctttgtagagagaaggtcttgccatgttgtccaggctggaatttaatgtcttttgacaaacgtatacactcacgaaccaccaccccaattaagatacagaatacttgtgtctcacaagaaaatccccttgagaatgatttgagttttttaattgaaatacatttagacatacaaacattaaactaaaaattggagaaagttatttcagcttgcaaagcagagaatttgtaaagtttttttatgttatcaaatttgtatattttaaaatgctgaagtgttaaataattatctacacattatgaaaactatttgtggaaaatgctttttgatttaacagtttccatgtttctaatactttaatatttttaatgttttagatactttgatatactggtttaatgctttgtgatcctagtctttattctcatattgaaattgttggatttaaaaggttaattaaaactggtctgcagctgaatgtctggcagtcatacttccaagtgagatttactgttccaaatagctcacttgagatccgatttcctaaagcatttttttattgcctttcttggaattactttcaaaggccacattattatttacagtaagtaatctcagtcatggcaaatatttattccttaatgatagttacaatttttggaattagccagtctgaagacaaaataactcttaatccaaaaggtcagtatttatttatgtggttctgaaccagttgagtttatttccttgaatagcttgtgatttgcttctgaaagcaatccaaaagcaaaagttcaaaaaatgttttgaaataatggcagcaatgtcagactgcttccatggccctccaaggggtgcactcattcaggcatagaccttgtgccttccataattcatcagtattgccacatttatgtttactactgtgtcagtaatgcctcattttcttgttaaagcttcatgtggttgctttcttaatgaatagtgcctcatgttttcttgaataaacttttatttttcacttctgttagggatgtttgtattcatcaagacaagaagattcatctcacagtggtgtattttggtaaagaaggactgtctaaagtcaagtctatcctagaatctgtcaccaggttggtgaaccacatctgcagtgaaggccttgatatataacattgctaaaagagaatttcagatatgtaatgagttaataatttttagtaactattatttaaaaattggctgagcatgtgggcggtggtggtgatgataagttcctcatttcacatgcaaccctacatgactcaacttcccttcactgcttagcaagcagcctggcatgatgctttctctgtggcccactcaccttctgtgtatttgctgctgctttcctttttttaaaatctaattccttcactttgacataatcatcttctgaatttgtctcttttttgtcacctttctttccttccatttcctcaggctccttcttctccccctgctaacaatgttgaggtctcccatatccttaagaaactcccactcaactctgaagtgcccagccactactgttatgtttctgtcctttcacagctcaacatcacgagacagtagttcatagctaagcaagtcatatagtacctggcacatagtagatgctcagaggtttgaatggatgaattagtaatcccttagtacttaattattaattctttagcctctcagcctttttctttctaaatcatgggcccaaagataacgacttaactgccaaattcttttctgttattctttttcattgcttttttacctttgacaacctaaccagtatttctgtcttaaaatgttcttcttgtgtttgtaaaatgtaactattttgtaaatgtaagtatgatgtaatgtaaactattaggttgattatcatctctaaccacaccagctctatatcctttacttgcttctttacctttctgccagttgtggccatttgccaagagcccagatttgatcagccattcttctcaaatcattcaactcacattcattgagtcctgcctactgtgttccaggtacactgcttgggagtttgactggggtagttggaagaagagtgggcgtagatgagtgaatctgagtccctgacctgcagggattctcagagccttgatgtatatagacacaattcactgtcttccccttccctacaccagctcctcctcctgatggccctctttcagttcagagtaaaaccattttcaccatctgggcatgacttctgagagccacagtcttttacttattctttgcctccagttacctctaattagttagttcctacttaattcacaggacctcttctctatctcttccttgctactgccaccaccctaaccctggttccccctccctccatttcttcccttcctgtccctccttagtgtttttagatcacctactaagtgccacaagctcacactggtaatactgaagtattgtcaagacacttctgtggcaaatggtgtaaacctaccttgagcttgcttgaggaaaataggagcagtattgaagaatctcggatacctcccagaaataaagggattgttacaaccaaatttggggaagaaaatcaaaacaactcttgtttctcagggattggaaccagagacttgaataccatcaaaattctcgtctccttgtctgtttttctctgcatgttgacttcattctcctgttgcagattggcttcttccacatggtgagggatatgactgttggcggctctgggctcacatcttctcagctttgccatcagagaggaaagagctttctcccagctccagttgagaaaatcccagggaaggacattttgcccactcttgagccaatcactatggccaggttgggtgggggtattgggactggcccagcttaagcctggtctccacccctaggaaattactgtggttggggtgggcagagagtgaggggtattctgtgatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtgcgtaaaatgttggtagatgagctgactatagaatttagaacgttgtcagcatgtcctatagtttgaatcaagtgattttgagggagaagttttagttaaaccccagtatttttttaagttatattaggcataatttaactggaatactaaataggaaattgaaaatttgaccctttgaaattcatatcctttgttctcttgggtccaacttccagtgactacatttgaagccaaatatggaaatgcagaggaacagggtatctacaaattgatgaggtgggagcagtgcaggtcagaaaaagagctaagcagatggtatggagatgtgtgtgagagtctgaagcactcagctttgggcatatagcgtccacacatgcaaaaatacccccatgcatgtgtgcacacacactcacatggaagtctagatgcagatagtgcttggtctccagactgtgcattttgggatgatttactatactttgctttaagttgtagatattttttgaaaattaatgagatagccaggtgcaggggctcacgcctataatctcagtacttcgggaggcttaggcgggtggatcatgaggtcaagagattgagaccatcctggccaacatggtgaaatcccgtctctactaaaaatacaaaaattagctgggcatggtggcgtacgcctgtagtcctagctactcgggtggctgaggcagaagaattgcttgaacctgggaggcaaaggttgcagtaagccaagatcatgccactgcactccagcctggtgacagagtgagactccatctcaaaaaaaaaaaaaaaaattaatgagaagatgacattttttgaaatcaaattttaaatgctttttagttcatttaaaagaattaaaagtattaaagaggctgggggtggtggctcatgcctgtaatcccagcactttgggaggccgaggcgggcggatcacgaggtcaagagatggagaccatcctggctaacacagtgaaaccccgtctctactaaaaatacaaaaaaaattatccggtcgtggtggtgggtgcctgtagtcctagctcctcaggagactgaggcaggagaatggcgtgagcccaggaggcggagcttgcagtgagctgagattgcgccactgcactgcagcctgggcgacagggcgacattctgtctcaaaaaaaaaaagtattaaagaatctcaacaggatgagtaagttgaggaaatctgttatacaaacatggtgactatagttaataacaatgtattgtatacttacaaattgctaagccagtagtagcattaaaaaatgttcttaccaccaaaaaaaaaaaaggttaattatgtgaggtgatgatatatgtttattagcttgatttagtcatttcgtagtgtatgaatgtagcaaaacataatgttgtacaccatttttattagtcaattagaaaaacattggggtgggggggtgctgctgagcacagtagctcacaccttaatcccagcaccttgggagtctgagacaggaggagcacttgagtgcaggagttcaagaccagcctgggcaacatagtgagtcctagtctttaaaaataaaatttttggccaggcatggtggctgaatgctttttagctcatttaaaagaattaaaagtattaaagaggctgggcgtggtggttcatgcctgtaatcccagcactttgggaggccgaggcaggcggatcacctcagtcgggagttcgataccagcctggccaacatggtgaaaccccatctctactaaaaattagccaggcgtggtggcttgttcctgtaatcccagctacttgcgaggctgaggcagaagaattgcttgaacctgggagacggaggttgcaatgagctgagatcgccagcctgggtgacagagcaagactccgtcttaaaaaataaaaataaaaatgttttaaagaatctaatagcaaatggggtttttttaatgtagaactattcatatgcaaatgattgccttcttattaattaggttagagatagttttcaggaactctttgagaacctaatgaataaatgaaggttaggtttattttacagcatgaaatgcaaaatgtgaaagttgaaggagacgtatttgcttagtttaaaagaaatattttatatccagaaatagatttgcctctggaaaattgaactccccatccctaaatgtatttgaacaaaggtagaatgagcatctgctagggatcttgtaataaaaaggttgccatgttactcccacacttcctgacaatcactgaacacttcatgtgatcatatctgattgaagccagccatagcaagggttgcgtctcctgagggaagatgggctagttagcctttatggtccttttagatcagtcagtttgaatgctgatgacaaggtcttctccaagggctattatatcaagtaattttaacccttgtcttcccgacttttccagattttggttcagatttattctatattttcattattctctgcatatctattcattgtacagtattctttgaatttactctttctaatgattcatttttgacaggtggatttaacagacgtttctaagtttcatagtgattatcagaggttaatctacgtttattactactgattagatgaaacaatgagtaataaatgactcacgtaatgaatacacatctccccaaagtcaaagggaataaacgtgaagcaccctttagtttgttttttcctctgttcttttgcaaggttatagttaacctactgatatgttacaaaatcatcatattcatcaaattaacatgatgttctgtagcctgaatattaaaaaatagataaaatcatgtataataagactttgataaaacttaatagatattgcaataaagaacagttcttcataacttctttttatgttacaaacctatattttaatttgtaggtaagaaggtgttttaccctgtggtgttcagtctttacaatcctgccattgtttatgccaaccaggaagtgccaccacctgtggagcagcagctggtgagactttcacattttcagttatgaaagactctaaagatcttttctagatgtttgttgtgtaagtagaaaacaaagtttcaataaaaaactgtatttccatgagcaaagtgttaaagaaaaactatagttattgtaagcacatttccatagttcctctttatacccccaataagatgcttttcacatttattgcttcagaattaagtgtagggggagcagagtttaggtcataaaggaaaacctcatgtcccagaatgtggaaattgtacagtcatttctaccagcttatttttactaatactaaaaatttgattttaaaaaccctactaactagaaattaaatctactctgctaaataagagggaatagtatactctggtaaattacctggaaagtcatagaatataaatgccatatatcaaaacttacagttattgccaaagctaattttatgtaagttttttaaaatttttaaataaacattattttataataatttagatttagagaagttgcaaagatagtacaaagagttccatacttcacccagtttcctctaatgctaacatcttatgtaaccatggtacatttgtcaaagtgaagaaattaatattggtaagttactgctaagtacactaggattacaccagtttttctactaatgtcctttttctgtttcagaatcgagtcgagaataccaaattgcttttaacataatcttttattattaatactaagaaaaagtagaaatgattaagaagtcactttaagatgtttaaaaaaatgaaaaataacttcaaggaaagtaataaaggcagaagttaataaaacaaaaatagattgagaaatatagaagcttatgtttatgtacaaaaaatttaatcataaagtagacagatttcaggtaaaaaggaaaacattggaaattagaatatgaaaacattgagataaatcaattttatagggtaagttttctaaattataaataaatgaaagatttgagaatttataaaatatgaacacaggctaagttcatgttagtattttatgaataaaagaggtgcaagtgggccgggcatggtggctcacgcctgtaatcccagcactttgggaggtcaagacgggtggatcacaaggtcaggagttcgagaccagcatggccaatatggtgaaaccccgtctgtattaaaaataaaaaaattagccaggcgtggtggcacgagcctgtagtcccacctactcaggaggctgaggcaaaagaatcacttgaacctgggaggcggaggttgcaatgagccaatatcacgccactgcactccagcctgggtgacagagtgagactccatctcaaaaaaacaaaacaaaaaaaaggtggaagctctgaagaaattaagagccatttaaaaaacagttatcaaaaagttaccctgtaggtatataaatacaatgttttaatttataagcttttccagactctcaaagagcaggtaatattagcaccatatgatgtacttaacatattttatgaggccaccattatcttcatatcaacacttggcatagtacacacagacacacacacacacacacacacacacacacacacacgcctctaccttatctataggccagtattatgaatataaatacaaataggttcaaaatggcaaactgagcacccacgtctgccatatctgacggtgaattattctgaagaaaagggtacattagtactggaaaatgagagaaggtgttagcagccgtaagtcttgagaactttctgtaagacgatagcagttagcgtaagatttctggaggagagaacagactagaatgtgttcaagagaacagtgagtgaagatggggctgctttgcatcctctgagctcatagcagacagaatggagggagcctggaataaacatgcttctctaggtgtgctgagaagcaggcatcacagggattgaccctcagtctaaggcagtgcatgtggtccctggagctggagaggctggtcggggtggctagggagcccctagactacaaaagtgaactactgttagcgcattccccctgagaccctgttctaatctccttgactgtgactggagataggccattgtaatcaaagctaacagccatggacttctgaacaatacttgaaacaaaagtgagtagcaattaaccaagactaaccaaacatttgaggaaaaacaatactatgaaagaggcaccaagtgttaatacacagaaaaattaacacatgagtatatgaatacagatagaaagtaattttaaaatatatctttgaggagattagagaaaatgttaaattcataaaacaggatttgttgctttaaaaaatcagaacttggaaattgtgaaaatatttttaaaatcagtaaatggtctgaatagcagaatggttacagttgaatcaaatttgtaaactggaagacaacccaactggacacgtaaagttcacgagataacatgagagaaaaattaagacaaggaagatcaagccagaagctcccaaattattaataggagttcagaaaagagagaatattgagtggaggaaatggaagaaagtttccagagctaagcagaaacaaatcttctggtgtttggagaacaacagtaaaaggacaattctaatagcttccagagacactaaaaatagcaaaacccagtttgttcacaaaggagtgacaatcagattggcattcgtcttctttttgaaaacactggtgttagaaaacaataaagcaatactatgaaaattctgaagaaaagtaactttgattctagaattcatattcaacctactattttaggacaaaatagacatttttgagctttcaaggactcagaatttatttctcaacagacctttgtaatcgagtccagcaaaatgataaatgtatacattgagagaggaggacctgagagtaaatagtggtgaacaaccaaaaaaattaagtctaaacatttgttgatgtaatagtgtaaatagttatgttgacataataaaaaggcaattaataccaatttgggattaagatgtcagcgggttatgtacatggtatacttatgtgtattacctagctgtcagctgagagggcctagaaccagtgacaccctaacagtaacaagtacactcagcttccaaatcttagtttctaatactattctccaatcaaacgagccagaggtccacggagaaatggttgattccagggcaggggcaaaaaatatacaagaagaccctggagcatcttacagtgccagaaagtaagaaagcactcaataaaaagatagggggaatatgtcgaaggggcacaggagccaacagaaagagctcccagtgcccaagctggaacaacctgagcaatgaaataaataacttaaacctggattataacccaaagcatcaagtaaatagccatgagtctatactgatacaaatgagtgagtgaatgagcagataaatattgagtgactagactagataggaaagaaaagttaagtcttccttacagaattccaaataacttatgtagatactccctcttccagtaggtggaactaggggactcactttcaaagaacatagtatggaaagaaaaaacaaacttttcacgggagaaacccagcagacaccttaaccaagggataccatgtacccatgacatgacataatgagaaggacactttagctcacagtcctcttccaaaaacgtagataacttccccaggaaagtcacagggaaagctgcagcaagcccacattgaggagcattgtacaaaatacctgaccattcttcctcaaaactgtcagggtcaccaaaaacaagactgagaaaccatcatagccaagaggagactaaggagacatgacaaccaaatgcaatgtggtgccctggactaggtcctagaatagaaaaaaaagacagtaaagggaaagctggtgaaatccaaatgaaatctggagttgagttaaatagtaatatagcaatgatggttccttagttttgacaaatgtaccacaacaatgtaagatgataacattaggggaagctaaaactggatgaggggtatacaggaactctctttactgttttgcaacttctttgtaaatctaaaattattccaaaataaaaggttgtatattaaaattaattaaaacaaaaagaggcaaataaagtcaacatagaagcgtgaagggaatgtaaaagcatgctaatactctttttttttttttttgagatggagtttcgctcttgttgcccagcctggagtgcagtggcatgatcttggctcactggaaactccaccttcccgtttcaagcgattctcctgcctcagcctcccaagtagctgggattacaggcacacaccaccacgcccagctaatttttgtatttttagtagagatggggtttcaccatgttggccagactggtctcgaactcctgaccttgtgatctgctggcctcagcctcccaaagtgttgggattataggcatgagccaccgcacccggccaaagcatgctaatattcttgcctggtttggagggttgtaggggaagaatgatttgaatgctgattcattctaggtgttgcatagcaacttaagtttaagcacttcaagttctagtttcaccacttgtaacctttgcaagttgcttaacttttctaagcttcagtctcctcacttaaaagacaaaaacttgttttccttgatgtttaaagctatattagaagtaaataagaaggaaaaaaatgggtaagacagttgataattcacatatttaaatagtcagccttactaggaataatttagaacagcagtataatgctttgtttctgctgttaggtcactgcttttaaaaagcaaagccatgtgagcaagactgggggatgggagctcctccgtcgcttctgttggggattcaggccagttctctgagtcgagttctaaacagattcatccctctgatccagtaatttccacccccaacagtctttcctggggaagtaatcgagctacatgatggtaatatgcataaattgataacattaaaagcaagcaaaactctaataataaaaggataaattgaattatggtacattctctggtgaatattgcatatcaaggaaaatgtgaaaaatgtaaatacagccgtgtaaatgaagaggaaaatgtaaagctaaaaagcgggaaatagcgtatctatattttaggtaacatttaaatgatgataatagctaatatttttatgaaccccttactatgtgcagggtacttgttctgttttgcctacacattaattcatttaatcctcctaacaacctctgaggtatgtagtattactgccccatttttcacagctgtgctgcagtcgagtgcctgtccaagtacacactggcctgagtaggcccaggaggctgggtgatgtggctccgcagcctccactcctgtccactgtgcacactgcctctgttatattaattcatcaaatattgagggtccctttgatgccacgcactatccaccactggcaccctgacacttagaccctaacagatatggctgttgctcgtgaggatctttatttattaggaggtgacagaaagtaaaatcagataatgcatgccacgtggatcattaaaacagactgagttgcaaagagtgactccgtggtttctgtggcttgtttggtcagaaaggtgtttctgagatgaagctgagcagagctgtccaaagaacaggaaagaaccagctaggctgtgattgggggatagtggtttcaggcagaaagaacagctactgggtttcctagggtgtttggagcacagccggtgaggggcacatagctgggccagggcatgtagagcttgttcagcctctggaaggcattgggattttatgctaagtatgttggaaagcctttggagggagaatggattgtgtgtggctctggctggcagcagccagttaggctttcacagtagacaaggggagatgattgtggcttgggtgacagtgtattataattacggagaaaggtttggatatgattcagagatagggctgacagagcttgctgttggattagatgtaggaaattagcaaaggaaaggaatgggagagcagagattgggattcaactggagccatagtagccatgtgttgtttatcagacatccaaggggaggtgccaaattgctagttggctacagggatctggcattctgtgagaggccaaggcttgggtatataggttatgtgtggataactgcatctcccacatgcttaggaggccagataaaacagtgcaagaaaatattaacaataaggattatggacaatttgagtttccttctactttcctttgtgaaaatgtgttgctttaaaaatcaaaccaatgattcctttttccaagtctgataatatttgaagaatttttagagaaactaagttacaaagttatagtacttatataatcagaattggcatggtgtagagatgtcaaagtgggtgttttgctttttaatactttgtatcagggttatattttaacaaagagataagaatattagagacaggagtggtggctcacacgtgtaatccgagcactttgggatgccgaggtgggtggatcaccagaggtcaagagttcgataccagcctggccaacatggtgaaaccctgtctctactataaataccaaaattagccaggtgtggtggcgcacacctgtaatcccagctgttcagcggactgaggcacggaaatcgcttgaacctgggagctggaggttgcagtgagccaagattgtgccactgccgtccagtctgggcaacacagtgagactctgtctcaaaataataataataatagagtctagtcttcattttgccactaaaattatgtctctctatatatttatttattcaacacgtatttattgaaagcttgtcatgtgcctggcattgttctaggtgctaggaatatagcagtgaacagaatccacaagtcctcccctcagggagctttacattctagaaggggaagaagttctccccctcagctcaaaaaaaaaaaaattgaaaagaaaaatgccaaactcatccatcagctccaatctgagctgagccctcagggctgcctggttcattatgtgttttcctgttgattctcctattctgtacagcagcaatttcagactgtgcccactcttctcaaaatttgtcacctctgcagaccttgatattcctgctatctgcaggaatttctgtgtaggtgccttacagatcactcagattcattatggccagaaccaactccatgttgttcctctctgggctggcccttcccctgggcttcatcttagggatagcaccattacatacccactgttcaggacggaagcctgctgtcatcttggttgatccttctccttcactccccactcctgcccattcaatcacttgctgacttctgtgaagtctctgacctaaatcttttccacattccacatccatacactcttttgcttttggtacataccacagtagcacacactagactagcagcttcccatccctagttatagctgttgcctcttttctttgtagcatgtatcaccacctaaaatgtatatttatttatttactattttcccacccaaacaaaggcgctttgatggcagggactttgtcacctctgtttattgctaagcctcagttactagaaccatatccaaaagattaaacacttgttgaaagtatgaataaaataaaaggtttatcaggcttcaacttgtaagcagaagtgattccaaggactcagtgtcatcaatgccctggttttatatttctttctctacttagacttaagtggtgacagcctcatattaaagctggtttctcgcatggtagaaaaggactttggcagttccaagcttcatagctgcatcgtgcactagaggtcaacaaatgttttctgtagagagccagataagaaatgttttaatctttataggccatacagttctgctgcaactactcaactctgccactgcactgtgaaagcacccatagacaatttgtaaacagatcaacacaactacgttccactaaaattatttactaaagcaggcagcaggccagatttagccagaggccatcgtttgctgaccctgccctacgaccaaatgtcctttctagtgagtctcttagaagaacgaaggagctttgttttccaaagttcccaacaaccaccctggtttacctacttggcctgatttttttttaaatacctattagtgagccagtaagtaagtgagccactatggtaagtggggtgagactgtctcactagtatagagactcatggcccactccgaatctactggtgacagcagcttccctgaattcatgggctgcccagggccaggtaattaccagaacaaaactgtaccaatcaggaagggggttgggggaatggatactgggtaggcaccagataaagtctactgtgtaaggttgatcctgtgtgttacaatttgtttatgcaactgttgtcctagaatgtaagccccttgaagtcaggcaccacaatgataattagtaacctcagcttgcaccttgtacaggctttgagttctatttttatttgttttgtaaggatttaataacataagtgcatgtgatccttaatcagtcacataaatgacaggaaaaaagtatacattagaaaataatttgtttcatcgttgattaaaacttctgcttcttatggaattaaattgttttctgtttttttttttttaactaaggttcacaaaaaggattctggcttttggcgagattttggctttggaatgacttgtcagtatcgttcagatttcctgaccattggtaagtatactttacatttaaggataggactttatttactccagacttaatggtattttgctaaaaggtctcagatttgagtgttttcctactaaagtatgagtgtctaaggttagctaaaaagagaaactggatatacaaaaggcaaaataagtttataattaatgttttgaataggaaaaaaatggtcataaaaataaagtataatatttacttgttcctttaaaatcaaaacacctgtttttaaaaatatctgtttaacttgttacccatagttgcaggtgtttagagtagtcttacaaaagctttctctataactttactgttgtgcccatgggttgttacagctgggagtaatcttggttatctagaccaaggactttcacatttttttgagatgaaacctcctttacttgtctagtgaactgttacacaaaatcccagtatttaatacaaatgaaagaagacctgctctttctagcgcgtcttggaatcacaccttagtcatgcattcccctaagcctaaagatggcccatgaataatttgttctaactatcctgcatgctctgttgtccaggctgaagagcagtggcacaatcttggctcactgcagcctctgcctcccaggctcaagcgatcctcctacctcaatccccaagtagctgtgaccacaggcgtgcaccaccacacccagttaatttttttgtttgttttgtagaggcggagcttcattatattgcctaggctggtcttgaactcctgggttcaagcaatctgcccaccttggcctcccaaagtgctgggattgcaggcgtgagccaccatgcccagcccctagcttcagtcttacccagcaaaatataaagtgtcaaagaatagtttaataaagcaggctgaaacctgattccatgtcttctgattcatttagggctagctacctttctacagcatagaagtcatagaatatattttatatacattctaggtccatatcacattcgtttttataaccagccttttgttttggaaatccccccaccttgtctccttatcattgtaacacttgaataatggaaaatcaggaaataacaataaaaggggcgttaaattaaactgatgctcttttccttgatttcttgcttagttaagcaagcagcatttcactattcctcaaaaatagatttgtgtacattttttcagtatcttgaatgctttgagttccttatctcttttttatgacaattttattgagatatagtttacatatcataaaatttattaatttaaagtgtacggttaaccaggtcatgtagctatcaccaccatcaaatttagagcatttcaccccaaaaagaaatcccatacccattaacaatcactcctcacatcctaccaaccctctttccccccaaacttaggcatctactggtctacttcctatagatttgcctcttctgggaatttaatagaaagcaaattgtacaatatgtggccttttatgactggcttctttcactcacataatgttttcaaagttcatccatgttgtgacatgttaggtacttcattcctttttatagccaaaaaatgttctattgtgtggttataccacattttgtttctccatttgtcagtttatatgcatttgagttgtttctactttttggctattataaatactgctgctgtgaacatttgtgtttaactttttgggtggacatagattttcaattctcttggacatatgcccaggactctggctgggtcatatggtaatcctgtgtttgaccttttgagaaattgccacaccgttttccaaagtggctgcatcattttacattcccaccagcagtgtttaggagttccagtttccccacatcctcattaatacatgttattatctttttgtttctagtatcacccatgatagtggatgtggtattgattgtgactctgattataatttttcttatgattaatgttgttgagcatctcttgatgtgtttattggccatttgtatatctttagtgaaatgtctgttcagatcctttgcccattttaattgggttatggagtttcttgggcttcttgaatatgtacattaatgtttttcatcaaatttgggaagtttcagccattatagtcatctctcagtacctgcatgggattggatccaggataccatgtggaaccaaaatccatggtcgatcaagtcccttatgtaaatatacatattttcatattacctgtgcatatctgcccatatactttaaaccatctctagattgcttataatacctaatacaggccaggcacggtggctcacgcctgtaatcccagcactttgggaggccgaggcgggcagatcacgaggtcaggagatcaagatcatcctggctaacaaggtaaaaccctgtctctactaaaaatacaaaaattagccaggcgtggtggcaggcgcctgtagtcccagctacttgggaggctgaggcaggagaatggcatgaacctgggaggcggagtttgcagtgagccgagattgcaccactgcactccagcctgggcaacagagtgagactccatcaaaaaaaaaaaaaaaaaaccctaatacaatgtaaatactatgtaaatagttgttatattgtatttaaatttttatatttattgttattttttatcgtttttttccctaatatttttgaaccatgttggttgattctatgggatgtggaactcatgcatatggagggctgactgtatttctttgaatactttttctgctccattctcatagttttctcctttgacactcactgtatgtatgttggtacatttaatggtatcccacatttttcttaggctctgtttatttctcttcattcttttctccctctgttcttcagattgcataatttctattgatctatccaagttctctgattgttttttctgttagatctactgttgagctactctaatgaatttttatttcagttactatagtttttaacttcagaatttctatgtggttcttttgatatatatataatttctttattaatactctatgtgatgaaacattgtcatcttctgttacttccttaagtgtgacttcttttaattctttgaacatacttacaatggctgctttggaatttttgtgtattaaagctaatgtctgggccctaacacaggcagtttttgttgcttgccggttttttttttttttttaagcgtatgtcacatcttcttgtttctttgcattcctcattatttctttttcgaaaactagacattttaggtaatacactgtggcaactctggatactgatttccctctaccaccacggcttggtttttttttttccttgtttatttatttattgacatggctggactattttaacaaattatttcttcctccttccccgaccttttggcaatatgaagcctctgctgttgctcctcagggcctgtgcagttatcctaggatggcattggatttagcagggctctctttatctctttccatgcctccattggtatcactcctattagactccactgactgttcactaattgctgtcttgtttttgacaatgctctggggcataaattgctccataatctgtccctactaaattgggcccttttgcagggatagtttttgcagcaagtctttgagatttgttcagaccccaggaggtatattcttactatctctctctgtggttctctctagtaaattagctggcctacagtttagctgttgccctcctggagttaccagcctcctcttaattgcttactaccaaaatctccattattttcaagaggctggaacttctctaaactctgaacttctctacattctattttaaataaagtcagttccttagggaagaactttggagcactttgttcttatggacttcctctcccccgggggaaaaaatccatgaggttttgccctgaggatggggacagtgacacacttattaagcagagtgaccacctctgccctatgagcaggacactgggtaggggcaggaggacccccagtattctcagctggccacacctggaagtggagcctccaccctgttgctgtgggctgggtgaaaaagagctgcacctgtttagaacttagactctttatttggagcttctgttcccttgtttcctttcttcctggtattcccattatacatatgttacatcttttgtagttgtcccaccgttcttagatattttgttcattttattttcagtctttttttttctttgattttctgttttggaaatttttattgtcatatcctcaagctcagagattgtttcttaagctaagtccggtctactaatgaacccatctaaggcattcatttatttcgcagtgtttttgatctctagcatttttttaaattccttagatccatctcactgcttatgttccgcatcttgtgtgttatctgctctttccattagagcccttagagtattatacatagttgttttaaattcccagcctgataattccaacatccctgctgtatctgaatctggatctggtacatgctctgtctgttcatactgtgtttttcttaacttttagtataccttgtcatgttttctgttgaaagttggacttgatatactgcgtaaaaggaactgcaataaataggcctttgatgatgtggtggtgaagtgtggagggagcggaagtgttctgtagtcccataagtaagtctcaatctcttagtgatcctgtatcccagactctgaatttcacacatgcttctcagtctcccctcctctcctggacaggatgactagaaggggctctagttgggtagatttcttcctccaagtcagttaggcactgataaaaccccagcaggttaggctctggttaaataacttctcctaaggacaggctttgttaataatgacaacatgctgtggcatactttaaaatgattaccttttccccttccccactgctggacgcattaagagatttttctctgatcttcaccactgaggacctaatagagctcctagaggtaaaactcacatgagtatgggggtcccaatatgaccaggtccccctggagtttttaacactcagacttacctcccctgagcctccagcaatttgtcgattacagttagggttttcctacctgggtactggtccccacagagatttctgctccagtaagttggaattctttgtatctgcctatctgtctcaccagttttgagggcagtggtttaccctgtgacctcacttctctgtgagagacctaagaggagttgttgctttttcagtgttcagcttttgacttgttaggatggagtgatgacttctagctccaggcatgccagaccagaaactgagaatgccccatttgttttaagtatatgtaccatctctaatattctaagagcttatatctacaaggaagaaaagctgatatgtatcagacatagcatttagtaaagctctgattgtttaatacttttcagagatccccagattattgtccatcctgttaatgtgaaattaagtgggatagaattatttgacaggagccgggcatggtggctcgaacttgtggtcccacttactaaggaggctaaggcagaaggatcacttgagcccaggagatggaggctgcagtgagctatgattgcacctctgcactccagcctgggcaacagagtgagaacacatctctgaaaaataaaaattatttgacaggccaggcacggtggctcacgcctgtaatcccagcactttgggaggccgaagtgagtggatcatctgaggtcaggagttcaagcttacgaagatgacgggattaagagattaaagtaaagacaggcaatcacaagggtattgattggggaagtgataaatgtccatgaaatcttcacaatttatgttcagagattgcagtaaagacaggagtaagaaattataaaagtattaatttggggaactaataaatgtccatgaaatcttcacaatttatgttcttctgccatggcttcagccagtccctccattcggggtccctgacttcctgcagcagcccactccagttagccttctgccccatcactctatcagaattgttctggggaagtttataagtaacatttatgctgccaggtccagtcagttcttcttaaattcttcactgaatagcacacacttgacaacttcttcctcaagacactttcttcacgtggctactacaatggcaccttttccagaattttctccctcacctggggccacttctcaatctcatttcctgacttaactttctttacctctatttaacctctagaaattggcatttcttagtgtttagacctaggccctgttttccttccaaattccttcagtaatttcattcattcctgtagctttaaataatctatggacccattctcaaatttatatctccagcttggccctttcttctttttccactctggggagtttttctatagcccagaaaagcgtgtgtctcaaaggacagaaaatgtggctggtcgcagtggctaatgcctgcaatccagcactttgggaagccaagtgggcggaacacttgaacccaaagttcgagaccagcctgggcaacatggtgataccccatctccaccaaaaaaaaaaaaaaagctgagtatggtgacatgcgcctgtggtcccagctactcggggctgagatgggaggatcgcctgagccacggaggtcgatgctgcagtgagccatgatcacaccactgcactccagcctgggtgacagagtgagaccctgtctcaaaaaaaaaaacaaaaaaaaaaagaaaacataaaaagttaatggtggtgagattataggtgacttgtattttcttctcctttatttgactttttgtagattttctacaggactttgaaatttacaaagtgttcttaaatatttaaccccattttgatactgtcaacaaccaaccttgagctccttgagtccaagtgtcagctcaaaactggacttccggtgactgggagtcactcctccatgccaggtgtctcgtgctacctttttgctgaaccatcccatcccttttgaagcagaacatttaaaattttatatatatccctgtgctctggctaataataggcagttatttatagtgtcaattttgatcttacaggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaagttaa
